United States Patent 9,328,346 (POLYCOMB-ASSOCIATED NON-CODING RNAS) - sequence listing, part 86

SEQ ID NO: 16036 - RNA, 111622 nt, Homo sapiens
cgguggcucggucucccggcugcgcgcggagcgggagggcucuccucacacaagcgcuuccuugccgagaggcuggagcugcggcaccgcaggccugagccaccccuucucugcugucuccuucucuuccucagggcucccgugucugcucgcccuccgacgcugcucagguuagaaagcccggagcgcgucuccgcugaggagcggucggggagcggggacacggagcagccggagcaggcgggcuccugacgggggcggcucugggggcugcgcggcgcugccuggugggcgcgaggcuuggcgggguuugggaguccggggggcgaggaggcggugcagugggauccgggcgcgggcgcccaagggcgguguagcgggugccggagcucccgaggugagggggcaauguauuagggauccugggggcucuuccggcuugggguagggguggguggcggcacacgggguccuaggucuuugacgucgagggagauuuaucagggucuugagcuucuuggaggugguguagcgggguuccgggacaaggggucuuuuuacccgggucccgagcucuuuggggcagagaaugcaguuuagcaagguuuacaccgguguaaaccuugucucuggaggcagaucaucggggucuuggggguucuuugagcgggcgugggcguccguuucgcauugcugggaugaagaagcaguguguccggguucuggggagaggggucuguucaucggugucuccgggugagagagcgauguauccguuccgcuggggccggggccgccuugggggguuguugggggcugaggguguguagcggcgaccagcgucuggccgggguuucugcuuugcccggagcggggcgguaacuuggcauggucuccagucuuuugggggcgacggggcgaguuagcuggcccccgggcagucucucggggugggcgcggcuccgcaggcgcuggguccgcugagggcgggagagggcuuuggugcuaccgcgcaggcugggcagcauccugaaacguuuuuguucaggucuccuucucucuggaugagauuuacucaaugcuuaguuggaggauugaucgguguuguugccuaguugaagaagcagugcguuuguucugcaguuuucuuuucucugccccgggaucccugugggggcgcgcuggucucgcuggagcuccgggagcuagaguggcagcaccuuaggugggcguuuggucugcagguucuuuaggaggccgguguccgcagguugagcguggauacagcuccugagcaacuggaaucuguugaggguggggaagacugauuuuggcuugcuuuccuaggugguggucugcuuugcucauccugcaugauuagaucuguucugaagucuugccugagugaauguuaggcagagucggauagugcagggaagcguguucugucuggcuucuuucuguccuuugaaaagcauuuguagagagggauaacgucaaauucagccuccagaaaacaauggaauuugaaaucccaaagcuagaacucugcaaaaacguuuucugugaccuguaaggaugguuaaucgagcuuuuuuagagaauucugcuuaacaguuucauuguauuguaaaaguguauuuagccuuggauauuacagagguuuugguaacuagcguaggcguaggugggauuuaaauaaaaugacuuguauguauguguauugguuaaaaaaaaaaacagcguauaggugagaaagccuauguguuugccugacauuucuuuugguuaguuacucuaucacagaggccuguauaugaaaguuaauguggcaggcagugaaguccguacucagagcuguucuguaaauauguaaucugggguuaacagacaaauuugaguauaccaaagcaaauaauuuugccugccuuagucuuuuucuucgugucaguuuuuuuuuuuucuuguuuuuugguuuguuucuuuugaaacagggacuuauuccgccuuccaggcuagguuguagcaucgcuaccauggcucacugcagccucgaccuccaaagcucaagcagcccucccaguucagcuucccauccccacccccaguagaggagcuggaacuacaugcaugugccaccacgccucacuaauuuuauuuauuuauuuauucaauuaauuaaagacaaggucuugcgcuguugcccagucuggucuugaacuccuggccucaagugauccuucagccucagcuucccaaaguacugggauuuagaggcgugagucaccaugccaggccucuuagauacaauuuuuuuuaaaagaugucauuuuuucugaucuuagaaccagacagauuagggauaauguacuuaauuuuggaauuuuacaucauuuugaaaaacaaaggaaucccgcacagcaauauuuaagacuuugaaggguuuaaaauaaguuuuguuguuguuguuauucagaccaaaauaccugguugacauuuacagcuaucacaacugauugcuugagcagauauuugguuggaaugacagcccccaaaccuguaagcagaucuuauuuuuccuuuuuuugagagaaagacaaagaacaaauuaagcagguuucagaaacuuuuuuuuuucuaaaaagcagcuuucaucauuucuaaguaaggcauagacugauaagucaacacauauuugauuaucugcuaggugucacagcgcuggauguacacugauuaaagcugucaugugacuuuccccuuuaaguccagagagaggaagaaaacaaauaaauacaguuaaaaauugugauacugcuaaggaagaaauacacaagguacuuaagauucagcucucuuuuuuuaguaaccccugaaugaugauacgauugauguguguugugauaauaagaaaccaagcaaaauaguuaacugccuucugaauuaguaaagaaagauuaaauuacaaucaguagaguuuuagguguuaaauguauguugacucuuuguagaugauugugcuacguaagcauacaaaagccuauaaggauacacaucagacuuaaccauguuuggauucuucaggagggaguugcagaggcauagaagagagcgguuuaauuuuauaguuuuauauuacuugaaucuauuucaaugagcagacauuacuuuuaaguacaaguuagagaaacccuaaaauuaaaacauuucagucacuaugcaaauggugaaauguacaguauuuauaaggcuuuugucaguauugccaguuguacccguguauacuaaugaaggaaaaggguauuucaaguaucugaaaauuauaagggugugcagggugggguggguagcacaacaaaauaagaaaagacacagaccuaaguaaaauguuaaaacauguuaaguuuguuggauauuuaauuauguaaagauaaauuaauuuuaggacuuucuuuuaucaaauuuaauuguuuccugaguuugcaaaaggaaguuuuuagauuuccuagaggagaauagggugggggaauagguauucuuauugugguacagacuucaggaaauuucuuuuugucaaacauauacacaucugauagauauauuuugcuugugaagcauacgaaccauacaaauaauuuuauaguuucauuauuacacugcugaaaaugacaguaccaaagugucuuuugaauuaucauucagaguucuagaaucauaaauaugauauacuaaagcaguuucuagaaaggaaaucauaagacaugaauuccagucuucacugugcuacucaugguguguccuuggauaauuccuuaaucuuucagggccccaguuuucauauauacauauaugaauuauacuuacauacauuuuauauauaauauauacuuuugcuuuaauauauacauauaugacauguguauguuguuauauacauaugccauauauguauauaauauguauaauauauaaaauauguguauaaaaagauacauauacacacacuuagaguuuuuguguugcaagucugaaguauuguauguacaaaaaggaagagauaccuuaagaguagcuaguucucaagaaacaacuaguuccauguaauuuuuacauauuauaccuaauuuuagaagccucuucuuuuuaaagguacauggcaaguauuuaauuccagaauauagauucaugaaggugagugauuuucuuuagauaauuuagcuuuaucuguuaaagcauuauuauuuuuaguuccaaucccugguucuguaguagauuaucuauauaauaauauguccuuacuuaacucuggauauagaaugaggucucuagugguugccuccagacuugauccccuuuaauccauccuuacauuacugccaaggugauuuuucugaagugcaaaucuauucauugcuucuuuucuuguuucuuuucucuuuucuuucucuuucuuucuuagaaauguuacugagauuuauuuauuuaucuuucaacuuuucuuuuaaguucaggggcacaugugcagaaugggcagguuugugacacagguaaacaugugccauagugauuuacugcacagaucaucccaucacccagguauaaagcccagcauccacuagcuauucuucucuuccugaugcugucucucccugcccuucuuucuuaaagcccauacuuuaucagcccaacucucuaucguuacaaggccuuucaucaucugacuaaucuuaugcauuucccccaccauaaaucuaaagcugcacuuguacuaauacgagcaguuuacugaaugagccauacuguuuccugacucagagccuucacauauguucucuccacuauuuaggaugucuuuccuucucuugucuugcuggcaaagucuacugauuuuuuaagauacaacguaagcacugucugcuuuuuuuuuuuuuuuuuuuuuagcucuuuuuuaguuaccauuuuuucuuuuuuuucuuucuuuacugucugcuuuuuaagucuucuggucuucccucuucccaacccuagguguuauauacucacuguaucauguucauucauucucuuguguuuacuaauguguuguaauuaagucucucuuuccuccuggacucaaaggcagguuuauauuugucuuauuacuuuuugacuuccuguugcuuguuuaugcauaguuggcuaucauuacauguuugaacucucaguaccaagauugauguguucaugaugucagaagugaguuaaacucaaaucucagucuuauccuguuuuccuaaaauuugggaguuucuaaaguaucuuauucucuugcccugugaccauaagcugauaugagaaugguaguucuuagcuuuguguuuaagaaauaagacuucucgcacuuuaagaggugaugguuacacuguuaaacuugcagaaaagucuuguagaauuuugaggcaacuacuaauccuuaucucuaaaauugcuagaagagauauuaacuaguuuggguguuuuaaaucuuggacaucauuauuugguagauauuuuaccuuggcugcuuuuuacuuggaaaaugauaguagcugauguaugcagguuuuuauauaggcuuuaauaauugcuuuacauacauugccauucauuuucaaaauaaauccuaaacauuuaauaauuugcucagcgucauuaucuacuaagaugcagacuaugacuacauguaggucugacugucuccagacucuaugcuuuuucuaauacuacacuguuuucugaauaugacugcuuauucaguguuuaaaauuauuaacauauuuaauucauuuuguaaauugaagaaguagguuguaaaguuuauccauucaguucuuccaaaaaagcuaaaguagacaauuugagauugauuggacuuuagagaccauuuaauccaacuccuuccuuuagcauaugaggaagcacacaugcaagagugguggaauggggugcugaagaucacacaguuaguuggucuauaagauuuucuuuguuaagcugguugugaacacugguguuauaaaacuauuacucgaggccaggcgcgguggcuuacgccucuaaucccagcacuuugggaggccgaggcgggcggauuaccugaagucaggaguucaagaccagccuggcuaacauggugaaaccccgucucuacuaaaaauacaaaaauuagccgggcgugguggcacacgccuguaaucccagcuauucgggaggcugaggcaggaaaauugcuugagccugggagacggagguugcagugagccgagauuguccagccuggccgacagaccuagacucugucucaaaaaaaaaaaaaaaaaaaaaaaaaggccgggugcgauggcucacacuugugaucccagcacuuugggaggcugaagcagguggaucacuugaguucaggaguucgagaccagccuggccaacauggugaaaccccgucucuacuaaaaauacaaaaauuagccaggugugguggugcacaccuguaaucccagguacucgggaggcugaggcaggagaauugcuugaacccgggacgcagagguugcaaugagcugagaucgcgccacugcacucaggcugggugacagagcaagacucaucucaaaaacaaaaaacaaaacaaaacaaaacaaacaaaaacuauugcuugaaagggauaccagaugcuugauuuucccccucaaggggaagaagcaaaagccuagaaugacuuuuuauaaaaguaauguugaggaucugagagucuuaaggacaaucagagaaaauccugacuuuggaucaugacacauggagacacgccagugccugaagcacaugguucccuaaucuuggcuccuuuccuuccucuuuuucuuucuuaaaauuuguccacaguuuacugaucuuaugccugcugaguuguuauuagcaucagucuuaccaguuaucauuuaagugccaaccaugggccaacuaauaggaauacagaaaugcauaaaaucuagucacugccaugaagaagcuuggucuguuugggagcggaaggcaguuuauaucuaauugcaagguaguguauaaagauaaccaugaguaguauaacuuuagcagcucagaagauuagguaaaugugggcugggcuagugguuacagaaauuucuauauagaaaaguuucuacuuaagucuuuaaaugaagaguuggaaugguguagaaagagaaaaagacuugggaaaaguuuuuuuuuuuuuuuuuuaaaucucagcuuuuacuaaucuuaccuugcuuacuuuccuucagccacacuccucacuguuucaugaggucuuuaacauguucuuucagauauccaaaugucucccuccuucacuuccuucaggucuuaauuaaaguauuauccuuuaucugagaacuuuacuggucaccuuguuuaaaaugacaauaucucuuccacacauacucuuccuauccuucuugccugcuuuguuucuuuuuugugcuuuucacuauccaacauacucuagauuuuuauugucuuucuacuccuacuaaaaaaaaguguaagagccggacacggugaugcaugccuguagucccaccuaccucggaggccgagguuggaggauugcuugagccuaggaguuugagaucagccugggcaaaaaaguaagacccugucucaaaaaaaagaguuaaauuaaaugaaaaauuaaaaaacauaagacccuccaggauagggauuuuuacccauuuuagucaauauuguauccccaacauacagaacggugcauuuuacaaaguaggugcucaaauuuuuguugaauuaauaagacaguggaacuuuaaagcaggagcuuaaaagaucauuugaucuaagccucucaucucuucuuuucuuucuuucuugcuggcaggcauggaggaagaggaacuuuccauuccaucuauuccuuuuuuuuuuuuuugagacggaguuucgcuucuguugcguaggcuggagugcaauggccugaucuggcucaccgcaaccucugccucccagguucaagugauucuccugccucagccuccugaguagcugggauuacaugcaugugccaccacucccggcuaauuuuguauuuuuaguagagaugggauuucuccauguuggucaggcuggucucaaacucccgaccucaggugauccgccuaccucggccucccaaagugcuuggauuacaggcgugagccacugccccuggcccauccauucuguuuuuuaaaaaauuugauaggacucgaagaaaaaauauauacaauaaaguacacaaaucauaaguauacagcucaaugaauuacauauguaaacauguaaccaacaaucagaucaagauagagaacauuuccaggaccuugaaagcuucccuccuguacucucuuagucauugcuuaacgaaaguuaccacuuuucugauacccaucacuauagauuaguuguguuuauuccugaaauucauauaaguggaaucaaaucauucuuuuaugucuaauuuccuguguugaacauuacaucugugaaauccauguuuuuugaguuaguaguaguaauucuuuuucauugcucuguauuauuucauuauacgagugucuauuugcgucuucuguugacagacauuugggcuguuuccaguguuuaguucuuagaaacaaagcuaccauaaacaauuuugugcauguguuuugguggccauaaaaauucauuuuuuggcaaagcgcuucauuuaaauauauaauaaaacauaucuccauauauauacacacauauacacacauaauucuuuuuuuuaauuauacuuuaaguucugggguacauaugcacaacgugcagguuuguuacauauguauacaugugccauguuggugugcugcaccugcaacucgucauuuacauuagguauaucuccuaaugcugucccuccccccaccccacaacaggcccuugugugugauguuccccuuccuguguccaaguguucucauuguucaauucucaccuaugaaugauaacaugugguguuugguuuuuugucccugcgauaguuugcugauaaugaugguuuccagcuucauccaugucccuacaaaggacaugaacucauccuuuuuuauugcugcauaguguuccaugguguguaugugccacauuuucuuaauccacccuaucauugauggacauuuggguugguuccaagucuuugcuauugugaauagugccgcaauaaacauacgaacacacauaauucuuaagcucacaugguuccucucacaugcuagaugaucauuaaaugauuaaagaugaauuaacuaaucucuuauuauaagauuauuucaaauguauuaaaauaauuuauucucucugcuaauaacauuuauguaaaucuuaguacauaaucuuucucccuaccugauuuguuuaaagaauaggaauaaaaacauuaagucaaaagauaagaccuuaaaaaaauuagacauugccauauugcuuucuagaaaguugcuaauuuauaugccaauaugaaacauuaguuuuaaaaaaacauuugcaauuugauaagcaaaauaucuuacuuaauuuguauuucuuugguuauaagugaaguugaaacauuguaaauuguuucauaaacaauuagauauuaaaauauuuauaauaaaacaauuuuuaaaagaaugccucagaugucuuguaagguaaaauauauuuuaucuagaauuauuguucuuuauuguuguuucuccuuuuaauagauaaauuuugaauaguuauuagaaaaacauaacaaaauucagagauagaaacaguugucccagaggcagccauuguuaacaguuuuuuauguauacuucuaaagauauuauagacuaugcauauauauguauauguguauaaauguguguauauguauauguuuguaaguguauguauauauauuugugugugcaugcauguguguaauguguguguauauaugccaaaacauuagaugaauuauggaaaccauucauuaaaauacuuucugguuuagauguguuauuguguaccauuuuguguauuaaaaauuagaaagggucuagcuaugauucguaucuggcuacuggcccagaaggaagaaaagcagggucuggcaguauuuggcgguaauuuucuguaagacaaguggccuuagcgcuccuuauuauugaaucaguucuuugacaauagcacuucuguuuauaguacugauucuguaguacuguuccaaagugaaaagccaaguuuuugaaaauuagacagaugauaccugaaagaagcucuuuaaauguaugaaagcuauuuggagguauuuaggaaaacauuuaggggaaagauacuuuauucuuaagcauuuuaggauucauuugcuugacaguuacaguuuuugcagaauuccucugacuacuguuuaacagugaaaauuugaguuugaauaauugcaaauaaaauuauucauuuacuuaaacuuuuauuuaccuaauuuaaaaaccaaauaaaauuauucauuuacuuaaacuuuuauuuaccuaauuuaaaaaccaaucacccucaauauaaacauauuuuaaaaauauuuuaagacaguuuuucaugauaauauauaguaguaauuugucucauauauaaaagauauuucugagcuugacuugaaugucacuguuaaauaaaugguuugagcaacaagagucagaaauuuuaauugguuucugcaggauuuuaaugguuuagggaaaagauauuuacuuuugggauauauucuuuuuuuuuuuuuuugagauggagucucgcacugucgcccgggcuggagugcaauggcaugaucuuggcucacugcaaccucggccucccagguucaagcaauucucuugccuuagccuccugaguagcugggauuacaggcgccugccaccaugcccggccaauuuuuuguauuuuuaguagagacgggguuucauuauguuggccaggcuggucucgaacuccugaccuugugauccacccaccuugaccucccaaagugcugggauuacaggcgugagccaccgcgcccugcucugggauagauucuuuuuaaggcccuuauuucaaaaacuaaaauuugggaaugacuauuguuuacugaauacuaacucacugacguagcccaggauaaguuagggguauuauaagaguuccuguuuacuggaauucuugucuccuacugaggauagauuauaaagcucuaagggccgcugaaagaauuuacaucuaauugugauugguaauauuuggggaauuugaagaaagaauuugucagagggaagagaucaucuugauuuuuuaaaaauguucaauuuugaaauauaucuuuauaggagaauugcaaagauaguccagaagauuuccaugugccauauacccuucacucagcuuucucuaauguucacaucuuauauaaucauguuauauugaucaaaacuaagaaauucauacugauuuuuuaaaagggaauucaauuaaccauuuuuuuugaagaccuauuauguauaaaagaguauuuuggcugcugaaguauguacaauaugggaaaacaaguaaagguuacagacaauaauagacugauaucagagcuuggugucauuccuugaacaaauucuuaaacagauuaucgaacacacguguugucgguacuuaacaaaagaaggcacugaucacuaggagccagcauggguucacaaagaacaaguaaugacaccuagcuucacuucuuuuuuuaugggguaagugaacuauuaauaguagauauaucagaagauacucuggccauaguauauauagaauuauugcuacauuuauuggauuuuaaauuacgugcugggcacuggauuaaaugcuuuuacauagguugucucauuaaguuauuguuuuacagaugaggaaagggucccucaagguuauacauauagcauuugacauccucuuaacgauaucuuuuuagacuagauagaaaaugugguccgaauaguuacauagguagguggauuaguaauugcuuaaauggccauauccagagcuugaugauuaaaauuaaacugcaguacauucuuaguggugugccucaagaagcuaucauguccuauuuaagauuuuuaucaguuacucugaaaauuguaagggaaugcugguauauauacagaaucagcaucuucacucuuacugccuuauuucuaauaguuaaaaaugacagacuguauuuagaaaauauuuguuacgaaauauguuauaagauuuuauauuugguguguaaauauuugauaaagaccggccuauaguugauuuuuuuuucagaagucugcacaaauacaagaugggaaucuuggagggcuaacagcaguagauguguguuuguuuaagcagaggugugugccugggugugucuccuuauuugucugcaguuggugagucagugguuuauuauaacuaucccaauauucagcaccugcuuaagcuacacuuugaagcauauuguccaaaacaguugauuauucuuuucuacucugcaucuagcuuaguucuguucuguuugccacauuuuaagguaggcauugauaaacaguguagugagaagagaguaaucagaaugaagcaugucuugaaacaguugcaaaguaauugaaacauugagguuguuuagcauggaagaaagaagaguugggguauaugauaauacuuuuuagauuggguaacuggaugaucuuuaauguucuuccugacucaaaucugagauucugugaaacaugaaggguuggcacauggaagaaggauuaagcauaucuuuugcauugcagucuggaggauggaacuaggaacaaugaaugaaaguuagaggaaggaaaauauugguucauaaugaagaagccuuuuuauuuuuuuaagagauggggucuugcucuguugcccaggcuggugacaauuugaauggaguaaacauucacucccugaggcacuaaagcauagauugaguaggguuuaaucaagcgauccuuuaaggacuuuuccaauuuaaaaauuuuuaaaaauuuucuucauugguuguaauuccaauuggcaaaacauuuucuugggcacuuauucacacuuauaauacuuauggcuucauacaguaucagauucuauuagagagaaugauaccuuccugauaaucaaaaucugaaauuauaguaugaaauaauuuaacuagauuuuuuauuuuuuugagacagggucuuacucugucauccaggcuggugugcaguggugugaucuuggcucacugcaaccucugcuuccugggcuaaagugauccuccagucucagccucccagguagcugggacuacaggcgcaugccaccacacccagcuaauuuuuguauuuuuguagagauggggcuuugccauguugcccaggcuggucuucaauuccugagcucaaagugauccaccugccuuggccucccaaagugaugggauuauaggcaugagccaccauaccuggccuuagaugauuuuuaaaaaguuuauucacaauuccgaaggaaacaagauuuuagucuuguuuuagaaaugucacagacuaauugaaguugcuuuuaaagaugauggcauaaguaucauuaaauucaaaugcuugugguuucucuucuguguaucuaaaaaaauguuaaugucaaaaacugaaaccacucaugccuguaaucccagcacuuugggaggcaaaggugggcagaucaccugaggucaggaguuugagaccaaccuggccuacauggugaaaccccgucacuacuaaaaauacaaaaauuagcugggcaugguggugggcaccuguaaucccagcuacucaggaggcugaagcagcagaaucacuugagccugggagguagagguugcauugcgcugagaucgcaccaguguauuccagccugggcgacaagagugaaacuaugucuaaaaaacaaaacaaaacaaaacaaaacaaacaaacaaacaaaaccccaaagauuauuaacuucuaaaugauucaguuguuuaaaucuaaaauggaacaguaaaccauuuuauucacugucaucccuuacacaaaucagagcuuuuuuuggccuucaugaccuucauauuuuuuuauccugagaauacucucuuucuuuaagcccaucuaaagucuaauuuuuaggacuuaacccugauccauuuuuuuaaagucaucucggguucuucuauccaacacugauauuuuucuuucuuuucuaacaguuugguaaucuauuaguacuauauccuauacuguuacuaauugcuuuauaauauguaagguuuuuuaaaaaaauuaacaggauuauaagccccuugaagacucuuuuacugaggcuugaaaacuacuuaaugaaauuaaaauuuacagacucggugguugaauuuuagcuaauguugaaacucuuaauagcaugagaaaaagccuaugcagaauuuccauguuuaguuucuacuuuuuuucuuuagcaauaugaucuuuagucuucaucugauguauuguaaaauuuacaaauaauaguaauauacccacuuuaaaaaugaaaaauaagaaaaagauuuuuccaucauccucacauucuuaauaccaccaucuccuaaauuuuggagucucccuuuuguuguuuuucaaugcauaugccaaugucuuugucauuagcccucagaaguggcaaauaauuuuaaaauguguauuucaaaacgaaauuucuuuuuagaaaaucaggagauacauucuaguaaauguacuuacuggaccucaguaguguacuuuuuacuuuguuacauucauaugaacaccaaaaaguuuaaugaauaaaauagaauauauuuuaacauguuuaagaaguaugucugugacaacaucuaauugagcuguugaugaaguuaguuuauagucaucagcuucauuuucuauauucuucauucccuguacaaaauacuugucauacccaguggguguuccagacuuagcauguuuuaaaaucaagguagcauugucauauuuuguuuugauuggcuuuugcucaggggaaguuuggguccauaucagagaucuguuugccuucuucacugaagcuaaugacuuucuguuaugugauaggcuuucacugcuucuucaugugggggcaucucugcaauguaaauugcuauuuuccaguuauuuuacuuaaauuaaaacaaauaaaguuucugaagacacucaggaaaugugugaauuuacugaguauauaaccuuagaacccuugagcaggaaaacaucaaaucacaaauagggaggugaguauacuggcuggcaaaucuuacauuguacuuugucauguaacacuguucacuuacucauuuuuagaagcuacaugugcauuauauacuaaugguauaucucucaaauaauugaaauaaugaaaaauugauaauucagagccacuuuuuauuuggcaugggaugugauuguuuuugcauuaccacauauuaaagucuaaaaggaguuaaauuuugugaucuaguaguuuucaguggaaccuuguuuuuuuuuuuuuuuuuuuuuuuugagacagggucuuguucuguugcccaggcuggagugcaguggugugauuucgggcucacugcaaccuccaccuccuggguucaagcgcuucuccugccucagccucccaaguagcugggacugcaggugggcaauaccacaccuggcuaauuuuuguauuuuuaguagagacaggguuucaccauguuggccaggcuggucucaaacuccugaccucagaugaucugcccaccucagccacccaaaguacugggauuacaggcaugcgucagccaccaccccuggcccauuuuuguuuuuuuuccucaaacaucuauauggcacugcaauauagaauacaaauaaaaaguaacauuuuuguauaacuuuaaguacauauuuauaacauuaacuuagcauaaaggggaucagugacauucaggguaggcucuuaaguugucuuaucuucacgacauucuauugccacuuuauuccuagcauuuaacagugccucauacauagcagauuccaaauguaucuuagugaaauaaaugaaugaaugacuuaggccauuuugauguacucaagaauuugaaauugaauaacugauaaugauuguaguuucucaaucucugcauuaaauuucuauuuuguuuugauuguacaauguccaccacaacuggaagaguuguuuuaguugguucuugagacuuagaguagaaucaggacacucucaaauugaacuaugacuuugaaaaaagaaguggauaauguuucaaaccugaaucaggaacauuucauauuugcuuuuuuuuuuuuuuugagacagucucuuugucaccuaggcuggagugcaauggugcaaucucggcucucugcaaccuuugccuccuggguucaagcgauucuugugccucagccuuccgaguagcugggauuauaggcaugcgccaccacacccagcuaauuuuuguauuuuaguagagacgggguuucaccacgcccagcuaauuuuuguauuuuuaguagagacagaguuuugccauguuaccaggcuggucucaaacuccugacuucaggugauccaucugccuuggucucccaaagugcugagauuacuggugugagccacugcacccggccuugcuuguguucuuuaugaugaauauaaaagaaguuaaacaggagauaucaccauuuuuugauaauuuuuaaaacaauaguacaauauguuaugagucccuuaguauaacagcuucacugaaguauaacuggcauauagugaauuacacaauuuaguaaguuuugauguagguauauaccugugaaaucauuaccacauucaaaauagugaccauacccaucaucuccagaaguuucuucaugcaugccccuuuauuaucuuuacuucaugccccuuuauuaucuuuaccucaugccccuuuauuaucuuuacuucaugccccuuuaucaucuuuacuucaugccgcuuuaucaucuuuacuucaugccgcuuuaucaucuuuacuucaugccccuccacacuccacccucucaaaguaaccauugaucuacuuaauguaacuacagauugauuguuuuguauuuucuagaguuuuauauaaauggaauuacauaguauguacuuuucuuuauagucuggcuucuuucacucaaauaauuauuuugagauucuucucuguuguugcauguauaaauaauucauucauuuuuuguaguaauaucccauuauauggguauaccaaaauuuaucauucauuugcugaugagcauuuggguuauuuacaguuuuauuuacaaauaaagcuguuacgaauauuaguguacgagucuuuauauggacauauauuuucauuucuuuugguuaaauaggaugacuaggucacaggguagguaucuguuuuaccuuuuuugggaauaacauauuuaucauaaagggcuaauuuucuuaauacacaaagagaucuuguagcucgguaagaguaagaucaaaaauccaacagaaaaaugggcagaggacaaaaccagguagcuaauaucaaaaaauauacaaauggcuuuaagcauaagaaaauauuuuuggaaagcugaacaaaaaacuuaauauguuguuuaaaauuuaaaccucuagagucagucugcuuggguuugcauauucucuaacaaucaguguaaucaaguucccuaaccuuccuguguuucaguuuucucaucaguaaaauguggcuaauaauagcaauaucaucuaccucaagggacuguuaugaguauuagauaaguuaauauauguggaguucucagaacaauaucugacacacaguaagugcucuauggaaguuuauuuuuauuauuauucaaaugcaaauuuaaacaggagaacauuuuuugauuaucagauugacaaggauuaaaaagcucaauaauacacaacacuggcaaagauaucuagaaucacuguuauauacuguaggcaggaacacaaauugugcaauuucuuuggaggacaaguugacuuuacauguuaaaaugauaaauauucauacuuuuucauucaauuuuaaauaauuuaucuuugcucuuuauaguauuaauuauauugucaaaaaacauauaugacucuuaguaggggucugguuaaauaaaugaugauauagccacacaaugggaugucauauagucauaaaaaaagaaaaaaggagcacuucuccauaagcuaaucucuaagacacauuauuggguuaaaaaaaaguaaguugcagagcaguguuuaugguaugccgcuuauauugcuguaaauaaguuguguauguguugguguaaauacacaugcauaugcacacauuaauaaacauauuuugcuucaaaaugcauagacuuuucuagaaggauacacaagaaagggaauaguuccuucugaagagggacuaaaagaagggaccaggagauuggaaaucagaucucgguaugacugugguuggguuugguuguguacacuuuuauacugcuugaguauuuauuucuugucaagagaauauuacauuaaaagaauuuguaguauguaauuauagauucacaggaaguuggaaaauucgugcagagagguaccauauacccuucauccaauuucaaacccugcugguaacaucuuauauaacccuagugcacuaucaaaaccaugaaauugauguuggacaauccaaagacuuuauucagauuucaccaguuuuacaggcacucauuguauguguguaauuguuugcaguuuuaucauguguaguuuugaccaccacagucaagauacagaacuguuucaucacaacagaaaucccugugccaucccuauauagucauaucucucauccuaaccacugacaacguaacuccuggccuuaaagagcauauaguuuuauaggggagauaauagagauauaccaacaauucaguacaaagaacaacacaaguggcugugugcaguggcucaugccugcaaucccagcacuucaggaagccaaggcggguggaucacuugagaggucaggaguucaagaccagccuggcuaacauggcgaaacccugucucuacuaaaaauacaaaaauuagcugggcgugguggugcaugccuguagucccagcuacucaggaggcugaggcacaagaauugcuugagccugggaaguggagguugcagugagcugugaaugcgccacugcacuccagccuggacgacagagugagacucugucucaaaaaccaauaccauaacaagugccaaaagaacguauuuauugcuuugagaguuaugagugaucaaauauuaaaaaaggaucagaaaaaucuucauggaaauaauuaguauaguuauaaggagaacuggcuauaguucugauucugcauuaaacaccacuaacuaaccagauguauaaaauaagaaaguugagagaaagauuuuuuuaguggucccuuuuaguauagucuuaauacuguggauaauuuggcaucauccuugaaggagggcuaugauuuuauucauuuaucaaauauuugaccauuuuaugccaggcacugcucuaggcucuguaaguaccucagugaacaaaacagacaaaaaucccuaccccuacccugagaagacauacauuuuagaugagugaauuaaaaaaaauguaaguuuacagcauguuagaagauaaguaguaaagaggaaaaauaaaccagggaagggggaauaaaguaugggaggaguuacacuucucuaaaggauggccaggaaaauucacugauaaggugacuuuuaaauaacaugaagacagucagugaaggagauaugacacaaauacaaaucauucuaggcccagggaauagcaaaugccaagucucugagguuggagcaugccugcgguauuuacauuugaagaagcuugucauuggaguugaguaaaggacuggguaauauaggaugaagucagaaagguaaugauggcacuggugaugggcugguugugcugccaggucaagcaaggucuuauagaccauuuuaaggacuucagcuuuuagacuaagugauacgugguauagaaagacauuggaugaguuggaacagaauagugacaugauuggacuuuuaaagagucagucuggcaacuguugagaguaggcuaaaggagaacaagggcagaagcagugaaaccaccuaggagacuguugcaguaauucaggugagaggugauggcuuggaccaaaaugguaguaguggugguggugaguaauugacauuuugaggucaacaggauuugggggacugggaagcagggagagaaaaaagagggaggcacagagguuaagggugauacaaaguuuguggucugagcaccuagaaggcuaguuacccauuugcuguuauggguaaaacuaugauggaagauuuuggaggagagaaguuggaucuuggacaaaguaaauuuaagauauaucuuagguauucuaagugagaugacugcuaacuaucugagucuagaguucaaaggaaaggaaugggcuagagguuuaaguuugggaauuauguauagaugcuauuuaaagaaaucagaucagaugacuucacuaagggaguaagcauaaagaggcgaagguccaggacagagauuuggagcacuacaacauuuaaaguuugggaaaugaagaacuagcaaaggaaacuuagaaggagaaaucacugaggcaagaggaaaaccaggagaacauggaaucuuggaagccaaugaagaaaguguuuugagaggagggaguaaugaaccccuugucagaugcugcucauaguuccaguaaagagaacugguaauugaauuggucauucuaguuugcaauguggaauucauuagugauucugacaagagcagguuugauagagugguggggaaauagacucauuggaauggauucaagagaaagggaagugagaaauuggagacaugcagaaagaaucauuuuucugaggaauuuugcugaagagggagggagagaaauagaauaguaacuuaagagagauguucaaagaguuuuuuuguuuuuuguuuuuguuuugacguguuuguaggaggcugagaaaaaaauggaaaauuugaugggauagacgaagagguaguggugguuaauggggaucuaguguguaaguaaaaagguugggucuuggguagagcagaaauaguucacgcuaguaaugaaagaggaaucagaauaugugggcacagacguaguuagguagaugugguuugagaguuuguagaaguucuuuuauugcuucuaguauuuuauuaguaaaauaggacacagggucauaagauaaaagugaggaugagagggaaggugauggaagauugaggagcaaaaaguugaaauaguuauguaagagaguggcagaauggaugaaucaggaaaauaagguauaauugucagucagcauuaaggaaacucauuugaggcuccuggccacgaauuuaaagagaaaccaauuuaucagacaucguguauuugugugugugugugugugugugugugugugagagagagagagagagagugcauguccauccagccacaugcagcuguguagguaucaacacagaauaggcagaaaauugcgcugaaagagagagagagagagagagaguccauccagccacaugcagcucuguagguaucaacauagaauaggcagaaaauugcauugguaacaacuagccaagcaagauugacauagucagaaggaagacaaguaguuaagcauguaugcaaaggaaggaaggaaguaaaugauugaauauggauuuaauuuggguaagaaggggauugaggacaugggaagguaaaaggaagugcagaagucaucagauuaguggacuacaggucuguuggguuggcagauuuuuuggaguuaggauauuagagguagugagcugguaucagagugugauacuuaaaaaugguauuucgaggcugggcaucaugccucauguguguaauccuagcacuucgggaggcugaggcagguggaucacuugaggucaggagauugagaccagccuggccaacauggugaaaccccgucucuacaaaaaaauacaaaaauuagucgggugugguggugcgugccuguagucccagcuacucaggaggcugaggugggaggaucacuugaguccagugagcugugauugcaccacugcacuccagccugggcgacagggugagacccugucucagaacaaaacaaaacaaaaaauggcauuuuggaaggguugcauuuauuaaaauugagaagguuuaagguuugacuguaugggaaugaguauaaaauaggguugagggaaggaucaguggaagauccuagaucuacugaagggcagaacuuccuuucugauaauaagaaacugacaagcaagaauugggaaaggauuguguggaugaugagauucccaagcauuaugaaaauaaugaugguguaaugagcaagcagcuaaaaucuucaagaaauaaaguggagagcuugauaacugcaguaaagaacggcuacagucugaugaugagauuucaguuuggauguuuuuagggaagaguuaggaagaauugucuggaaugggcaacuaggauugagaaagaauagaagcuuuuagucugaggaacugagccaccauuaucaggccuagagaggcacugaaaugaaauaauuaccucuggaagccacaugcugugugggcucuagacugauaccagguagccauaaaaugccaugugcuagacgccauaacucauacccuauaguucgacaauauauagucaaucacuaaucaaugcuauuucuguaaaccaaugagaauuccugucaaacaauuguguaucagucugcuccaugucccccuuugccuuuaaaaaccugcugguaacaaaggcugaauggggcacuccccaaggcaacuuggaaauguguccuaggcugcaggucucaaccuuggcucaaauaaauucucuauauuaauuuuacuucaguuucuuccuuuaggucaguaggaucaagaagaccuaccuucacauccaggcccugugguaugaggaguugggagggaaaacacauaacacuugagaaagcuucaggggaaaugccgauaacagagaaccaaguuguaguuagagcaagaaugacuuuaacuaguagaaccagugaagaacaucccaaauagaggaaacaccagaaacagagucacaaaagguacauuauuugauguuggagaauagcgacaacucuagugcaguuuagaauuuaagguuuauuccaguuugaugucuucguagucacaucccuuuuaguaucauguagaauuuauaggcauucucuauauuuuaacauccaggaauuuuucauaagaaugaacaucaaucccaauauugaaauaguaggacauggcuuaaugcugauccugaaccauuaauaaugauuuuuguuacagcuucccagccacuucuucaauuuaguuguagcucugggcaugcaaugcggaauaaugacaucucuccucccuuaugaauccuaccucccaccaagucucucaggaauacccaaaucagagaaaaauauuaauuauaaaaaauaagcauagagcucuuucaucucuuucccaaaguauuucuagaauuuuuucaccuaguuuauauuacuacauuuaaauuacccacuaauagaauaacaguguucuuaaaauauuuuuagaaauccaagagaccauguugguucuuaagcaccuuuuguuguucaucagcuacauguauuauaucacuaauauguuucaguuaggugucuuucaacuuuagauaucagaaagcccaauucaaacaaccuuacacaaugaagaaauuuauuagcuuaauguaacuggaaguccagaggaaaggcagucuuuaggauuagucaguuaguaccuuaaugaagacaccaaagauucagaucauuuccauuguuccacucugcuguccacagugcuggcuuuauuccagggugggauucucagauucucuucauacaguggguaccaggaaggagcuauauguucuauaaggaggaaaaauucuggcuuccuccuaacagaaaggacaaccuuaaccagaggccaccagcaaaccucuucuaccucuucuccuaucugauugacaugauuccuucucauaucugagucaguuucuggcagugaggauggauccaccauugagcuaaaguuaguucucccaguuuuugccacucagaguuguggcguggauauuggagaacacagucacaaugucugcuuacaguguuugccuugguuguguucuaaugcucugagguucuuuauucauucuuaucuguuacauuuuuauagugaguuaaaauaugcuucaucauacuuuauugguuuaauugccauguucagagcuuucugucauauagagaguagagcaauuauuaagcauuccuuucugcaaaaagggaaaaaugcuggaauagugaaaagauugaagauaguuggcaaauuugaaucuguaccuccuuauaaccaauaguuuuuaaccucuuucaaccuccaguaauugacuuagcuaucauuuacauagaaacuuuaguaauuugauuuguaucuccuuucucucugucaaaaguugccugaagcguugugguaaaguagaaaguggacuggguugugauuaaguuucuaauuaauucuagcuccacugcuuuccagaucugugugaucaugggcagauaacuucaucucagaccuucugcuugcuucucuguaagccuggagagaacuaccugucuucucaucaaguuguuuuuauuggaguuaguguagcgaaaacucucaaaccguguuuuuuucuacucucacaccaccacaaaaaucaucaucaauacagaagaagacuucugugaccaaagguauggggguuuuucccuacacaccaagcagugcacaucagcuggguauucuccaguucaauucuggcacugucuaccuggagaauuuaagaacaugccaaccuauccuuaagauaccagucacaaguccgggccaccccauccuucagacaccaguugcaaaucugggccucuggaacuucugaccaacugguuucaaguuggguuccucuuugggcccacuuccucuuugggcucaauuaauuugcuggaguggugcacagaacucagggaaauacuugcuuaccuuuagugguuuauuauaaaggauauauguagaggauacagaugaagcgaugcauagggugaaguaugggggaaggggugcggagcuuucauguccucccuggguaugcuacccccugggaaccuccguauguucagcuauccagaagcucucugaaccaguuuucuuggguuuuuaaagaagccucaugacaucaacauuccuuccuccaggguaugaggcaggacccucucuggagggucuuaagacccacugucagagaggcuggguagauuaaaguccugcuauagagccgauaaaaggagaagaggagaaggucagaggccugccucugaggccucacacccucagcauuauaacaaaagacaaacaagggcuauagggguuaggagccaggaaccaugaaugaaaaccaauguauauguaucauaaugcugcagaguuaaauaagcuaauaugaaagaaaucugauaaauauagaguagcaaacaauuuuaaauugccugaauuauuauauucuaauaguaaacuguaggcaguuaaagagaggaaccugaauaacacagaagauucugaugcuaaaaaauaaauaguugaucuuaguuucugaguaucuaagguguaucagaagaagauaaggaugugugcagcuuuuuugaaaguagaugcuuaaugaauaguuagcuacuaguuaguauauccaauggcuacuucucaaguauucccuagaauuuuuuuaacuuaaauuuuugccccuuuucuggcuaaagcuguuuuugaagguaucaacuagguauuauaagcuuuagggcuuuguguagcuuacaagguaugacagauacauuuauucaaauuauugacuguuuucucauauacacuuuuuuuuuccuuucuuggaauaucauucuuuugaagaaccccaggguuucacauugggugaaguuugguuguuauuaccaaaagagauagcacauuucauugcugagaacccucaagagcaagacuucauauuuggaguagaaugaaauuaagaugacacuaaagaauuugacuuauaaaaaacuaauauauccauucaaugucuuagguuaauguucauggugagucugaguauguuaauaaacuguauuagcuauaguuucuguaucucauuacuauugguuugaaacuggguauauaugcuucuuaaauuguugacauucaccuuuuuguuuugagcuagucacuguuaucugucauguuagacuuggggccauagcuuuuucuaaaugaaaagacuuaucuuaccauauuuuuuuucuuuuacauaagagauacuauuaauauauauaagccuugaaaggaaaaggauacuaauguauguugacuguguuacuauguacaagcauaccaaacauuuaacauuuguaucauuuaauucucccuucaaccuggugagagaguauuauuguccccauuuuacaaaaggaaacauugaaacauagagauuaaguaaacaaaauuacuauaauggagaaauccugcuuucuccuucccuuuuacccucagugggcauuuuucauaccugcuuucauuuaauuauacaacucuuugaagauguuauuaucauuuugcagaugaagaaaaacauuaacaugaauguacaauuuaaagaauaagaaaaugaaaauguguacuacauuaaggaauagaagccuauauaaaagguuuucguuugguuuuguuuacaucaauugauucucaaauguuaaaccaaccuugcuuuuuuucauaucaacacuacuuggggccggccaugguggcucaccugugcaaucucagcacuuugggaggcccaggcggguggauugcuugaagucaggaguucgagaccagcuuggccaacauggugaaaccccgucucuacuaaaaauacaaaaaauuagccaggcaugguggcacgcaccuguagucccagcuacucaggaggcugaggcaggagaaucacuucaaccugggaggcagagguuguagugaucagagcucgccccacugcacuccagccugggugacagagcgagacuccaucucaaaaaacaaaaaacaacaacaacaaaaaaauuagcugggccugguggugcaugccuguaguccuagcuacccaggagucugaggcagagaaucacuugaacugggagguggagguugccaagauugccacugcacuccagcuugggcgacagagugagacuccgucucaaaacaaaaacaaaaaacaaaacaaaacaaaaaaacacaacuuggucaugagguauuguacuuuuuacauauuguuggauuugauuuaugucauauuaaguauuuuuacaucuauauucauaggaaaauuggucuauaguuuucuuauaauaucuuaguuugguuuugauacagggucauggugcccuuuuagaaugacuugagaaguguucucucuucuucaauuuucuggauaagccuuuuagaauuaguauuauuucuuccuuaaauguuuguuagaauugaccagugaagucagcuggaccuggaaguuuucuuuguggggugguuuuuaacuguaauuucaauuccuuuaauauauguaagguuauucagguuaucuguuucuucuugagugagcuuuauaauuugucuuucauggaauuugucuguuucaucuaaguuguuaaaucuauugacaucaaguugcucaugacguucucuuacccuuuuaaugucugucuuuaauuuaucucucucacuugugauauugguaauuuauguauuuucucuccaccccccuccuccauuagucuggcuagugauuuauuaauuuuauugaucucagagagccagcauuugcuuucauugacucaauaaaaaauuuuaaauaaacuuuauuuuuuuagagcaguuuuagguucacagcaaaauugaguggaaaauacagaguucuuauaucccccccaccagccuuucccacuucaacauuucacaccagaagugguauauuuguuacaacugaaccuacagugauguaucauuaucacccaaaguccauaauuuacauugggguucacucuugauguuguacauucuguggguuuugacaaauguguaauggcauauaucuaccauuaucauauuaucauacaaaauaguuccacucuccuaaaaauccucugugcuccaccuguucaucccuaccucccaguuaaccccuggcaaccacugaucuuuucacucucuccauagucuuugccuuuuucaaaguuucauacaguugaaaucauauaguaugucaccuuuucagauuggcuucuuucacguaguaauauauacguuuaagguucuugcaugucuuuucaugcauggcaugauugcucauuucucuuuagcgcugaaucauauuccauugucuggaugugccacgguuuauuuauccauucaccuacugaaggacauauugguggcuuccaaguuugggcaauuaugaauaaaacugcuauaaacauaaggacauacguuuucgacucauuugggucacuaccaaggagcaugauugcuggaucauaugguaagaguauauuuaguuuuguaagaaacugccaaacugucuuccaaaguggcuuuaccauuuugcauuuuacugaucucaaagaaccagcuuuugguuucguugacuuuuuucuauuucuuuucuguuguacguguauguuuuucauuccugcucaucuaucuuuucuuucuucuccuucuguguacuucccuucagaagaggaggacacacuuacugcuuaggauuagcuugcuuuucucuuucuaauuuuuuuuuaacuuuuauuuuaaguucagggguacaugugcagguuuguuauauagguaaacuugugucauggagguuuguuguacagauuauuuugucacucagguauuaagccuagcacccuuuaguuaguuuuccugauccucucccucaucccacucuccacccuccaguaggccccaacuaauuuccuaaagugaaagccuaggucacugauuugagaccuucuuuucuaacauucagaaguauauuguuuaguuuccagauguuuggagauuuuuuuuuagauguuuuucuaauuuuaauuucuaauauaauuuuauugugaucagagaauauacuuugcaugcuuugaaauccuugaaacuuagugagaauguuuuauggcucagaauauagucugaguugggguguuguuccauguguacuugaaaagauguguauucugcuguaauuuggugguggauucuauaaauguuaauuagaucaaguugguugcuagugguguucaaguuuacuauguccuuacuaaguuuuugucuacuaguugugucauuauugagagauuuguugaaaucucugacaauaauuguggauuugucuguuugugcuuguaauuuuaucagguuuugcuuuaggcauuuugaagcucuguuacuagcuuaggauuuuucuucuugaugaauucaucccuuuacucauugugaaauuauucuuuuuauucuuaguaauaaucuuuacuguaaaauauacuuuaucuguuauuaauauagauacucuagcucuccuuugauuaguguuagcccaguuaacaauccuuuaaccuuuauguguuuuuauauuuaaaauggguuucuuguagacagcauauaguuggguuuuacuucuuuuuaaauacaaucugacaaucucuaucccuuuuaaucaggaguuuagaccauuuagucuuaauaugaugacugguaugauuagacuuuugucuacuguugugcuguuuguuuucuauuugucccauuucuucuuugcauuuuucucucuuuucuuggcauucuuuuggauugagaaguuuuuaauguucuauuuuacuugcacuauugucuuaggaacuuugccucuuuucuuuuuuagugguuguccuaggauuacauucuauaucuuuaacuuacaccguguuccuacacauuauauuauacaacuucuauauuuuacuucuguauuuguuaaaaaccccacaguagauuguaauuaugguuguuuuaaaccauuuuauuuuaaagaguuguaaaaauaagaaauaucuuuuauaguuacccacauauuuacuccacuguaccucaugucuuuguaugguuccauguuuuuguuuaguaucauuuuucuucugcaaaaaaucuuucucaauauuuuuuauugugcaguucuacuggugacagauuuucucggcuuuuaugugucugaaaaauuacaucaacauuucagaaagauauuuuuacuggguaccaaauuguaguguaucaccuccgguuuggugguuggcuaggaggacucgggacuuagcauauagucaaacucaugguuaugacuuaucacagcagaaggguacaaagcuaaauuagcaaaugggaaagguucaugggugaagucuggaggaaacaaggcacaagcuuacacgaaucuucucccaguggaaucaugcaggauacauuuaauuuaacaaugaauugugacaacacaugugaauacaguugaacaggaagcucauuagagacucagugcccaaggguuuuauugggagcuggucagguaagcguccucugccuagcauguagcaaaauuccaguuuccaagaaggaaagcagauguucagaauauuguuugcauaaauacuucaggcacaguaaaacacccuuuuuaguuagggaaugucaggaacccuuuugaaguucaaguucuuagacaccagccaaggccuaaccuuacaaguaggccuuucuaaggauagcacuccugagccugcuguguuaccuuuuuccugcauacuagguugccuuguuuuuuuccuuuucuguacuuuguagauuuuaauuuauugucuucugacuuguauagcuucaaggagaaaucugugaugacuuaucuuugcuccauugaauguaauguaccuuuuuaccucuggcugcuuuaaauguuuucuuuaucauuauuuucagcaauguaugugugaauguguguuuguguuuauccugcuagauauugcuugaacuucugggaacuguggguuuguaguuuucaacaaaguggaaauuucuguagcuauuuuuuccaauauugcccuacucuuuuuguuuucaugcuuucauuaugguuauguugauugccgacauugcuacagaggucauggcaucuuuauuuuuuggagggguuauguguguguguguguguuucucucugucuucauuuuuggauaguuuuauuccugugucuucaauuuacuaauacuuucuuuuguaguggcuaaucugcuacaaaucuuauauaauaauauuuuuauuucaaguauuuuuuuauauguagaaguuuuauuugauucuuuuauguuucuuugucuccucauuguguuuggguuuucucuuaugcuguugaggaaacauuuguuauagcuguuuuaauguucucaucucuuaauuugaucaucucuuucauuucugguucuguuaauauugacuguuuuucuaguucacaagucacauuuuauugcuucuugauaggucuaauaguuuuuuaucgaaugcucauuauugugaauuuuauguuauuugcuggauuugguugcauuauuuuaaaggauguuaguuuuuuucuaguaugccacuguuacuuacagauaaguucgauccuuucaaagcuuauuuuuaugcagcuucagggagaaucuagaguagccuuaaggacuaauuuaaccucacuucuaaugcaugguccuucuggagucacucauggcugcccugcuauucagcaagauuucaccacuuuggguaauacaaauuuuaacaauuccuggccuuuugugagcacugacaguuguuuaucuuacaacuccugguaauuuucuuuuucuaaagguugauguuuuauuuugcccagccucuuggggguucacccuccacauguauaacuuguauucagccaaagauccaguaggacugcugugcauuuuuugggaucucuuuccguguugaucucuucucucaggcaucugcccccucccccucccccugaauucuagcuguuuuggccucccuaaacucugauauaugucuuuucaauucagcaauguuccuagguucuuaugagguuaccuuucccugcgccauuguuuguaaauuaccuccaggcagaagcuggagggcccuauuauuauugcccuuuuagggcaauagucugguaucauagacuugugcugccuuuguucagugccagcaaauaguuuccucuauuuuauccaauuucugguuguuagggagaaggauauuuccagacccucuuuguccuucauauucagaaguggaaaucucccuauaaacauugcauacuuuuccauuuauaccauaaauguuucccuuuucugaagcaacuucauccucguaaugugugaaaaugucaagccuuuacuuuuuucuuauuauauucagaagauaauaaugaugcaugugaucaggaucucaaacuucagauuuugcucagauuuuguuucaaauuuuuguauucacaaaaaaucuccuaugccuuugaugaacaucuagguaucacuguggaucugggcuccaaggagggugaggcaaggggggcgccuaagguacaaaauuuaaggagacacugacucucagaugucaauccugugcuuguacuaccuggagaguaagugucuccuuaaauuuuguacccuagaugccuuguuugcuucagucuaguacacgcuuugcacuggauauuccagacuaagaucacuuuuauuaccuagggcauuagucucaaaccauuauuaacuagaucacauauugccuuuguaguaggugucuuuuuuaccuucauaguuaaauuauuuaaacuucucugaccaucuauuuuuuuggaggaguuguaauaaagucugauguaaaaugccaguuccuuaguauuggcugagaaaugagagaagaaaagaaaagaguauucaggguagcaaauacugucccacaaagccaaaaccauguguacugaagccuuaccuauuuuuaguuuagucggccuuggcccuagaaaacaguuccucucccuaccuaggccagauuccauuaauuccaugugggcuguugcccacugggcaugcagcuguauuugcaguuugagagucccaaguaagccugacuaggcuucaaaaaugaaucuagauuuauacuaaggaauuuuaauaugggucagagacaugcaguuggucucugauggugggaagaacagaguuuuuaaucuuacauaaaauguacucucuuugaggucuuugguuugugacccacuuuuggauugccuuagaguguucuugcagcuggaaugauaaaggaaucucuuuucucucuucuuagaauauuaaaggagacaggaagaaguccagaugaagugacucauggaaccauuuguuuaucugaaccugagcuaaaucuuaggagagaaggguaaaaauaauucauucuuauuauuuuuaguccagauuaccaggauuuuucagauagugauguagguauggguucuggcaguaauaaacggcaauuuuacccagaauggcaucuguuaaauaucuuccucuggcacuugaagugguauuugguaucuguuugauaguucagggguuguucuaaaacauugauccugugugcagaaaguaaccauuaaucucauguuacuacugcuugacucaauuuucuuuauuuuuauuuucuuggacuuuucuuuuuuaaaaaauaagaagaguagcauauuuguaccaucugcaaagcacuuuuauaauggauuggaaugugaaaaucucuaauccagaaggaagauucuuauauagucuuuauagauaaaugcaauguaccuuucuuuaauuacugggugagguaauauguugugaaagaaaauagugaacuuggauucaaaaaaaccuaauuauaguucagguugaacugcuuguagcucugugaccuugagcaggccaguuaaucucuuugagagucacuuuuuuccaucugcaaaguauguguauguaugugggaggugggggaggaugugauaaaaucugccugccuauuuauucgugucagugugaagagcauaauaaagaugugaaagcacuugggaaauguguaaagaacauauacauacaaauguaaaaaugauauuuauaaguauuuuaucucagcaaaaucaagucuuguuuuuaucuuugggacacuguguaaauauagucucagcuaaauuuuuuuuuuaaaaucacugauagcuuagaaaaagagaaguaaaaaaauacguauauuggaaaauggauggaaaacacaucaaagguuacaaguuaccuaugaaagaauugauaaaaucuccuuagaguuuguguguguguguguuuguguguauuaacaaaauuugaaauuuuuacuuaccuucucuuucaccucuagacuuugaaagucuguaucagauuuugugacauauuguauguggauugucuacuuuagauuauccauggaaaacuauuuuuuaaaaucagucguguugcuccuuguugucuaagacaauucuggauguuuucuccugauugguauguuuucaggggaaugcaaacuaauuuaauauagcccugguguguauaaugaggguguuaaaucugucagaacacaaaucacaaugauugaaauaugaauguaauauuuugguaccuuugaaacuauuaaauuacuccccuauauuacauuaaaucagugagagaauucccuugguugguucauucauucauuaaacaaauauuaauaccauuccuacuauugccagguacuguuguaucacauacaacaguaaacaaaacagacaaaaauuucugccucuauggagcuuacauucuagcugagagggaaacugaaacuaacagauaaaauauauacuguaucagauagcaaaauaaaggagggaaaggggaugggggaguguuggaaggcauggcaguuggaggagggcaggccugggaaggauugugacauuugagugaagaccuacaaggaaucuguacagauaucucagggaagaacauuccuguucuaagguauagcaaggguaacagauuugaggaaagugugugccuaguauguucaaggaacaaggaggaggcuagugugacugaaguggagugagcauggaguguuaggcuggugcagacauaauugcgguuuuugcauuguuuaaauuugcuguuugguauuggaauacauuauuaaauaaaugugguuauguuauacauaauuuuaaugugcauuucuugcuuuguuuugcuaaugacuuauuacuugcuguuuauuuuauauuuauuuagacuauggaaaugauguuagacaaaaagcaaauucaagugauuuucuuauucaaguucaaaaugggucauaaagcagcagagacaacucgcagcaucaacaaugcauuuggcccagaaauugcuaacaaagguacagugcaguggugguucaagaacuuuugcaaaggagacgagagccgugaagaugaggaguguugugcccggccaucaaaaguuggcaacgaccaauugagagcaaucaucgaagcugauccucuuacaacacuagaaguugccgagaacucaacaucaaccauccuacggucauucagcauuugaagcaaauuagaagguuguaaaagcucgauaagugggugccucaugagcugacugaaaauaaaaacaaucgucauuuugaaguguugucuucucuuacuuuguguaacaacaaugaaccauuucuugaucagauugugacgugcguugguaaguggauuuuauaugacaaccgcugaugaccagcuuggugguuggacugagaagaagcuccagagcacuucccaaagccaaacuucuaccaaaauguuaauggucacuguuugauggucugcugccggucugauccacuacagcuuucugaguuccagcaaaaccauuacaucugagaaguaugcucaacaaaucucugagaugcauggaaagcugcaacgccugcagccagcauugaucaacauaaagggcccaguccuucggcacaacaaugccugacaaugcgucgcacaaccaacgcuucaaaaguugaaugaauugggcacaaaguuuugccucauccaccguauucaccugacuucuugccaacugacuaccacuucuucaagcaucucagcaacuuuuugcagggaagauguuuccacaaccagaaugcagaaaaagcuuuccaagaguuuaucgaaucccagaucacacauuuuuacacuacaggaauaaauaaacuuauuucucauuggcaaaaauguguugauuguaauguuuccuauuuugaugaauaaagauguguuugagccuaguuauaauauaaugauuuaaaauucacgguacaaaaccgcaauuacuuuugcaccaaccuaauaagauuaaaaccaguagagguggguauuuugagaaccauguauuucaaggacggaauuauuguuugugucagcuacugcucauagguaaaauaagaggaagucggagaaucgauuguuguguuuagcaauguggaagauguuggugaccuuaaauaagugcaaguugguagacagaugggaugaaaagcuugguugauauggauucaggagaaaaugggagauguggagacagugaguguagauaacacuuuugaguuuuauuguaaagggggaacuaugcacauuugguguguagaguuaagagagugggcuuuaaaaaauuuuuugguucuauguuuaaugugacaggaauaauccaguagagagggaauauuugacaaugcaguagaaggaagagaaaauugcugcagcaguuuucuugaauaggugggaaauaauugggauuaccuuuaguuuuccaaagugaccauuguauuucuuugaugcuuauaauucacauucuucccuuuuaaagaacaucagugccugagccuuuuuauauacauauccuuucuuaugucuguaccuuaccccucacauguauacuuuuuucuuuuuuuuaaaaaacccugcauguggcauucaaacacauguaugcuuuuaucagagccccuaaaauacuuuauuacauuuauuuacaugucucacccauuacuggauugucgauaccuugaucuauguuauuacucaacuauugguucuuugacuguaguguuuuuauucauugcuacaugccuauauuaguuacccauuguugcauaacaaauuacuuuaaaacauagccacucaaaacacacauuuauuauauugcagugagucaggaauccaggaacagcauaggugcugggucucuuacaagguuaugaaccaauguguugacagggccugaagucucaucagaaaucuugaugugaaaggauccauuuucuaggucacucauaaggcaggauucauuucuucucaggcuguuggccagaggccucccuuggacccgugccaaagggccccauagagcaucucacaguauggcaguugacuuagagcaaacaagcaagagggcaagaaaaagugccagcaaaagagagugcuagcaagaagcacaucacaauuuuuauaaccuaaucacagaagugacuucccaucacuguugccauauuuucuuuauuuuuuaaaauugagacagagucuuacuauguugcccaggcuggucuugaacuccugggcucaagugauccuccugccuuggccucccaaagucuugggauuacaggcgugaaccaccaugcuuggccaauauuuucuucuuuauaagcaaguuacuaggucuagcccacacuuaaagaggguuacacaacaugugacuaucagaaggcagggaucacugcagggacguauuagaaguccgccacccgguccccaaacucuagaacuauaaaaaugcuuaacuuguugaaugaauuaaccuuuuuccaagcacccucauaacugguaguguacauuuguaagagggcuggucaaggguaagaauuugguuugagacuguauacagaauaacuugauacucauggauuauuucaacuguuucuuguuuccuuaaugauuugcuuuuaugaaauaauguuaaugaaaaguucaagucauuuuguaucuucaggagcuaagcaaaaccaggaaugcuauucaagaaaaucagaauacaugcaguauauuuuaauaggaauucuagaaauaaucugauagcaagcuguauuuugagauaauucaagcuuccagucauuccuaacauauauacccuuuuaugacauggaugagcauaaggauauauaaaaaucugugcaauugaaauguaguugaauuugaucucuacuauaaaauaaucuuuauaaaaauaagauuuuaacagguaggaauaagcaucaucaaucagaucauggauuucaauuuuuuugcauaguuuacauguugaggugauuuaaucuuuugaagaaaacuaaggaaucucauccucuuauaaaauguuagauauuagaaauaacuuguccaauccuauauuuuuauaguugaggaaauggcuacccagugacguacccaagcuuucugguggcacggccagugccagaucccaggccuccugacuccauucagugcacuguaccaugccuuaaaccauacuggagccacuuggggaguuuaaaaacuuuuaugcuucucuuauccccagaccuuuugauuuaauugguauggguuagaacuuggucauuggaaguuuuaaacacgccccaggugauucaugcaucauagucugggaaccucuacuccaaaaagaauuagugugcuugaggaauuggaacuagagugaaaucagugguacagacuucuauccguuaugauuccuuaaucacuuauuuggcuggguuuuaucagaguaguaagacaauuuuuuacauugagaaauaauuaagauauaugcagagcaaagacuuccuuaauaaaacuguccuuucacuaguauuuugugagauagccugugacaaaauuuuuccuaaucaugaaauuggagaacaauuuuuugacacuaaucaggcaaggagaaaguuucgugccaucuguguuguggcaugcucugcuguuguuuuaacuagauaaaauucuaauuacuguuaaacagauuguuuaugagguuguuuuuaauauuuuagagcaagugcauaaauauaaagaggcaaagaaaugguuccagauuuaaaauacaguuucuuuaaaaguaaaucagaauuugacacacuggguuguuuaauuacacauuucaguuuggguccuugguacugcaauguugcaaggcauaugaaauuugcaguuuguuacaacuauucuguugugucguuuuauacuuuuggauauaaagcugaccaaacauucuaacuagaaaauacuaauucaugauugauaaguggcauuuuguuucuacauauuguucuuuuaaacaaggucuuucuuugauaaugacagauguagggaauaugaagcagaagagguaagaauaggagauuaugaucagaucaaagcauuucagaauguuaaaucuuuuauugaaccaguaucaggguguugacaagaaaagcuauauauuuggguugcuagaguagaagcgauaaggggcauauuaguuuucuauugcuaccaucauaaaucaauacaaacuugguagcuuaaacagaaagcuuuuuaaucuuacaguucugugagucaguaggccaauccaggucucauuggguuaaaauaaaaauuucagcauggccauguuccuuucuggaggcuguagggcaagaucaguuuccuugcuuauaugagguuuugguagaauucacuuccuugugguuguagcauuugucuugaucagagcccuuucuagcaccuacauuccacccucguucccuggcauguggcccuccuucaucuucaaagccaguaacaaaggucaagucccucucaagcuuccaguauuuccuucuccuuugauuuaaacucucugauccaccuucugucuuccucuuccacuuuaaaagccucaugugaugagauugggccuaccuggauaauacagaguaaucucucccaucucaaguuccuuaaccuuaauuacaacugcaagucccuuuugccauguaagguaacuuagguuccagugcuuaagggcacagacaucuuuggagggccauuguucugccugucaaagagggcuagaucacuggagucaaggaagccaagugucaguauugacauagcuguugaaagucuucauuuauacaacaaauuuuuuuuagugcuugcugugucuagucauuguaguaggcacuggggcuauugugguaaacaagacagacauaguaucugcccuugccuaucuagcaguauacuuauaaaaacaaguaaaacauauagcauugcuuuauaaagaauucuucauguauuccauauuuauguaagcucuuugaaagccaguacuaguguucuuuguuuuggcccuuuccucaucccaucacuacagcaguguuuuacauacuagaugcuuaacagauacuguuaacaaaggcuuacuuuguuuuuucuuugcauugaguuagaaaccucauuuaucucucuuuuuuucuauuuucugcuucaaaagcagugaggaauuuugaguucaaaaauccagacuuagaggacaauuuaagauuuaaucagauacccacugaggaauuuuuaaaaaguccuuaagaaugaccauguacuccauuuuacuuuucuugguaaagacucuaaagugcuaaaggcagcucuguuuugcuuuuuccuccuccuccuccuauuauuauuauuacuguuauuuuugagaaagggucuggcucugucacccaggcuggagugcauugguaugagcacaggcucacuguagccuugaccuccucagcucaaacagucuuccuaccucagccucccaacgaacugggacuauaggcacacuguaccacaucuggcuauuuuuuacaucuucuguagagauggagucucacuauguuacccaggcuggucuugagcuccugggcucaaacuauccuuacaccuuggccucccaaaaugaugggauuauaggcaugaaccacgguucccagccuugcuuucaccuccuaaauucaacagucagagaguacuuacccaauuaaaaaaaaaaaucaacaguugcuuuaaaccaguauucaccuauagugaagaacugccaacucagaagcaaauuaaaauaaauuuuucaauauggcuuuucugagauagauagacuuuuaaaauaauggaagagauuuacuaucuguuggucacugcucucagagcuucuaucuuccucauauacaauucucucuugugcucccacugugugccgagugugggucuacccuucauggaaaaacugcgguauucuuaccaaucguuaaaugccuucuaaaagacaguuauuuguaguuuucuuagugauaguccugguuacaauucuguaucauguaguuucccaauguagcaauaggaaacuucaguaaugguggauuggaguaagcauagguauaugagauuuauagucuacacaggcauugauuucaaucauagaacuuuuuaucagaacuauuagcaagugguuaaauauacuuguaacacagguuugggcuacauaguguuaagugucacaugaggccuucuuaauuucaguacauaccaaguucuccaucccaaaucccuucuugauucuuugaugauuuaacauuauuuauggauaauuucuuauucugaccuuuaauguuucuaaacaaauagccuaaauauauuuuauauaaaacuucauuucugaaagaagaacuuuuggaauaauggguggaaaguucauuugauuugcuuaaguguagagauggcuauugugauauuuaaguuuggaugguacuaauuugggugaaggaaaguaguagcuacuuuuauagagauaggugguucaaucuuuaaaauguuacuagguaauguugauuucugugaacuuagcauuucaguggccaguaagguaaagcauccuguuggguuuaguucauauguaaaaauucuuauuaauuggcaacuuuugaagagagcuggaaguuuaacugugaaugguguaauacuaauuaacugaaguuuucuugauucuuugaaaaagaugggaaaaaacuccuguguuuauggacauuaaaauauaguagugacuuaaacacacgcaaugcuacagagagaagagacaggaaauuuacuaaccuacugaaacuuuugacaggugcagugcaucuuuggaagucagauuuugauuauuauuaauaaaacagccuuuguuuaguaaguugaacaucaagugagaagauuacauggagcaguaagcauacagauuugcaauagguacuccauucaguggguuuuaaugggugucaaaacuaaacugaccuuagugaauuauagcuacugcacacacauggcuucaguuagaaaggauaugguaccagguaaugucaucaguuuuuccaaauguguuccuggggaaaauaaccuaaauucuugaagcagaucauuuaacuuauaauuggauguaauauuaugacaagaaaagaccuuaaggcaaaaacuguuccuuauagaggcuuuuuguuuuucauuugaaauuagugcaguugcugauuggcuuuaaaaaaaacccucauauucuuuuaaauauaauaaucugaagguguugcuaaauuuacuagcccaacugagaaacaacaguauccuuaaaaacaaauaauugaguuuagguuaaauggaaauaguuggcuaaauaugauuuuuaaaaauaauaccuaagguacauguaggaaccagauagauuaaauaacaugauagaaaguguucagaagagguaguacuuuuauacuuaguuuuaaaaaauuuaaauuccucuacuauguagauuuuuauauuuugugaccacaugcauguauaguauaguaauaauucacuguaagcuuguaguguacuauauuaguugaaguacgauaaagaaauucuugcagaagaguagaaauacuucugaaauacuguguuuuccagcuugcauuccucauccuacuuauucaaauaaagcgacuauuuuuucccugauaaaaaaguuagaaacaaaugauuguuuuacuuuuuuuuuuuuuuuuuuuuuuugagauggaaucucacucugucacccaggcuggagugcaguggcacgaucucagcucacuacaaccucugucucccaggcuuaagugauucucaugacucagccucccgaguagcugggauuacaggcgugugccaccacacccagcuaauuuuuuuguauuuuugguagagacaggguuucaccauguuggccaggcugaucucaaacuccugaccucaggugaucugcccaccuuggccucccaaaguccugggauuacaagcaugagccaccuugccuggccuguuuuacuuuuuauuuucagaaugcuuauuaugcaauggaagcagaauuaaucauauuccucucccugaccaacaauguggaauucucuacugacuguaaaucaguauuuuuaaaagagcuuuaaugaaaguucuuuuaugauaccacuaagcagaugucaggauuuacuuuucaauuaggugguauaguggugaugagcagaucagacuccuuugcaggugauacauugcuuaggggaacugacauuuagaccauugaucccucuagugauuuuacaugucacgacugagcuauuugucacuugcucuaucugaaaaguaggcagaauaaacaagaggauuuuuacagacuauaagauccaaacuaaauaauccugaaaaggccuuugauuuaaaauucuuuuaaguaucauaaauuuuauuuuuuuaaaugaacaugcaguaaaacugacuuuuccuauguauaguugauauauuucaacauguauagauuuaucuaaccaccaucacagucaauauccagaauaguuuccuuagcucaaaaaacuccuguguuaucccuguguaguugugcucccccccaccccucaauaccugguaacucugccauuuuacuuuugucuuuucaaaaauggucaugaaguggaauaauagagcaugaagccauuuaagacuguuacauauccauuuacucagcauaugccuuauaagauucauauaaguuguucuguguauugauauuuuauuccuuuuuauuacugaguaguauucaguuguauggauguaccacaguuuguuuauaaguuuauuaauuggaggacauuugaguuguuuccaguuuuuagcuauuuugaauagagcuucuauaaacauuuguguauaggauuuugugcaaaugaguucucauuucuuuuggguaaaaauacauagguaugggauuggugggucauaugguaaauauuuauugucaagaaauugacaaacuguuuucuaaaauggcuguuuccacuuuguauuuccaucagcaauguaugaguguucuaguuguucugcacaguugucagcacuugguauguucaaucuuuuucauuuuagccauucuaauagauuuguagugguaccugauaaugaguuucauuuuucacuuuccugauagcuagugauguugcgcauuuugucguauguuuuguuauauucucuuuggugaaggaucuauucagguccuuugaccauuaaaaacaaccuuuuuauuuugguagaaguuuagguguauagaagaguuacaaagauaauacaaagaguuuuauauuccuuuauauuccucacacagcuugccauaauaauaacaguuuacaaaaccaagugcauuuuucaaaaccaagaaaccaacaggugccuuacuaccaaccaaacuccagauuccaaauugagauuuugccagauuuuccacugggucuccuguucuugaauccauuccaguauuacauguuacauuuguuaucucucccuaaaucuccuauagucuaugacaguuucucugccuuucuuuguuuuucauaaacuugauaguucugaguacuaguaccagucagauauuuugcagagugucucucaauuuguguuugucugaugcuuuucuugugauuagacugagguuaugaguuuuaggaagaauacacagagggaaaugcccuuuuccucacaucuuaucaaagugcaugaugacagcauuacuuggcuaagguacuguuuaucagauuuccucacuguaaagucgauauuuuugucuuuuuguauuauauucuuuagaaaugaguugcuaauuucagcccacaaucaaaagggugggagauuguuucaucuuauggauaggguauaucuauauguuauuaaguuuucuucuguaaguaagccuuugucccuucucuuccauuuauuuauucagucauuuauaucaauauguauacuuauuuuauacauuggcuuauaauucaauacuauguuauuuuguugcuaaaauuguuccaguguuggucccuguauuccuuugacaugucccguccuuuucuuuuuugaauacuuccuuaauuucugguacuacaagauacuccaggcuuaucauauauuuucucugcccuaccccuagaaucagccauuuccaccaggagcccugguuucuuguguuggagaauuguguuuagauccauugucucucuggguacuggauauacuuguugaugcagggguaucaccauuucaaggccuucucagaggauagagcuaggaaauaauacauuuguauauuaaucauguauuuauguacaucuauaauuguuucuguaccuauuuguauuauauauuuugcuguauauauauuauauguuaaguucauacugaugucugugacuaauccaguaccacaggguucauucuaggcuuccccacuuugcuuaucuguaacuuuccuuucuaacagaaaccuggccuuauccauuuacuuguuuguuccaucucaguaaagcaaguucacaauuguuaaccaguaccccugugagaaauaaauuuacccuacccccuuuaguuggguuaugccauucauuuauaauacagccagauucauuugucauggacugcauucuaucuuaaaauucccccagcaucuuuguugauuuuuuaaaauuugcauacauuaaaguucagucuuugugaugugcgguucuguggguuuugacaaaugcauaacgucauguauacaccaccucagugucauacagaacaacuucaucacacuaaaaaauuucuccaugcauccccuuuguagucagccacuacuccauaccccaacuccucuccugacaaccaaaaucuccuguaguuuugcauuuuccauugugucaucugaaugcaaucguauaauauauugcuuuuggaucugacuucuuucauuuagaaaaauacauuuaagguuuauucauauuguuucaugaaucaaauaguucauuccuuuucauuucugcauaguauuuuauuguauaggaauaccacaguuuguuuauccauucacccggacauuuugguugcuuccagguuuuggugauuaugaauaaagcuucauuaaauauugguguauagguuuuugucugaauacaaguuuucaguucaguuuaguaaguaucuagaaguuugacugcugugucauaugauaaauguauacuuagcucuguuagaaacugccaaacuguguuucaggugguugugccauuuuuuauuuccaccaguaaugaaugagauuuccuauugcucuguaucuuuagcagcauuuggaauuaccaguuguuuuuguuuguuuguuuguuuguuuuuuaagcuauucuaaucauguacuuuugcucauauuuaaauuauauuguuuucuuacuguugaguuuugaguguucuauauauuuguuggacagaaguccuuuguuccauaagcgauuugcagguauuaucucccugucaguagcuuguccuuauguuauguuaaagauaccuuuccagagcauaaauuuuuaauuuuguugaaguccaauuuauaacuuuuaauuuuauggauuauguuuuugaugucauaucucagaacucugcuuaacuucagguaacaaagauuuucuucuucuuugucauuuucuagguacaaguuuuacaguuuuauauuuuacauuuaaguuugagugaauuuuuguauaacaugaggguuuaggugaaauuuuauuuuuuucuuugcauauggaugcacaguuguuccaacaccauuuguugaaaagacaauccuuuccucacuauaugucuuugaaccuuugacaaaaaucaguugacccuguuuguguggauauauuugugaacacucuauucuuuuccauugauugaucucucccuucagcaauaucacauugucuugguaaguagcuuaaagccuuaaaauuagguaguauaauuccuucaacuuuauucauuuuaaaaauaguuuugucuucucuaguucuuuugccuuuccauaauaaucuuggcaucagcuugucuauaacuacaaaaaauccuggaauuuugauuggaguugcauuaaauuucuagaccaguuuggggagaauugacaucuuuacaauguugagcuuucugaucuaugaacacaggauaucuuucuacuuacucagauuuuccugaugcauacaucagcauuucguuguuguuagcauauagcucuuguacauguucuaauauguuuaugcucaaguauuuguuuuuuauggagcuauuuugaacgguauuauuuuuaaaugugaggguuccaaauuguucauuguuaauguacagaaaugugauugauguugaccuuuucuccccaaucuuucuguauguucagauuggaucauuuuuauucaucuguaguaaguucacugacuuuuucuucugucgucuugauucggcuauugagcucauuuagugagcuuuuuauuuugguuauugguauuuuuccacuucuaaaauuuccauuugguucuucuuuuaucuucuauuuuuuuuucugaguuuaucucuguuucaagaauguuugcacuuacuuguuaaagcauucuguaauaauggcucuaaauaucuuuaauaucuuagauaauuuuaauaucuuuguuuucuugauguuaguauuuuuccugugcaaguugaguuuuuuugauuccuuguauaccuaguaauuuuggauuauguccuggacauuugacuauuauguuaggagacguugggucuuguuuaaauacuaugcaaaauguugauauauuuguuuuaguagacagucaacccaguuagagucacacugcaaauuucuguggauuguaguuacaacaucaguuugauuuucaaaacuuuugccauauuacuugguucugucccacauguguaccacccauugccagucuggaacuugaggggucgucuguucauaauucucaaagucuguguauguuuguuugggucagauguaugcaugugccacucgagggugaguccaggaguucauaaaacaacuuugagguguugcucucccauguuccuugucugugaucucccaguaauuucuaauucugcauggcuccccuuuucugaucagaaaguggaucuuuaucccucuuuaauguucacucccugcagcugugcccauauucagggccaaguggcaggaggacagagagagaagcaaaagggauucaccacauccucuugggaccacagcuucugugaucagagagguagauucccucucucagaguuuuaguucuuaguaaccuccauugccacugcugccacagcugugauggguggcugggcuugagagagugaagagagaaaaaaacggggggauuugcacacuuccuugugaguccuaagagaccccuuucccucucucaagccagagguagagggcuucuccugaagcuuuccauuugggcuguauuauguucagucuggaugaaagcagagggggaaauaaaugguaaaccugugguugcuucagugguacaucaaauucugguuguuuuaaucggccugcuacuguuacuuuucaaaguuccuuaguaguuguuccaugcauucuguccaggucuuauagcuacauuaacuuguuggcaugugauuaccccaucuuaucuggaacuggaagcugacuuaagguuuucaauuuuguuucucuaggaauuugacaagaaacugaaguuuugauucagauauauuuugaauugaaaccagagauguucuagaguuuagauucuuucauuugauuaagguaagauuguuugauaaaauuuaaucauaccuuuacuguacguuuucagugaugugcuagaauuuagauuguuucauuugauuaagguaagauuguuuaauaaaauuuaauuauaccaauacuaugcauuuuuagacuuauauuuuaauguguauuugauuaacacauuuaaauuucccagucuaaucugagauucugaccucaggaaauauuuucaugguuucuuuaccacuuaaauagcuaauguuccuuguaacaacuacuagauucaagggaaacaugauuauacauucacuggaaguguuauagacugauaucaaaucuguuugccuagagcaggagucagcaaacuauggccuaugggccagccaccuauuuugguaaauaaaguuuauuggaacacagucacacccacuuaauacauauuguguguggccaucuuagcacuacauuggcagaguuuuuaguuggaacagugucuguauggcccacaagccuaaaaucuggcccuuuuaggaaaguuugcugacccuuggccuagaaaacugaagcaggguaucuuauucugcuauguaauuauaauacaugaaaugguagcuaacugauuuuaguugucaguaaggcuuguuguaugaaaacuuauuagagauuuaaauaugcauauaaguauaugugcagauacaggaacucuaauuucuugaagugaagggucuguauuauuucuugggaggugcuaguuuucugaaguaauugauuuuuaaaauaagacuuaauguuagcaguuaaauacuaugcuuauuuuuuaaguagaagccuucauuuugcuuagauuuucaaaaauaaaaguuuauaugauaaaggucaagcuuguucucauucuaaaaacuauucacacgaauguauuugauuauauuugucucuccuacuaaauuuaaacugaacaaauaauauuuugagagugaugauuguguguuuuuaauaucuguucuaguagugcaaaugguuuagcauauaugaacuuaaaugaaaacuugcuaauauagaacuacauuuaguggcuaaaguuggaguuacguuucucucugagguuuaaauggaaacgcuuacacuuguuugugauuccuaaaauuauuaguguuuaaauaaacauaagauagaaggagaaaauaaaauuggagccuagaaagucuauaaaaucuuugcuacccuccucagaagucucuuggcugaagaaaaaaaaaaguauauuuuaaaaacaugccauauaaguuagaauuuccaaccaauaucauaaaggaauuucucuguucagggcaccaaaauuagaaacaaauuauuuuugcuauuucccauguaauuuuaagaaaauaaaguaagcuucuaaaaucuucaucucauaaagaaugauuauuugauuugaaaacagccucuuauauccugcauaaccugaaauauauuugguuuccuaauagacuugugugagguaucuuugcuuucauuuucauaaagucaauuuaaaacuuuuuaaaauuuacuuuuuaaaggagggaaucuggaaacuuaucagaaagaaaauacuuugcaucuuuuugugccaucacacauuuuauauuuaaaucaguauggauuuagaauuugagugcuuauacauuugaguuaugaaagaugauaaaauuaagcugcagaagggauggaaaucuugauagcuuuaauauguuaaugaggccaccuuagcauuguguguguuuagcuguggagaguaucugauuuguauacuaagacuuaggaauaaaauaaucaauuucuuacgaauaaguaaaauuuccucuuaaaugauggaugauauaagaagguaaugcuaacauuuuuugcaucuauuaaaaucauaucuuaagacaucuuuuuuuaauuucccugauuuguguucuaguugugguacuuaaaaguaaaacaaggggaaauaaacucauaggaaaguuuauacuuugauuuucucuuucauauaaucuuagauuauuuagauuuuucuaacagcauaaaauauuucauuauaaaaucaaauacugagucauugccaauuugauaguaucauugaaauuaaauauguguacuuuaaagacaggcauaggauuuuuucuuuuaauugaauauacugcuuaucuuuuaaaguauauguggcuagauaagaaaggaccugaauggacuugauuuggaauuuucucuguucaugucuuugaagguauucagacuaaaagagaaugucagcuuuuuaacuuuguaaaaccugguccauauuaccgcauagcuguuaguuacaguagcuauuugcaauguugaauuuuugagaugaguauuuuuacugcuaacgauguggacauguguauuauuuucauauaacugucagggcaguaaagaaacuaguuaggaagucaaccuccaagauuuauccucauaggagacaguguuaaaaaucuuacuuuaguugaccacuaugggguuuucuuuaaaauguuaaauaauguuuucgaauaauuugguuuuuguacccauuuuaucuucuaccaaauaaauuuaaaaaaaucaaguuuauacacguaauuugcuaucaagaaagguauacugcauuugaaggagaagaauaacgucucuuuuucucuuguuuaaagcucuugaaaaaaauuuuauuuugaaauaauuuuagauguacaaauaaguuacaaugauaauauaguacagagaguuuuuuuaauauucauuacucagcuuacccucauguuaacaucuuacauaaccaugguauaaugaucagaacuaaauaaucaauaaugacuuacuaaaacuacagaccuuauuagaauuucaccaguuuuuccacuaauguucuuuuuccaggaucccauauuacauuuaguuguguuuuuccuuagucuccuccaaucugacaguuccuuagucuuuccgugucucucaugauuuucacacuuugaaagacuccuggucagguauuuuuguagaaugucauucaauuagaguugaguuucucugauguuuccucauaacuagauugaaguuacagauuuugagacagaauaccacggaggugaugugccuuucucagcacacaauaucagaagccacguggugucagaauguccuauuacugguaauguuaaccuugaucacuugauuaugguggugucuaucagauuucucuauuaaaaaguuaauacuuuucccuuaauuaguaaauauuugggggaaaaugcuuugaggcuucaaaaauaucuuguuuuuccuuaaauuuuuggccacuaauuuuagcauuuauagguagaucuugccugcagcuucugugguguuuuaguggugauuuucuauucuccguauuuccucuacauuuaucaauuauaauucuucuguaauacagaguagucccugcucacauuuauuuacuuaaucauuuacuuauaucagugugaacucauagauauuuauuuuauucucuggauuagaaucaaaauucuguuguuauuuauuuuguugcucaaauuguuccagcuucagccacugggagcgcuuuucaacacgucauugucuuuuucuuuucuuucuuuuuuuuaaagcaauuccuuacuuucugacuuuaugagaugcuucaggcucaucuuguauuuucccugcuuuaguccugaaaucacuuaccucuccaaggaacccagguccaacuuauuggagaauaguauuuagaaaccagcaucugggugcuagguauguucauugcuaccgaggaguuacugcuuuuaggccuuucaggagucagaguuaggaaauguauacugauaugguuaggcuuuguguccccacccauaucucaucuugaauuauaauucccauaauccccacauguugagggagagaccugguaggaggugacuggaucauggggcaguguccccaugcauuucuuauaauagugagugaguucuaaugagaucugaugguuuuauaagugucugacaguuccucccuuacacacuugcccucuugccugcugccauguaagacauucccuucugccaugauuguaaguuuccugaggccuccccagccauguugaacugugagucaauuaaaccucuuuccuuuauaaauuacccagucuugggcaguucuuuauaauagugugaaaacggacgaauuacauauaccaacucacauacauacaucuauauuuauuuguguuuacuuucuguauacacgcuuaaaauuuuaauucaugcugauaccuucaacuccaguuuugcaccacagggauuauucuagcauuuccccuuugcuuauuuguaauuucuuucucccacagugagaaaccugacucucauucucuacacuauauuuauguauuuauuauacauauauaguaguuuccaaauugcuaauccauacuccugugagaaacaaauuuaccaaauagaauacaguguuuguauacaguuauuuuuaucuuuauucucacauuauccagccagaaugcuuuuuuccaaaguuaguugucaggucuuuucuucuguauauccccaucaaucuacugugccauuucauuuguaccacaguuagauucauuuugucacaguucacauuccaucuuggguuucccugauauccuaguuauuugcauuuaauuuguauacaguaaaauucauucuuuguguuguaguuuuguggauuuugaaaaaugcauagagucacauaucuaccaacagcaguucugugaccacccccgcacccccaauuuuuuugugcugccacuuuguagucagccucucuuccaagccccaaauccuggcaaccccuaauguguguucuaucccuuuaguuauuagccuuuuccagaguaucauauacauggaaucauauaauauguagccucuuaggucuggcuucuuucauuuagcaaaauacauuuuaaguuucauccauuuguugcauaaauccuuaguuuauaccuuuuuguugcugaguaguauucuauuauauguacacgauuugcuuauucauuuaucuguugugggacaucuggguuguuugcaguuucagucaaucgugaauaaagcuacuacauuuacauaaagggugugugugugugugugugugugucucuguguguguguauacauaaguuuucauuucacuugagugaauaccuaggagcaggauuaugggccuuaucuuaaguguauaguuaacuuuauaagaaacuguuaaacuauuucuaagugaauauacaauuuugcauuccugccaccaauauauaagaauuuuugcuguucugcauccuugucagcacuugauauugugcaguauauuuuugccuuuuaucuguucuaauguauguguaguggcaucuuguguuuuucuaaugacucauaauguugagcaccuuuuuauaugucauccuuauauguuugugaaaagguagcuggucucuuuuauuucucuguauuuucuucuuuuaugaucagccaaguagauagucuuuccaauaucuuuuugaccaaauuagcuguuauuaucucugacuauuuagcuaugcuuuauaauaaaauacacauuuucauauaugaguuuugguuaucuguaacuauuccaagggaagguauguauaguuuuauauaggugaguauuugaaugauaauuuuauuguugucuaaagcuagauugcaucguaggaaucuauccaaagauuacaucugugacugaaaaaacauguaaaacaagacgaaguguaauaaauacugcuagugcugaagauuggcauuggauugacaaauguuacucuagaaaaauaaauuuuagagucuuuggugagaucuuuucaccuuugaguaucaaauggacaaagaaaccugauacugucuuaggauaucugucaauauggacaaacuuugguauguucuuacaacuaaucaguuaauauuaggugaaagagauuagaaaugaauguuuuuaaacuugggcuacuuuauauaaacauuuaaacuagcaacuuaaaauacuuaggacuuauauuuaguuucugucagaauggaaugaagacauagcaaguuucagugguaguuuucuacccuauuuaagccugauacuuacuauuucuuuuuguaaagaccuauguuuaacccauuagaauaugugcggggaugccauguuauuuaauuaggccuuucuauuuguuugcuguauaacaaauagaaaguuauacagcaaacuguauagcugcuguauaguucuugcccuuuuaagaacuuuacuauauuacacaaaauaauaugcuuagauuugaaaaauacuguaugccuagauuuggaaaauaauauaugccuuaaaggauagcauuccugucacauuaugugaguaauuaugauugauucuguugauaauucuaauuagcuaagugaguucccuauuucaguaggagauuguuuccuauuucaguaggagaaagccaaacgaaacaauguuuuauuuacauauucagauucugaaaauaacuuuaguauuagaagucauuacauaugggaagaugacuuuuucugcuuuagaauaagcguaccucuuuaaauguccuauuuaauagugugaucacaugacugauauuucuaauggcuaaacccaguguuguuauuaugaugaugaugacagucuuugauuuaaaccaaagccauuauagaaaggucugcccuuuccaauauaaaacuuauaaaacauauauauauaaauuacauuggauguaacuuguguauauauaacuuacauuaaugacugcuguagucauuguauauaucuuacauuguugucccuucucaggccauauuuguaaaugagauguauuuuuuguuuguuuuuuauugauccuuauuccuagaaauguaaaugagauguaaauaagaccaacuguuuuccaagacuuguaaaaguagaaaaauuacuauauauacauauauuauaaauauauauuuuauuuccuuuuucccuucucuugaaaagcaggaaaaaaaagaagaaagaauguggguuuuuauuuguucuguaaggccuugauagcagccuacuuccuuguuuauaggagacuaggaacuuugugacuucaauugaguaugcuuuagaaccugaaacauaauaaaguggcaccugcuagcaguuuugcauguaugacaguugacauuauuaauuucacuuucauuguugaaaucagcacuucugaaauugggguauugaagaaggauggaauuuaacuucuuuugaacagcuguucuuugguugacucugacucagacacuuuguuucuuuauuauuuuauuuaauucuuaaauuuaauccucacaauuuauuuagucuucacaauuagccuacaaaggaggcgugauuacacacauuuuacaaacaaaauuuauucaaaggaacacagcaggccaggcgcgguggcucaugccuguaaucccagcacuuugggaggcugaggcgggcagaucacaaggucaggaguucgagaccaaccuggccaacauggugaaacccugucucuacuaaaaauacagaaauuagccgggcgugguggugcgcaccuguaaucgcagcuacuugggaggccaaggcaggagaaucaauugaacucaggaggcggagguugcagugagcugauugugccauugcacuccauccugggugacagagcgagacugucucaaaaaaaaaaaaaaaaaaaaaggaaauucacacuuuuaucaacuauacuauauugcuucuucuaagacuagaaaaauaggccaggcacaguggcucauuccuguaaucccagcauuuugggaagcuaaggccgguggauuccuugagcucaggaguucaagaccagccugggcaacauggugaaaccccaucucugccaaaaaaauacaaaaaaauuggcuggguguaguggugcaugccuauagucucagcuacuugggaggcugaggcuggaggaucgcuugagccugggaggcagagguuucagggagccaagaucaagccacuggagugagacccagucucaaaaaagaaaacaaacagaaaaagaaaagugaugagaaguguuagaaaaucucucuaaacuuaagccugugggagggaaacuaauaauuagacaagacugaaauuucaaccuuauguuuaauuaauaauuagacaagacugaaauuucaaccucacggggcuucacuuuuggaaaaccuguuuuauguguguuauacaagagaacugucaguauaauaccuauuaaugcuaaucauauggcuaaauauccauuugauaucuuggaaaagauuaucuaauaacauuacugauaauuguuuccuuagaaacaaauuaucugugaaucagaaauaaugcacauaucugcauugcuguuagcaguaaaaauacucaucucaaaaauuuaacacugcaaauguaacuuucugauaguccaauuaaacucuuaaaaugauacuuaguauaauauuuguaaaacaaacucauauagcugcaaauaauacuuuuaaacuguuuugucaauaaacucauuuuauuguagaucaguaaauucuauuuccauagugauuaaaccgucuuuaucuuaaugguauugauaguaauauaguaauguuauacugugaacauuaauaacuucauguagaauugucaguuguaaggguuuuucuuaauauuuuuguuauauuagcagucuuauuguauacuuaauauaaauuuaucuauaguccagucauuauuuaguauuuauuuccagcauauuaauauucccaaaucaauaaaauacauaacauguuucaaggauaaugaaauuguauagacaguuguuucaguauauauaagcagucaaacuguagauuuucuguugaaaaagugauaaauguuaguugacauuugguaaggaaaaaguccaauaauuuaauauuuuuuuuaauaacauccuaggguaaaguauguuguaauacuaaguaguauauauaaaaguaguaucugagucuguguauuuauuucaguguuauaaguagaacaacaaaguuagaaagcugcaauggaaagcaaagccuuuguaaguaaucacaagacuugggucuaguguuggugcagccagaacuaguugugugacuuuggacaagucauuaaacucuagaucuuauuuuuuuguuguucuucuuuacaaauaagcugguuggauuacgguuuuuaagauuauugccaguucugugauucuuuuuuguuuucacuuguuuaaauuguguuaaaauacacguaauauaaaauuuaccaucugaacuauuuuuaaguauauaguucagugguauuaaauacauucauaauguugugcauccauuuccauuacucuuucaaucuuguaaaccugaaacucuguacugauuaaucaguaacuccccaguuuucccuucccccacucccuggcaaccaccagucuacugugugucuuuaugauuuugaauaaguaccucauacaaauggaauuauaguauuaguguuuuuggugaccaguuuauuucacuuaguauaauguccucaagguucaucuauguuguaacauauaucauaauuuccuuucuuuuuaaggcugaaaaauauuuuguuguauguauauaccacauuuuacguauucauuccauugauacacucuuggguugcuugcacauuuuggcuauuguuaauaaugcugcugugaacacagguguaccaauauuucuuugagagccuguuuuaaguucuuuagggauauacugagaaguggaauuguuggaucguaugguaaacucuguuuuuaaauuuuugagaaacagucauacuguuuuuccagaguggcuguaccauuuuguuuuucuuauuuuuuaaauuuauuuuucuuucuuuuauacaaaccugcacauguaaguggcuguacaauuuuacauucucaucaacacugcacaagaguuccauuuucuuuacauccuugucagcacuuguuauuuucuguuuuuugauaauggguaugaggcaguaucucauuguaguuuugauuuguguucguuaaugauuuaugauguugagcaucuuuucauguguuucuuggccaauuauguguauauucuuuggugaaaugucuauucaaguucuuugcccaguuuugaauucggucguuugcuuuuuguuguugaguuuuaaaaguuaucuauauauucuggauauuaaucccuuaucagauacauaauuugcaaauauuagcuccuauucugugaguugccuuuuuacucugcugauauugucuuuugaugcacaacauuuuaaguuuuucaugaaguccaaauugucuauuuucucuuguugcuugugucuuugaguaauauccaggaaaucauuacuaaauccaauauugugaagcuuuugcccuguuuucuucuaagaauuuuauaguuuuagaauuuauguuuaagucuuucaucuauuuuugcauaugguaaggauccagcuucacucuuuugcauauggauauccaguuuucccaacaccauuuguugaaaagacugugcuuuuauuccccuuuggguggucuugccacccuugucaaaaauuauuugauuauauauuugagaguucauuucuaggcccucuaguguauuccauugaucuauaugucuaugccaguaccauacuguuuugaucauucuaacuuuugaaaucagaaagugugagucuuccaacuugguucuuuuuuaagauuguuuuggcuauuugagguccuuugagauuccauguggauuuuugguuagguuuuucuauuuccgugaaaaacaugucaucaggauuuugauagugauugcauugaaucuguagauugcuuuguguagugcugacauuuuaacaauauuaugucuuccaauccaugaacaugcgauauguuucuauuuaugucuucuuuaauuuuguucagcaguguuuuguaauuuucauuuuacaugucuuucaccuccuugguuaauuucuaaguauauuauucuuuuugaugcuauaauaaauggaauuacuuuugucauuuucuuuucagauuguucauuguuauuauauagaaauuaacuaauuaaaaaaaauuaggcugggcacgguggcucaugccuauaaucccagcacuuugggaggcugagguagguggaucaccugaggucaggaguucaagaccagcccggccaucaugacgaaaccccgucucuacuaaaaauacaaacauuagcuggacgugguggugggcacccauaaucccagcuacuugggaggcugaggcaggagaaucacuugaaccugggagguggauguugcagugagccaggaucacgccacuguacucuagccagggcaacagagugagacgcugucucaaaaaaaaaaaaaaaaaaaaaaauaugcccuggcuuuuagaguugccagaguucuugugcugguucuuucucauugaugagggcugauguucuuuuuuccuuugaaguugcuguccuucaaaugggacuuuuuguuuuuaugaucuuuauugccucaagaguuugccuguggcacaaguugcaugugguugaaugccuuuguuucugaaugcuuuuaaagggccaagguucagcuuuacgcucaugggcugcaugcucuaacucuggguggccuggacugaauccacagcuuuguccacugauuccucgaagcugagcccaggcugggcuagaggggcugagguacucccagacugcugacaacagcauuccaugagguauggcagcacggguccaugggcuuaagugcuccugugggagcauugcaggugggaggcauucuggcaggggcaccaugggugggaggcaggggugguggaggcaccacgggcaggaagugcuccagcaggguaguugaggcuuugcuguguguaggcacgaccagacagggacuaugcgaggggcugguggacagcagggugcacagaucaggcucacccuggucccacaggaaagaaagcccuguucucuccaggucuggcagcuuauacaggucagagccaccccuuccuaaggagcuguuuagggccuugaacauauccuggcacuuggcaacccugugugggguucccaguuuccucccccuucaguccuggcaucuaggucaucucucuaaccucuuucagugugauuuucucagauugucugucuggauuaugccaguuuaguugauacucuggucuaucucaaugggagaaguuauuucuggcuaugacuagucagccaucuuguuuggguccucugcaacugauuucuguucauauccugcuccuuugcugaauccauaguugauuuuuuuuauagugaaagguuuaaaauaauuucacauuccuguuuguguauuuucuauagcuacuuucuuugugguuaccaugggauuacaauuaacauccuagguuauaacacucuaauuugagcuuauaaaaguuuaacuucaauaauauccaaaaauccugcucaucuacagcuuuauucccacaccugucaguuguuggugucacaaauuacauccuuauacauuauguacccacaaacaaacuguuaaaugcgguagucucuuagguuguauagaaaacaaaaagugaaguuacagaccauuauuacaacaauaguagguuuuaugauugcccauguaguuacuuuuauugagauauuuauuucugguguucuuucauuuuaccuuauagguuuccauugaucauuucuugcagggcaggucuagugguaaugaauuccuucagcuuuuauuuaucuaggaauaucuuaaugucuccuucaccuuugaaggacacuuuugccggauauaggauucuuguuugacagauuuuuuuguuuguuuguuuguuuguuuuccuucuagcacauugaauaugucaacccacugccucuggccuccaaaguuucugaugcgaaacaugaugauaaccuucuugagagucccuuguauaugauaagucucuuucuuacugauuuuaagauccucacuuugucuuuggcuuucgauaguuucauuauacuauaucccaauaugggucucugaguucaugcuacuuggaguuuguugagcuccugggauguuuauacucgugucuuucaucaaacuuuggaaguuuuucaucauuauucaugugaucucuuugccucuuucucuuuucuccuccuuucaaaacucccacaauguauauacucauccaauugauggugucccacagaucucuuagauucucuucauuuuucuucagucuuuuuuuuuucuguuccucagagucauaguugcaauuguccuaucuuaaaguuagcugauucuucagccugcucagauaugccuuugaaucuauauagugaauuuuucauuuuguacuucucagcuccagaauuucucuuugguucuuuuuuagguucuguagcucuacugauacuuacacguuuuucauacaucauuuucuugauucugucugcaccuuccuuuaguucuuugcacaucuuuaagacagcauuuaaagagcuaugguagauuugccaucaggucuuuuucaaggacgauuucuaugauuuauuuuuugccuuugaaugugccauacuuuccuguuucuuuguaugccuugugauuuuuuguuguuguugaaaacuagacauuuaaaucuauuaaugugcuaagucuggaaaucagauuuucuccuuucacuagggcugguuguuuuaguauuauuuuuguuuauuguuuuugguuuuuguagacuggguaaggaaacagggaucagccuaugucagagauagaaauauaaacuuaaggucuucccagguauuuucuuugcaucuuuuccuggacaugcaugaucauuuuccaguuuuguccauauuuacaguuguuuuugaaugucccagucuuuaaugucuggcucccaaaaggagaaaaagagaaaaauaaauacaggaagaaaaauuggcucuggcccuuuaaguucccuggaagucauuucaggggagcaggggggcucuugcaacaccgggaggaggugcaacaacaauggcuggcagccucuuugacuacacccaugugaucuuuggcaacaaucagugaucagaguacagaucuccauaccuggaggacaagguccuuuuugccuacgugggcuccugcaagcugaguacaaacugcuccaggagcacaugcacagcugccugccagggagcuaggaguggaggauggcuugcugcaacaguguuaagagcugaaaaugacccaaauuaaugcacuuuaucauuuaguccuucucuuggaaguugcaagccuucaguggacuacagaguuccaagauaauuacuuuagacagauucugccagugcaguuguugucuaaguugggagacagauuccuggugguuccuacuuugucaucuuucuugaaucccucugugauuucuuauggcagaaauuauguuaauaguaaacucaacauaagugauauaguuuuuugguuccuaauaaaucagauuuuuguuuuuuguguuuagaauggcagcccaagauaacuaugcuggugguucuauggcuuauggugcuacauauacccauagugauauaauaugucuaaaaagguaugauuauugguauuaggaauaaaagcuucauuagccaaauauuuuaaagcuuuuuuuuuuucuuuuuugcagggcagagguggagagggguuagauuauuucaucugcccuacaguuggcauaauaaagaguaagcccuuaguuuugggaauguaugcaguaagcuaggcauccuugcgucggcugucauagaagucccuguccucuuagucuucaguaaacauuaggauauaccaggacuuauauucuguaccacagaguucagcauucaauuaaauauggucuuauaucauagucuaaauaauuuguuaauaauuauaagguuuugaggggcaguuguuaugccucuuguuuguacacacagugccuaguagguauucaguaaacacuuguugauuagguuaucauguauaagcaauaauuuuuuuguggaauaaugaaggucuugaaacuugaguagacauuagacugaaaguaugcacaacuuccuguaaauuauguguaaauuuguagauuugaacuuugacuugcauacuaaggauucuuuuacugauuucagagugguagugcugauauuuccuaacauuuacugaguacucucucugugccuggcaucgaucuaaacaauuuauguacauuaacucauuuaauacuacauuaugaaguauucuuuaaauccauaugguauaugaggaaacuaagauauaaacaaguuaaacuuuuucuuaaauacacagaguuaauaagugauagagccaggauucaaacccagaaaaaaacagcuaaaagccuacauccuuaacuucuauguuauacugccucccaguguuacauauaugacguuuccaauuuuuauuggacuuaagggccuaaauucaucaaaccucccuccucuaaacacauacacgugugcacgcaugcacagacacacacacacacacacacacacacagacacacacacaccuauuuuaaucuuuuguuauuagauacaguuauuagaccaucuugggaucauggcguuuucuguaacuuaaacuaccuaccuuuaggugaauugaguuagaauugaguauuugacacaaauauuacuucuauuccagauuaugaacauuucaaaacucuauuucauaaguaauaaacaugauuuuggcaauauuccaaacacugcuguuguuggaaguguuagguuagauagaauucugaguacuuuauuaaguuaaauagacacugacaaaggaauauuuuuauaaagaucugauaagccuucuggucuguauaaacccugucuguccuacaaguguacaaauguagaagauagcaaaaucugagaaauauuauagucaauuagucacuccuaaaauguagcguuuuuacuuuguccauaguguuuauugcaaaacagcauaggaauaauggagucuuaagaguaaagcucaguugccaaauaggaaagcuuauacuaaaauggauuccaauuucuuagugaaaaucaaaacuugauugcauagaaaguauaagaauuucauguucaugcacaucccugauccauaaaucaggacuuuuaauauagauuucauaucuucagccagagugagcuugcuugcuugccuuuuuuuuuuuuuuuuuuuuuuuuuuuugagaccuaaucuugcucuugucacccaggcuggagugcaguggcgugaucucggcucacugcaaccuccgccucccagguucaagcgauuuuccugccucagccuccugaguagcugggauuacaggcgcccaccaccacacucagcuaauuuuugugcuuuuaguagagauaggguuucgccauguuggccaggcuggucucgaccuccugaccucagaugauccaccugccucggccucccaaagugcuggaauuacaggcgugagccaccaugcccagccaagagugagcuuucuaauuaguauauucuugagucggauguuaguagggaaaaauguguauguguauaaaauauauauaauuauugccuaacuaaaucaaggaugauuuauuguuuaaaugcaauuugagucaguagaccauguguaagagagacauuuuugcuaagucucuaagauuauggggaauauuuguuacagccccaggccuaguagauuauccugacuaacuaauacccuauagaaaggguauccagauaaucauuagagaccccuauuuguauuggagagagaacaucaguauuagugaagcccuaugauaacucaagucacuagucuuaaauaugauuuguucaaugaagagcugauacuagaguaggugugucagagaaagcuuucuaaguaugcacaaaaacacaguauuuguuagaaugaacuguuagacaacuaaaucaggagagucaugaacuuucuuuuuucauaugacagaaaaaaaauuagauaaucuuuuuugagugaacgcugugagccgaacauaaaccuugcaagaagcagcaagaucugcaaguauagcuaaaccaucauuuaaaaaacagucuuugugugcagcaaacuugggcauauaugcugaccuuauacugauaauuucaauuuuguucucacccuuuguugguuguccaugauaguguuaaauaugacugacuaaucuguaugguuauaaaagcacauuaaggaauauagguuuaguaugguagcaucaaucccuuuuguauuuuuauacaugagaaaauuccgcuuuuauuuuuaugagcuuauguggaaacuggguaagguaaacaaugauauguaagaauaugacugcuaguagaaguaaauauagguaaguugcauguuuucuaggaagaguuauuagaguacugaaaauugucacaucaaguauuuucaguugaucugcuaauagaugcauugaaagcuagcauuugacauuuaagccuacucuuaaaauaguagagaaagcuaggaggaaaguuuuucuucuccaaggcauuauguucuuucucuacugaaguauuaugcuuuuccuucccauaaucugucugauaacauuuuuauuuucuauguaucuucuuuguauuuuauagcacugugaggaacuauaaguugucaaaaccaguauguauggauugaagagugacagaaaggguaaauauauagaugaacuauauuaauuguaucagacaauuuuuaugagcucuaaaauguauguggaauuaaaacucaugauaucagcaacucaaaaagugggaaggguauacauaaaguguuuuaaggucuuagaguuagcuauaaagugauagaaguacugauuuguauuagacuguaauuagcaaggaugguuuuaaucauuaggguaaccaugauugaaacaguaaaagaauuauuagcuggcaaaagaaauugaauaaugaaaacuacuugauaaaaucaaaagaaggcaagagagaagagaaagaauauaaaacagguuaauuggaagaaacaaacaauaggcuaauggauaaaauuuaaaauauauuaaugacaucaaauguaaaugguuuaaauauucuaguaaaagacaaauuuguuugaaaaauuuggaagacuaaauuucuuucuuuuucuuuugagucagagucuugcuguguuacccuggcuggaguggcacgaucucggcucccugcaaccucugccuccuuggcucaagcaauccucccaccucagccucccaaguagcugggacuacagaugcaugccaccacaccuagcuaauuuucuuuauuuuuuguagagacagaguuuugccauguugcccaggcuggucucaaacuccugagcucaaacgauuugcccaccuuggcuucccaaagugcugggauuauaaauuucuuuaaaaccaaaauauauuucauuuucaagggauacauguuacauauaagaacacaaaaagguugaaacuaaaaggauuaaaauauaccaugcaaaugcuaaucaaaggaaagcugaugaagcuaugcuaauaucaggcaaaguagacauuaaggcaaaaagcaauacuagacguaaagaaggucauuucauaauaauauaaaagguccauacacuggaaagacauaauaauucuaaauucaugugaacuuaauaauuuggcuuuaaagaaauaaagcaaaauaugacagagcuaaaaugaguauggccacaaauuucauuucucuagaagcuaaaccagagagucuagcugugugauuuagaacaaaugaagugagcccacaauguuuccaggccauagcacaggaagagggaacccaaacagcucaggaauuacaaagguuugaguuuggguucagagaugacaaggaaugaaaauuauaucagauggaaauuugcaucuacaaaaauaaaugaagagcccuggaaauggugaguguauaugaauggauauaaaagucuuuuuuucucucauuuaagaaacuuuuuucuuaaagauaauugcuuaaaacaagaauaauaauauguuauggaauuuuucacauaaguagagguuuuuuuguuuuuuuaaagcaguauaguuaauauaccaguaguggagauaaaauggaauuaugaaaauuacuuacccaacaaugacaaaaagaaaaaaaaaugacaaagaugagacauaguaaaccaauagcuagauagcagauauauacccaaucauagcaauaaucacauuaaauguaaauggucuaaauaccauuaaaaaauggagauuaucuaauuugauuuaaaaaaaaauuucauuuacauauugucuacaaaaacucacauugaauauaaaaacacagguuaauaguaaacagcugaggcugggugcgguggcucauguauguaauuccagcacuuugggaggcagaggaggguggaucacuugaggucaggagguugagacuagccuggccaacauggugaaaccccaucuuuacgaaaaauuaaaauuagcugggcaugguggcgggcaccuguaaucccagcuacucaggagguugaggcaggagaaucgcuugaacccagaaggcagagguuacagugagccaagaucgcgccauuguacuccagccugggugacagagagaaacuccaucucgauuuaaaaaaaaaaaaaaacgaaaaguaaacagaugaaaaaagauauaccguguagacacuaauaaaaagaaaacaggaguuccacaauuaguaucagauaaaguagauuuuagagcaagaaguaugaaggacauuugauaauauaaaaggggucaguuuaccaagaguauauagugaucuuaaacauguaggccccuaauaauggagcauuaaaauagaugaaggaaaauuaauagaauucaaaggagaaauagacaaauauacaauuauaguuggggucugcaacauuauuucucaauaauugauucaguugaacuguagucuaccacaagaggcaugauuuauccuuguuacauuaguuuuaauguuuccauucuaauugggaguugcucucucauuagccaaaagauuauuccugcuaacccugauuaucaaaguaguguuaaagugcacauucuauucuaagugucaacaaccagagaucaguaaaaauagcaaauacuuauuggggcuuacuaauuucuagauguauuuguguccuguuguuauuauagcaaauuaccacaaccuuaguugcuuauaacaacacagauuuauuuuacaguucuggagaucagaaguucaaaaugcauaucacugggcuaaaaucaaggggccaguaggauuauguuccuucuggaagcuguaguggggaucuuuuccuugcauuuucuaacuccuagaggcugucuguauuccuuggcucauggcucccuucuaaagaaguaaaaaggccuguauuucagauggaauacuugaucuguguaauccaucaaguagauaaaaccacuuuuuugguuuauugaaacaagaccaugaaaguaaaguuuugaaaaagaaaacaaauuuucaauucgaauccccuuugcaauucugaugacaguuuuucuccuggugcucugcuuagguauggguaagcaggggugagacagauuuuauuauacuuuagacuuuugaagacaaaauaucuaauuuuaccaaguuuuuaugagcagccagagauuuugccuuugcuaccuaguguuuuuuguccagucauuuuuuuuuuuuuuugagauggagucucgcucugucgcccaggcuggagugcaguggccugaucuugccucacuguaaacuccaccucccggguucacgccauucuccugccucagccucccaaguugcugggacuacaggcgcccgccaccaugcccggcuaauuuuuuguuguuuuaguagagaugggguuucaccauguuagccaggauggucucgauuuccugaucucgugauccgccugccucagccucccaaagugcugggauuacaggcgugagccacccagccuuguccagucauucuuaaaaaucacauguuaagugaguugauggacuauucgcugagcacuuggcaacauccucagcaaaugcccucauuucauuuuguuguuguuguuuguucucuagaucuuaaaggacuuuuugauauuuuuauauaugccuaugagcuuuucccauuuaggauauacaugugauucagauaucuaucuaucuuuuuuguuuuguuuuguuuuuucugagacggaguauuucccugucacuacucaggcuggagugcaauggcaugaucucugcucacugcagccucugccucuuggguucaagcaauucuccugccugagccucccaagcagcugggauuacagguacacaccaccacgccuggcuaauuuuuauauuuuuaguagagacaggguuucaccauauuggccaggcuggucucgaacuccuaaccuugugauccaucugccucggccucccaaagugcugggauuacaggcccaagccaccaccccggccucagauuuuuauauauacguuuggauggaguaaaguaggcuauugucugaguaauuaccauuuccuuuuauuugcaagaaaauaacaauuuuaauuauuugagaauggacaacuuccugugucugguauguuaacgagugaaucuauagugucagucugguaggagaguaugguagaauagucauuaaugucuuucuaacauauagugcugaucuaggacuaauuuauguucuuaguaaucagugauacuuucaagcaauggcuccugagauacauauuguguuauauuacgaaaugucuuccuaggaacagaagucuugauuagucacuugguuuuaugggauugauaugacuacaugaaucguguguguguguguauguauguauauuaauauguccguauguucuuacuccugaguuauuugucaugaaaauagaaaugauugaguuaugccuuuauuuugccaguugucuaaaauauuucaaguacuuuuuaaaaaauugauguguugcuuucuagcuuuuauuguuacagagcuuggaaccauuauacuuccuaaacuagcugcggcuucuuacagggaaaaaauaaguguuuagaauagcagaguagaauuugaggggggaauuauauucacauaauuuguuuauauguauacuagaaacaauuagacaauuaaauagaaaacaagggggaaaaaucuauucacacauggcuucuucucucaaggaguuuauuuuuugacauaaaugcagcagcaaggaccuguaagacauuuauccuugagaguaagcuuuugauuaguccaaugucauagacuaaaugagaguauuucuguuuggguggagaauaugcuuuuucgggaggagcagcagacaguaggaaaggagccaagaauacacaauugagaaacaguuuucuaacaguguaagaugacuuacuuaacauugauuauuaaagauuguagaauauucauauuugggcauuuuaggauaguuucucauuuucccagaaaggcugaaagagggcauacuggcuuaaaauuucauagucaucuuaagggguuccuuucagaaaaguauguucaagcuggacauauuuaacuuuugggugcucuauaaccucuaaggauuuagguguaaaguaugugaaaaacauguaaaagauuccauaaagcccccaaaagucuugaaguuugaccuccucagucacuucuugugacuaacauggagaaaagagaaaucaaaauuuuauugacuuuauguuuguuuuuaguuuauaaauuccccuuguuuuaucucuacauucaggcucuauaaauuuauaccaagaaacugcuagaaaaauuacauuuuaagucaagaaauagacaucaauaacauacuugaaugcuuucucccucccaaccccaggcacuaguaauggggggaaacauugaugucauaugagucuucaaauucaguauauguuaaacuucuguuuaaagucacuuugcuuccuagagguggaguuucagcacuaaggaaaaagaacagucucuauccuuauuacauaugugcauuguaggguaugauaagaagcucaguuuauaacccagguacccuauuagacuguuuagggaccauagcuacuuugugguuggcuuaauagagaaggaaagauuuguauaacaucuuaauuucuuaaucaacauuugccacaauuugaaaccuagaguuuauuaugaugugugaguaauaauuuaaauucugucuuaaggaagcaauuuuuaaaacaugaagcaguguguaggcuacacaguacagcuuguugcaggaagaaaacucauacauacauacauaugaaauauaugugaugcacauauacauacauauauggagaagauuuuuuuguuuuuuuuuuuugagacagaguuucgcucuuguugcccaggcuggagugcaauggcgugaucugagcucacugcaaccuccgccuccuggguucaagcgauucuccugccucaaccuccccaguagcuggcaguacaggcacacgccacuacacccggcuaauuuuuuuauuuuuaguagagaggagguuucaccauguuggccagacuggucucaaacuccugaccucagguaauccgcccgccucagccucccaaagugcugggauuacaggcauugagccauugcucccggccagaagauuauuuuuuuuuaauuuuuuugaccuuauuuuuucuggggccaccguucacacagcugagguggggaugccgccccauagaagaugauuuugauuugggaagaaagacagaaaguauaauuuucuccuugccaaauauuuguaauucagguuuuaccuuuguaaauaauccuagugccaagauuuuagguuauuuauauaaaugucagugaaaacuuaguuucaacccuuagaaaauguauugauauauauauauggaauauauuuauaugccuuaagaaauaaucuuagguaaaauuucauuucugcuucaccaccuuauuuuuuuagguaaaugcuguuucugugcugcaaguuacauucaccucaaauuuaaaaaccaacagaaaguaucuacacccuuugaucagcaugaaguaaggucuuaagcaggagguuaaugaaaggucuugcagugcugaaguuaauucaauuugguaaccuucuuauuugcuuagaaaauugugcagcugggaaaucuuaguuuaaaucuuauuuaauucacauuuauugcugauaaaauuuauguugccuaccaauauaucauucuguggaaagccagauuguauuuguuucuugauugcuauucuuaucaacuuuuaugagauaauaaaaauuacagaagcuuagagaaaggugauuuuuuucaggggaauauguacucugguuuuacugauugcuuauuugggaaaaugcuaacauaccuuauaacagauguuuaacaaauauuuguugauuaaaugaacugauacagauagaugaagauuauucuuuuuuuuuuuuuuuuuuuuuuuuuuuuuuuugagauagagucucgcuuugucacccaggcuggagugcaguggcacgaucucagcuuacugcaaccucugccuccuggguucaagcgauucuccugccucagccucacaaguagcugggauuacaggcuuaugccaccacacccuccuaauuuuuguauuuuuaguagagacgagguuucgccauguuggccaggcuagucucaaacuccugaccucaugugaucugcccaccucagccucccaaagugcugggauuacagguaugagucacugugcccggccugaagauuauuauuuuucuaauugacuuagauaucacuucauccauaaacauuuuccuuuguuugccuauuaugagugccuacugugugguaggcacuaaauuaaguguucacuuaaucuuaaaacuacuuuauaaagcagaaaguaugauaucagcuuaacagaugaggaaaccgaaguuuggaaaggucaacuaacuuguccaagauugucaagcuuaccaggauucaaauuuaggccuaucagacuaaaaagcucagguugucccaaaaauauaccuucucacuuuguuuguaugaccuauuuaauuaguuucuucuauauuuucauagcauuuauuacucaaaaacaaaacuauagaaacccauuauagauuaauuuuacuaagguauaguuuacauaaaauaaaaugugccccuuuaaaauuuauaguuggaugaguuuugucggaugaauacagucauuuaacuaccagcacaacaaucaaaaucuagaacauuuccaucguccucaaaagccccucaucuaugucccauuauaagucacucccuuccugccacugcugauuaacuuuuaucccuaugauuuucuuuuuccagaaugucacauaaaugaaauuauauaguaaguacacuuuugugucugacuucuuucacguagugaaaugcuuuugagauucaucuauguuguggcagguuaucaguaucagugcauugcuguguuguguuccauuguauggaugaaccacaguuuauccagucaccauuugguggacauuuggguuguuuccagcuuggaauuaucauuaauaaacugcuguaaccauacauguucauaaccuguuuaguuuuaaaauuucuggauuauuauggcauucucuggagucauauggccuucuaacgaguucauagauuccuuaguuuuagauaugagauacaucauugaaggcugugagcccuuuguuagaaauuggagaugaauuuguugauugcuuucaaaauuuggagaugacauuugagacacgccuuuuaaaaaaauuagcauguaguaguaguaguaggaaauaaaugacauaaaaagugcagggaaauguaguauaauggcaaacacuggacuaagauaaauuuggguucugagccuauaaucugguuucauuuuccagcuguaucucuuaagagauuuuggacaaguugagacuugaaaaaacuaguaaccgcucuaaaagaaaaauggaacuuacauuuccacauucuugaguauauacacguaucucauuuaguucucaagacaccugugagguaccugugagcuagauaguacuagugcuaguguacuaaugagaaaaccgugauucagagaagugaaauaacuggcaguggaagaaaagcuaguaagugauugagucaacaguugacucuauaucaguuuccuuaucugaaaaacgaagguaauaccacuuuguaguuaugagaauuaagugggauuacauuaauaaggacucaaaacugcugcuagucucuuccucuaccccccuuuuuauaaagguccccacuucccagucucuugaccugccauucuguuaacuauuaauuaauaagagaaauuuauaauauggauauuacucuuauguaucuuuaaaauugcaaaagauuaugcagugucugaaggcuguauauuaaauguuucuuuuuaucauaaacauuagaaaaaacauuacuucaaauugcaaguagaauuugcaguauuguuuauucuaccagauuauccuuacauguuuccauuagcguauucucacaaucauuuuuucugauaucaugcuuucugcauugcuuugugaaguagcucaaaacugcauucuauauaaaaaaauuauccuaauaauaacucauuuaaaaaccaauuuggggcugggugcgguggcucaugccuguaaucccagcacuuugggaggccaaggcagguggaucaccugaggucaggaguucaagaccagccuggccaacaugguuaaaccccgucucuacuaaaaguacaaaaaaaaucagccaagcaugguggcgcacaccuguaaucccagcuacuugugaggcugaggcaggagaaucgcuugaacccaggaggcagagguugcagugagccgagaaugugccacugcacuccagcccaggugacugacaagacucugucuccaaaaaaauuaaaaaaaaaaaauuggguacugauuucuuccacauauaauuucuucugcauagcuaauacucuguaucuuaugauuuuuaaaauuacuauaagcaggcuucuugaugaaccuuucuccuuuagacauuccaguuugcaggauggcgccaaacuugguaaaagauguuucauaaaaacuuauugucaacaacuauucuauagaaccuguguuugaaccaugcagaguaaacacaucauuaaguuuucuuuuucuuggcuuuccuaaugaguggagaaaucuuaacacagcuggagaagccugaaacuccuuucugagcugauuuauuuacauagcauaugcuuaguuugacacauugcuuagaagcaagcagagagcuuuuaaaguuaagugcuauacaguacuucaaagaacauuuuagcuacacuguaauuguucagcuuuucuggauacaaagcaucucuuugcuguuaaaaaaacauuccugucucacuuuuuuauguuauggcuuucaaugcuagagaaaaguaagcugaauguauuuaaaagcucuuuuuaaaaacauauuuuaguuucagaagcugacgcauaaugcuaguaguuuaagauugugucugcacaaccaaggguaaaucuuucugcucuuaucuaguuggugugaaaguauauggugacuuggagccauaauaugauacuaugauguaaagaacuuacacuucaaagccagauuaaaucuagguuuaaaucccacuaugugcucacuaauaauuuuucuucagcaaaguuaagaacuacucaguuucuucaaccauaugugggugauaaaaaaaaaaucuucuuaggguuugauuucaauaaccgaaaguauaucuaaugcuuagcauauaugguaaaacuacucguuaaaccuuuccuuuuucugugaccuuccccacccucccaaaaaggaacaacuuccuuucucauugaaaugaauauuuuuuuagccuaaauauguuuuauuaagguuugaggauaaaugagaguagcaggguugaccuacuuauggagugcugaugaugauuuucauucagcacaagcucuggauuguggaaagaauagguugccauacagguaacaaaacccaauagaauaguuugaaaaugaacauacauaauuauaaacauggcgacaaaauacaugccuucagugugucugaauaaggcauguuugaguggaaugccugaauaggcauugauagagggaaauauauauauaaauaaaaaaugcccugcaucuucaaggaauucaaucuagagaaaaauacccacagauucauaauuacuugcaaaccagacuugaagaauuuguguaauugagauauaguaaagggcgacauggggagagagugauuaauuuguacauugagaaacuuucuggugagaugguaugacagagacuguggguuuccucccagggucuguuuucuccuuaauaauagaacccgguuuuuuccacuuggcauguggcugccuagaacagaggugccuccuagcuucccuugcagcuagagguggccaugugacuaagauuugacuaaugaaauguuggaaaugugugaagcuugaggaaagucucauuaguuugaauuaguucuacugagagaugugcuguuuugcccuucugccuuucuuuuucuuucugggauacaacacagacaugauggcugaggcuucaguagcuuucuuagggcauaaggugauguagaaagauagaaagcaccuagguccuugaugagcacauagcugcauauaugcuccagacugccuauuucuagauauauuuuauaugagugaaaacccaagcuggaacauaagaugguuuauuucuggugucuguuacuaauagcaaaaccuguuccucacagguacagauagcagugugguacaagcaucugacucccucuaaccccacaucuaguuaccacugaaaugacuauaaauauaucuaaauagaguguaccagcauugaaaacaccaaaaaggaaguguucacauaccugaaauaccaacaucccaagaaaaagaaauaacugcaguagguugaaauguaucaaauauguuaaaaaucugugaguucauauguuacuuuuuuuuaaagcuccuuauguuuggggacuagggagccaauucauuauuuugaaaauugauaaagauuuaaucauuaauucugcccuucccauacaaacuguauaucucaggguaaccaaguaguuggcaagagcaagauuuucuuuauagaaauauuuuaacuauacauuaagaaggucugauagaauaucacccauuuugcaacuuuuaaugaaacaaucaucagugauugcuaaaaguaauauugggugaacugcuaaaggauaacuuuauaauggcuuuccucuuguuuuugggcuacaacacagacauggcugaggcuuuaguagcuuucuugggucauauaauggcuuuauaauggauuaggcugaaaauagggauuaaucuuaacaucauaaaaagagagacaguugaacauuauauacuuccugaugaagguucacaucucuaucaugaaguauccuugugaaaaaucaaacccuacuuuuaucaaaccgccgagaucccgccacugcacuccagccugggcgacagagcgagacuccgucucaaaaaaaaaaaaaaaaaaaaaaaaaaagaaaagaaauauugaggagacagacucugaaauaagauucugcaaccuuaaaaauacaggaauguugcacucaacaccagggcaaaagcacauacucuugauauaaaagguuacuucuguaacaagaaaauuguagaaaacauuuuuuuaugcuuguagauuuuuuaaauuguggagucuuuggagugagauguagaaaauaaguucauaaggcagcagguggggaugaaagugggggcuagcuaacggggaggcauacauuaaaaggguguuggauauuaauaaguacggccuauaggauggaaacuaaaaaaugcaauauccgaauaagaaacaauaaaauagaaacuaaauaggcaguauauagauuaaacuguaccagaagcaacagagaguggauuagaaaauuguauuagugaugcagacuacaaauuugagaagcucucccaaaaugcagaggaaaagggggagaagagaugaaaaaagaaaauuugaagaaaaagaugauugacauaaaggauagaguacagagauccaauauauacaauugacauuuuggaagagaccagaacaaauucaacaggaacaauuauuaaacacacaaugggauaaaaacuuuucugagaugaaggaugaccugagccugcaauucgagcaggcuuguugccaaacaccaggaaaaauuaaugaaaacagccuaacaacuaaagcuauucuggcgaaacuuuguacuuucucuuguuaaaaucaucaucgucgucgucaucaucaucaucaugaucaucaggcauccaggaagggagaaaaacaagaaaacauacaaguuguucacaaggaaagaaaagauggacuagcuuuagauugauuguucuuaucauuaaacaucggcuuguucuugccauuaaacaguugagcaguguauacagaguucuguaggcaauuuggacccuaaaauucuuuauucagccaaguuguuugaugaagaagcaacacauauuuucaauucugcaagacuucaaaauauauaccacccaccuacccuucuaaaagaauuauuucaaaacauacuguagcugagagauucugcaacauacaggcaaaagccaaaacuuacaaauuuuuuccaagcaugacuuuagggcuuagcuaacucuugaaucacugcuuuguaaauugauucaagaguuaacuaaagucauucucacuggagcacaaacuaauuauucugcaaaaaucaauaugcuagugacccuaauuuucagaauugccuaagauaguucugaguuugggcagcauacguauuuccacuugcacauaguaccuacuuuaugcauaugguauauuacagugguucucaaagugugaucuccugaccagaagcauagguuucaccuggaacuugauagaaaagcagguuuuuaggucucuaccuagauuuaguaaaucagaaacugugggguuugugaacagcaaucuguguuugaacaaaccuucuagguaauucuaaugcccagugaaauuuagagccaguuguauugguucucagaccaaauuaaucaucagaaucacuuguguaagacuuugaaaugucuuuuccccguccagaugagacuuaauuaucuggauuuggaaaucacuggucugauaaagcuuagaaccaaaagaccaccuuaucaauuucugagccuuaguauuuucuauuguaaaauagcacucauuuuccugaccauuucauuggauuguugcagaaauuaaaugaagaaaugaauguaaaaguacuuugcaguguagauaaggaaauccauagcuacaaguucauuauccuguguuugaaaagggccucacuuaaugguuguuaauauucucuuggagaccaguauauaccaucuguguugggcuucagugaaguguucuccccaugcaccucuuucuaguaucuuucccuuuccuaacuaaacuaccugccacacuacuuuuuauuugauuuucaaauucaauuauuauauuuauuuuaccaccuuuucaauguggauuuuuuucacuuguuuucuguauguucaagucuuguaucuucaagguucuaaguuauuugagagcggaaaucguuucuauauauauuuuuauuuuccucaguaucagauguuaagcuaagcuaugcaucuauauaucuauauacuauagauauauaguaauacuaaguaaaaugcuucauucauugaauuuagucuguucauuagcucauugucauuaacugcuguaggaauugaugaggauuuucuuuuucuauuugauuaauuuagugcuuugaugcaaacaacuuuccuucuacuaguaugaaaaagugguuggucuggaaccagucaacaucuguacuucuuaaaauuauuuuuuuaaagguucaucauauuauucuuucugccuaguuuaugguugcugaaguuaagaaaacuggaacuaggugugguagcucaugccuguaaucccagcacuuugggaagccgaggcaggggguguugcuugaguucagaaguucaagaccagucugggaaacacagugagacuucaucucuacuaaaaauaaaaauaaaaaauaaaaauuagccaagcaugauggugugcaccuguagucccagcuacccaggaggcuaaggcagaaggaucacuugagcccgagagauugcagcuacagugagcuaugagcauggcacugcacuccagccugggugacagagugagagauccuguccaaaaaaaaaaaaaaaaaaagaaagaaagaaaugaaaagaaaggagaaaggaaagaaaaaaagaaaacuggaauugcuuugguguccuguuagggguaagacuaagauuuuccuacaaaaguaugucagguaggaggcccaguaggcuuagaauaugaauuuccacaccugagcuaauagaagccaccagguggucucaggucuccuuaugaguaaagugcaauaaccacgaaugugucuucccccaacuucuaguucuguucugcauuuuuauuuauacauuaucuuuaaaggcuaauaaaauuagcuuuccuuagaugguucuccuuuaucuccauaguguugaaauuuuuuauuuuuguuuugcuuuuucguuucauagcuucaaagccgauuuauuggcucggcucaguggcucacaccuguaaucccagcacuuugggaggcuaaaaggaucacuugagcccaggaguucaagaccaggcuggguaacuaaugagaccgcccccaucucaaaaaaaaaaaaagccaauuuguguugcaugacaugagcaaauagauuugaccuuugcugucacuggugauuuucauucuaaggguaauuacaaucuguauucaagauuauauguucuugccagaaauuaaacuaaguagaaaaaaaaaaguuaaagcuuuuuauuccccuugacuucuugccuuuuuuuauuauuauuuuuauuuuugcuauggcuaauaaaaagucauagaauaaaauaauuuuuuuaaaaaaaaagacagggucucaggucacccaggcuggucucgaacuccuggcuucaagucauccucccaccuugguuucccaaagugcugggaugacaggcgugagccaccaugcccagcccaaaaaauagcuuuaucuuuagauucuucuuuuucacacccuaauuucuuguacuguuaguuacucacauauacugccaccuuggggcuuuuagaacaugaguacauuuucaaagccucacauuaacauggggaagguuuugcuucaacgagcuauaccagaauaucauaauaauuaugacagaaauaagguauuauaaugcauuuguaagcuauugcuggauuuguggggccagugaggauccuguugucaagagcuuaauuauucuaagccaccuggggaccagguagcuuucuuagaauaaaauacauaacauucacaaucaugacucucauuucugucccuuucuaauauuaauauggcauuuaauuauacuguuagauuuaaagaaaauucaaaaauuucaguagcuucauucagaaaugcuaauacauuuuuagaacaacuagauaacuuuuccuaaaauuauguuuaccugugugaacuguugauuuaugguaaaauuaaacuuuaaccaaaacaagaccugugaaugucugaauucaguucgcagucuaguaaccuguuauaaguuaaaaucuucuggggaaggggaguauucagcuucugaaauauaauauuuauauaucuguucuaagauacccugugacauaucagagcacagccuuuggagucagacugaaaaacuggaguuaaaauaccauucuuaauacuagauaugugaaccaucaaauaaucauguggcuucagguaaauuacuuaacaucacaaugccuuaguuucaucaucuguaaguagggaaugcacaaaauuuuuuuaucagauuuaaguucucgucuuggcuuuguuccuguucuuuuccuuuaguaaaucuuuuuguggguccuuaugccuuagucuuuucaucuaugaaauucaaauaauauaauuuacuauaggaauacauuggagauacugcagauucaguuccagaccaccauaaugugaauaucacaauaaagugacucacacacauuuuuugguuucccagugcuuauaaaaguuauguuuauucuguacuguagucuguuaaguguagaauagcauuaugucuaaaaaauauacauaccuggccgggugcagugacucacagcuguaaucccagcacuuugggaggccaagguggggaggaucacuugaggucaggaguucaagaucagccuggccaacguggugaaacccuuucucuacuaaaaaugcaaaaauuagccaggcaugguggcauaugccuguaaucccagcuacucaggaggcugaggcacaagaaucgcuugaaccccggaguuagagguuucagugagccgagaucacaucacugcacuccagccugggagacagagcaagacucugucucaaaaaaaaaaaaaaaaaaaaaguacauaccuuaauuuaaaaauacuucauugcuuaaaaauuguuagagauuaucugagccuuuagcaagucauaaucuuuuuacugguggagggucuucccuugauguugauggcugcuaaaugcucaggguggugguugcugaagauugugguaguggugggaauuucuuaaaauaagacaacgaugaaguuugccacauagaaugagucuuccuuucaugaaagauuuaucuguaucauuccaugccauuugauagcauuuuauccacaauagaacuucuuucaaaauuggagucaauccucccaaacccugcuguugcuuuauugacuaaguuuaugugauauuccaaauccuuuguugucauuucuuuuucuuuucuuuuuuguuuuuugagacagagucucacucugucaucuaggcuggagugcaggggcaccgugugagcucacugcaaccuccgucuccuggguucaagcaauucuccugccucagccucccaaguagcugggauuacaggugcccaccaccacgcccggcuaauuuuuauauuuuuaguagagacaggguuucaccacguuggccaggcugcucucgaacuccuuaccucagguaaucugcccgccucggccuccuaaaguacuggguuuacaggcgugagccaccgcgcccggccagucguuucaacaauguucauggcaucuucaccggguguagauuccaucucaagaaaccacuuucuuugcucaugcaugagauugcagcaauucagcccccucuucagacucuacuucuaauucugguucucuugcuguuuucaccacaucuguaguuacuuccuccacugaaguuuugaaccccucaaagucauccaugaaggugggaaucaacuuacaaacucuguucauguugauauuuugaccuccucccaugagucaugaauauucuuaauggcaucuagaaugguggauccuuuccagcagguuuucaauuuauuuuaccuagauccaucagaggaaucaccaucuauggccagcuauaguguuacaaaauguauuuauuaaauacuaagaccugaaaguuggcugggugugguggcucacaccuguaaucccagcacuuugggaggcugagguggguggaucacgaguucaggaguuugagaccagccuggccaacauagugaaacccugucucuacuaaaaauauaaaaauuagccagccaugguggcacaugccucuaaucccagcuacucaggaggcugaggcagaagaaucgcuugaauccgggaggcagagguugcagugagccgagaucaugccacugcacuccagccugggcgauacagugagacuccaucucagaaaaaaaaaaaaaaaaagacaugaaagucaaauugcuuuuugaucuaugggcuucagaaugaauguuguguuagcaggcauggauacagcauuaaucucguuguacaucuccaucagagcucuugggugaccagcugcaugucaaugggcaguaacauuuugaagggaaucuuuuuuucugagcaguaggucucaacagugggcuucagauauucaguaaaccaugucguaaacagaugugcugucauccaggcuuuguuguuccauuuauagagugcaggaagaguagauuuagcauaauucuuaagggcucuaguauuuucagaauuauaaaggagcauuggccucaacuuaaagucaccaguugcauuagccccuaacgagagucagcuggugcuuugaagccaggcauugacuucucucuagcuaugaaaguccuagauggcaucuucuucuaauagaagacugcuuugucuacauugaaaaucuguuuaguguggcugcuuucaucaaugaucuuagcuagagcuucugaauaacuugcuguagcuucuacaucagcacuugcugcuuuaccuuguaccugauaaaccagccucugcuagcuuccaacuuuucuucugcagcuuccucaccucucucagccuucauaaaauugaagaggguuagggcuuugcuguggauuauuaggcuuuggcuucagggaauauuguggcugguuugaccuuaagaccgccagaauuuucuccauuaucagcaauaaggcuguuucacuuucuuuucauucauguguucacuggaauagcaauuuuaacuuccaucaagaacuuuuccauugcuaucacagcuuggcuuuuuggcacaagaggucuagcuuuuagccuauuuuggcuuuagacaugcccuccucacugagcuuaaucauuucuagcuuuuguuuuaaagugagagacauguggcucuuccuuucacuugaauaguuacuggucauuguagaguuauuaauuggccuaauguccauauuggugugucucagaaaauagcaaggcccaaggagaaggucagaaacaggcaaucggggaacagcuggucauuggagcagucagaaaacacaaaacauuuaucaauaaagguugccauuuuauaugaguacaguuaauaguaccccaaaacaauuaaaauagcaacauugaagaucacugaucacagaucaccauaacagauauaauuaugagaaaauauuagaaauacugugagaauucaguaacauagagcauguccauauauauacccgcuacucaguuuccuugggauuuuuuuccuagaaauacaaucuuauuugaaguauuaugagcacuuguaucacagaucauuucaauuuuguuacuaaaaaauaaaagggacuugcaaaauuuccuuccuguuuugccuuauugugaguagcuaccagagaauucuacuuguuuauauuacuggaaggauccuaacaaccaaaaauauuaggcaguucuccuuugaguuacaucuaucacuggauauuuaacaauuugacuguauaauuuaaaucuuggucuauuaagcaguaaacagauggaacauuacuaacagcaguaauuaaauuauaaaucuguuuuaaaaucggccaauauacagcaucacaguccguauucuguuaugucaguuauguucguuuuuauuuggauuacaauuucugaauacccaaauauuggaaagaaaacaaaguugucugguucaaaugucuguuuuuuaucuuuuuaauuauauaggccaagugcuugcuugcuugcuugcuugcuuucaagaaaggaaggaaaggagggagcaacggagaggaaagaauauuuaacaauguucauuuauucaacaaaccguuaaugaaugucuacucugagcuaggcacaguuuuuuuuugcccccucacucugucgcccaggcuggagugcaauggcgaucucagcucacggcaauucuccugccucagccucccaaguagcugggacaacaggugcgcaccaccacgcccagcuaauuuuuuguauuuuuaguacagaugggauuucaccauguugaccaggcuggucucaaacuccugaccuugucaagugauccucccaccuuggccucccaaagugcugggauuacaggcaugagccaagcuaggugcauuucuaaguauuggggauacaacaguggccaggagaagcaaaaccccagcccucauggaauuugcauucuaguggauuggggaugaauaauuuaaauguauaauaugucaaauggugauaaaugcuaugaagaaaaauaaaacugaguaaggaccuagagaaugauggggugagaacugguauuuuagauaagguggccagggaagcccuuucuaauacauuggcauuuaagcagugaccugaaugaagugagagagccauccaaauggauaucuggggaaauagagugcuaggcauggggaaugacaagugcaaauacccugacuugggagcaugcuuaacugucaaucuucaauucauucuaccuggaagcuuuucuuaacaccuuaaaagguuaagguguuuuauagcauagucuacauaacuuuuuuuuuacaguucuuaaaucuuagcauuauuauuuuuucugccugcgaaucuguccuuuagagacauggauaaugccuuaccugccacauaguagcugcugaacaaauauugaucaaaacaaucagugaguuugauuauuuguugagcaauuacuauuucaucuacuuacucaguaucaauaaauuauuuuuuaauuaagaguaagcauucuucucaaucaaggaauuauaggaaacauaaauagauguguaaguagauaagagaaauaauaagcagggaaacuuuggccuacauuauucgagggaaaaaaagccaauaacaauguaagugaauauuuaaaaaaccuauugaaagguuguucuuuacugaaauacaaccuucauauuuugaaagcucaugaugcuauccauaguuccugauauuuagugaauuacucuaauaguuacuugaaguaacuaggaaaauaaaucugaaaaguaaaguaucacagaaaagauguuugaauugcaaaucacuuuagaauagaacaauuugcuuuccaaaaaaaacccuaagaguuauguuuuacuuucccuaauuuuuaacuauuucuacaaagaaguuuuuccacaguuucuuuaugaugcuuacugcaugacauuuucuguuuuagaucuccagcguuauaagaccugauuuuuauuggauuauauuucuaaugaaauaaaucuuuagggucagcaguaggugagguuucaagauuuuuuuuuaauuuaugaguuuuucauuuguuuguuuuaccuaaagcaucaaucuauuuuguagauguggcaaaagcuucaaaauaaauaggaagccucucaccacucaaaguuaccaucauuuauaccuagcagaaugucagugcaaucuacuucuugaaauuucagagugucugugucaguuuucuauaauuuggcaacauuauaaugaaauuacugaguuucucuuuagaugagccuauuuuuuaguuaauacuguaugucaacacucagagauuuccuucucuucauccuccuucgaucucucuuaccauccccgccccucugaaaaaaacccgugcccauuugaaagcuaaauuuuucuacaaauuuuuaacugacuuacauuuuuuucuuucaauauuuuaacaaaguuaaccuuccccuucuuaguuuuucauuauuuuuuuuuaagagacaggaucucgcuguguugcccaggcuggaauacaguggcucuucacaggcgcaaucccacuacugaucaucacacuccauuuccagccugggcugguucgucccuccuuaggcaacuuggugguucucuacucccgggaggucaucauacugauggcaaacuuaauguggacacccgaucggcauagcacccuauagcccagaacuccugggcucaagugauccuaccccagucccaaguagcugggacugcaagcacaugccauuuuuuauaguuaaaaaaaaaaaaaaaaaacagcguggucauggaaaauuagaaaauaaagaccuauauaugcauuguuuacuuaaaauaagauaauacuaaaugugcuguucuguaaccuauauuuuucaguuaacagucuucauuucaguaucuuuccauuuuaucaaguccauuguugaauuucccaguccagaaccaaguuucacaucugguuguuaugucccuaagucucuuaaaaaaacacacacaaaacagcccccuccuuuuuuauuuucauaucacuuauugaguugaggagacaggaccagcuguccugcaggaugucucaccuucuagaagugucugguugcuuccuccuuuaacuuguuccucuaucccuuguauuuccuguuaaccagagauuaaauuuuauguccugagagauccaagugaaacauuuugggcuggaauguaugguaagugauauauuuuuuauuaugacuuaucaggagacagcuucuggaugggucacaauuaaggagacuaaaguugaccacugaauuaggguaugacuaucugaucuuuucacugucaaguuuaaucuuuuucuucuuucaacuagaaaauaacauauuugguguuacuuugcacaguaugaaucucuaggucauggcaaacguauaccugcauuuaacacuugccugaaucuguaauaucaugagggauuacauaaugcuaauuuucuuauuuuuuaaaaaaauuuacuucuuauuauuagauaggcuuuugcacaacagaguauuuuauuuacuaggguuuuugauuuguucugaaauauggcugcuccuacaaagacaaguaaauaauuuuuuucacucaguugccaauuuuugucagcuuagaagauuagguaaguuuuuugcuggcuuucuccuuuuuaaauauuauugcagauucguggauuuuuauugcuucguuguguuucagucuacuucacucauaauucuuacaaauuugacuaauaggaaagaggaccuuuuagacugauuccugugucuuuuugccaugauguuauauauuuauggaaauguuuaaacaaaaguauauagugagugguauacugaacuuccaauauaucugucacucucaguuuuagcaauuagcaauaauuuucuaauuuuaucugucuccugcugcuuuuuugacacccuugauuuuuauuucauugguaguggaaaguuuguuuucugguguggcaaggugucccaucccuagaccuggaauuacucauuucuuuaagaagcccugauugucuuuaguaacgaauggcaucagacaauaaaaccuggacauaaggauuauuggaaguuuuuaaauuugauuuuucuuuauuuucccaucgugugcuucaacauauugguagcuguguuaguuuguucuugcauugcuguaaaggaauaccugagacuggguaauuuauuuuuaaaaaaaaagaggcuuaaaauuggcucacaauucugcaggcuauacaaacauggugccagcauccacucagcuucuggggaggccucagggagcuuuuacucauggcagaaggcaaagcuggagcaagcaggucacauggccagggcaggagccaagggagugugggcaaugcuuuuaagcaaucagaucucacgcaaacucauucaucaucaaggggauggcgcuaagccauucaagagggaugcacccccaugauccaaacaccucccccuagaccccaccuccaacacugaacauuacauuucaacaugagauuuggguggggacaaaugcccaaacuauaucaguagccuuguuccauaagcaggguugcaggcaugcgaguaguggaggaagggcacuucucaaagauaggauaaaaagcuuuauauuucuauauuaguuggucaaaauguaaggcguagcugacagauuacucagcuguugacauguaagugcuuuuaaugaaggauuuaaaaaaaaaaauaaacaccauuuaguguuaucaguuugcccccacugcaauauaaggaaauccucaauuuauaugacuucuuaaguuuuguuuguuacacacuuugguuucucauaguaauaaugcagaugaugaauuauucucaguuaauaggguuaaaaauguauuauuggguuuccacuucuuaaaaucuguauucaccuccuuucccuucugaugccccagcaaaauaaaauguuuaaaaaugagaaaugaagaagccaguaacaguaaauaggaggacuacccaaggaugauaguugaacagauuuccagaucucuaguugaguaccaguaggcccaacuauacccucuucuccccuccucauaccucuuucaccccuacacuugaauacagauagcuggcaagaaucccaggcaaacacuaggcagauuuucuuuacagagcaugagaaagacgaaggcuucuaaagugugugcuguguucguguaacaaaagagaaaacaccaucuucuuucuggcauuugaaaggucugcuggcuccccacccacucacccugugggaacacugccagucagcuuauguccagcccacacagagcucccucuuuuuauccccuccaggggaacaaucuagccaaaaucagacuaucuucaaaauaacacaggaaaucuauguuggcuaaugagucauucucccuuaaaugugaaugaguaaccgaagaucaccaggcauggugggaaaaacuaauggcaugaaagacuaaauaaccaggaaaauggccaguggaaaaaguaaaacuaauaagaaagaacuuuauuuuaaaaaaagaagaauaaaucaucuaauauauucagagauccaagaagauacuacaucuauuaaacaagaauaggaggacacaaguuuuuagauugaaagggcacaccaagcacugaaauagagaaucaaacaugguacugugacacaucucaaaacugcagaauuccuaggauaaacaaagaucccggaagaaaucacacacauaguaacaaguaacagacugaaaucaaaccccuuaugaauaacuuuuaaugauuuaagacaguaaaguauugccuacaacauuuuagaaagaaaauaauaugcaaccauggauucuacaaccugccaaacuauuaaucaagggugagagcagaauacaguuguuuucagacacugaagggugcaaaguuugccuuccauuggaaguaaaagaaaugaaugaauuacacauucaccaucaacuucuugagaaacggaaguuuagcauuugauuuuuuuuaauauaucauugcugccaaaaggguugaggggaaaaugagaaggggggauuaaaaacgauaaaauuaguuguugauucacaccauacaauaaauuacagagcuccuguggcaaacggcaguuaaacuacucccuuuacucucagcaggcugaaauguaucauacauuauauguauaacuauccauaauuucccauguuucccaaucaucccagcaaaaaguaacccaggacuacuugcauugcaaucacaacaggcucauacaccauauggccagaagaagcaacagcaucacauuuuccucccaucaggacuggaaugacaugaucugacuuaaauuuaagagcaucauucugacugcuguguuaagaauagacuugaggguggaguaguaggguaagcguagaaggagagagaccaguuugaauauaacugcuguguuccaggugaaagaugacagugauucugacaggguaguaacaauguaguuggugaaaagaggucagauucuggguauaauuugaagguagaaccaacagaauuuccugacuuaugggauauugagugaauaagaaagggucaagauuuuuagucugagcaguaggaaggguggaacagauugaggaaaagauugggaguuaaguuuuggauguuauuucagaaaucuauuugaccuccaaauaaagauauauguauuggauauacguaucugcagcucugaagaaagaccuggccuggcgagagaauuuggggauagucagccuuguauuuaaaggcaugagguugggugagaucaaagugaauagacugaauagagauaaagaaguucaaaagacuggggcccuaagguacucuaacauuuaagaauuagggagaugaaaaggaagacucaaagaagagaagaacagccagugggauuuuaggagaaccaaaagagaauggugcccuagaaaccaugggaagaaaauguuucaagaaggaaagagccauugacuauuuuaugcuguuaggaggucaaguaggaugagcacuaaaaauucauuguuggauuuagcaacauggauguugguguuuaccuugaaaaggucuacuguguuuuuucagacagcuacuaagguguuaggacauaaauacuuguacauaaguaguuauuuggcccuaacuauuuaauaaaugcuacauguugagcaucccaaguucagaaaucgaaaauacaaaaugcuucaaaaucaagaacuuuuuaagcaucaacgugaugcucuaaagaaauacucagugaagcguuucagauuuuagaucuggggugcugaacuguuaaguguaaugcagauauucccaaaucugagaaaaauccaaaauccaaaacccuucuggucccaagcauuuuggguacagcauacucaaacuguauuagguauuucuuuuggccuagggggcauugugaaaaauuacugagauaccaagggagccacaaacuaagaaaguuugaacaucucugcuuuagaagcuugagcuaacuaaggauuucaccaaaaggaggaagcaccucuuaccuuuuuuugugcugaaaaguuugaguuugcaauuuuaaaucugauccaaaauuguccuaauacaguuguucaacauuaaaaaaaaaaaaagcaaagaaaacuuuauccuaugaaaugccgguaguacaucuuugcaugauuuuuuuucuucuugccuccauagguauggucugaauaugcguugcuuggcagcucgggucaacuauaagacuuugauuauuaucugcgcacucuucacuuuggucacaguacuuuuguggaauaaguguuccagugacaaagcaauccaguuuccacggcguucgaguaguggcuucagaguggauggguuugaaaaaagagcagcagcaucugagaguaacaacuauaugaaccacguggccaaacaacagucugaggaagcauucccucaggaacagcagaaagcacccccuguuguugggggcuucaauagcaaugugggaaguaagguguuagggcucaaauaugaagaaauugacugucucauaaaugaugaacacacaauuaaagggagacgagaggggaacgaagucuuucuuccauucacuuggguugagaaauauuuugauguuuauggaaaggugguucaguaugauggcuaugaucgguuugaauucucucauagcuauuccaaagucuaugcacagagagcccccuaucaccccgaugguguguuuaugucuuuugaaggcuacaauguggaaguccgagacagagucaagugcauaagugggguugaagguugguaucugucugcuucacuugcauuuuucaagcaugauuguguugaggaauaagaaaauguuguuaauuauacaucaaguacauagcuuacugucaaaagaccuuucaucacucuaauuuagcagggaggaacagguuaagccugaaccuagggcaacuuucuagaugcuaugacuuaagggcugccauaagaccaaaccugggcaaacagaauuauuuuauuaacguaacucagaaucuaaaauucucaccaguaagguaaaggcauuguuucuccagaaguuugcguuaaaauauauagcuagaauccugugagagaugggaaagggagagagaccauccaguggacccaucaauguaccaguguggucugguuaccuaaugagucaggugucaucucuggaaggagguuucaagucuucagaacaagacaauauguagaugcuuuuucucuggacuuauacugaacuccuagucuauuacauuuuucauugucuuuaaaaccuggggcaguaagaguuccuuguggauacaauuaauaugcuuuggaauuugcuuuucaaaccagaaagccaaauugaauuugacuuuaaaguauaucacuuaaacagaggaaagagcuuaauauguuugagauuucuugguuuggguuuuacuuuccucauuuuguuauaaagugauuuuaagaucuuaauauuuuaaaaucuguauugaaguaaguuuuuaacuaacuaaauauauauuuuuugcucuggaaagaaguuugugcucacuuggugaccauguggauguuuucagacucccacagaccgaaggauuauagcccacucaugucugugaaguuaaugguguguuuauucauccaguuggaaauuggaauuuacauaucugaugcaggaguuuuuuccuuuguuuuuacuacuuagauaaauuuuuuauaauaucuuuuucucuuauuuugagacagaaucucacucugucacccaggccuggagugcagugauacugucauggcuuacugcagucucgaucucccaggcucaagugauccucccaccucagccucccaacuagcugggacuauaggcaugcuccaccaugcccagcuaauuuuuuaaaauuuauuuuuuguaaaaacagugucucacuguguuguccaggcuugugugaaacuccuggacucaagcaguccuuccaccuuagccucccaaagugcuggaaucacaaacaugaggcacugugccuggccaauauccuuaccaaauguuuagaagagagaagugaccagauucaccuauacucuuaccaccucaauauaauuauuauuauuuuuauauauucucuggaggccuuuguacuuagacauauguuuuagcauaaucguaaugauguuuacuauacagugauucaggagaguaauagagauuucaaagauauucagagucaaaccuuuuuuucagcaguuuuuuaaaugcaugaaauuaauaggcgccuaaauucuaaaauaaaaaaguaaaaaguacccauaaccacuauuaauauuuugacuuuuuuuccccauucuuuuuguuguuguagaaauauauuuuuauuuuauuuuauuuuauuuuuaauuuuuaaguucagggguacaugugcaguuuuguuauauagguaacuucaugucauggagauuuguuuuacagauuauuuugucacccagguauuaagccuaggacccaucaguuauuuuucugauccucgcccgccaccuacccucuacccuccagaggccccaguguguguuguuccccucuauguguccaugcguuuucaucauuuagcucccacuuagaagugagaacaugcaguauuugguuuucuguuccugcguugguuugcuaaggauaauggccccucgcuccauccauauuucuacaaagcacgugaucucuuucuuuuuuauggcugcauaguagaaaugcaucuuuaaaaaaaauucagaucauacuguauggucaauuuuuauucugauauuuucuacuuaacauguuucaacuauuuccccucacugaauauuuauugaacauuuuaauaacuaauauuuguaguaaggacaugccaugauauauguaauguaugagacccuucucuuuaguuguacacuuaggucauuuccagguuuuuuauguuuuuuaauuaauguuuuauauuuaauuuuuguggguacauaguagguguauguauuuaugggguguauuagauauuuugauacaggcaugcaauguauaauaaucaucacaucaggguuaaugguguauccaucaccucaaccauuuauccuuucuuaguguuacaaacaauccaguaauauucuuucaguuauuuuuaaauauauaauaaauuaagaucaagugaauaaaaucugguauuugguagcacaaagggugacuaacuauauuuccauuuuuuugcuauuauaaauguuacagauuuucauuguuaaucuuuauuugcuauuuuaauuuuauucucauuguaguguauuccuauucugagaauauaauuaacugccaugucaaauaaccugccaaaccuuuguacuguuuugccagccauuuuccagaaagguggaacuugcucaugcuuccagcagcagaguaugagggugccguuuucacccaacucuugccaucauggaccauuguuuuuuugucuguugguuacagagggauauuauaauuuucucucuuuaacaacuagugaggucagauaucuuuuucuuaugcuuuuugccguauuuucauguucuuuaccccuuuuucgaaugugauaaguggaguuuuuuaaaaauguauuugugugaacuuauguaguaaggguagcaguacucauauuuguuagagauguuucuucaaucugguugucuuuucauuuuacauaugauuuguugguuuuagaaguuuuuaguuccauuuauuaaacuuaugggguuuuuuggaucuuuguaccucuucuuuuuaugcuuagaaaggcacuugccacaccacauuaugaucagcuuuucacuuuuaguuucucugauaguuuuaugguuucauuuuuuuacguuuaacuuuuuuaguucugcuaaauugauuuauauuuuggcaaaugguacaaggucacagccuaauuuuaaaccuuuuuccccaauauguauugaaucaucucuuuucccacugaguuugauggaauauucgucauuauacuaaauucuuaggaguacuagaauguguuucuggacugcuacuugguuucauugaucagucccaguucuugugccaguugcacauuauuguagucaccacucauguuuaaugaaguuguauaaaccaccuuuuauuaauugauaauaauucuauuugaauuacagaggagaucccccucuuggaggaaagguacaaauguuaaaaagcuuaucuguagccuaccuaauuccguaaacauuguuuugaaucuacaacaaaacacauaaaauuuuguagauucccagucucugcugugcucaucagauucuuauuaauuuuagaacuacagauaguaguuuaucucucaauacauacgugauucaaccauacaacauuauguaaauguaggauuuguagcuccuaaguaguaaauuacuaagaaaaacacuaauaccaaacauuuaaaaguuguacuuagaacuuuacauaagguaauccauuaaugaauuauuucaagaaucuaugguaaaauauacaaacuaaauucauguuuuaaaaaacacuucuuaagaauuacauuuuaacaggaaagauaugaaaaagaauuucaagcuguguuuauauuuuaaauugccaagucacaacugguuuuuuuuuuuuuuuuuuuuuuuuugagacagagucuugcuccaucauccaggcuggagggcaguggcgccaucucggcucacugcaaccccugccuccuggguucaagugauucuccugucucagccucccaaauagcugggauuacagguaccugccaccacccccagcuagcuuuuuguauguuaguagagacgggguuucaccguguugcccaggcuggucucaaacuccugagcucaggcaguccacccaccuuggccucccaaagugcuaggauuacaggcaugagccaccgugccuggccacaacuggcuuuuuaagcaaauacauuaaccaucagaugacauaccuaauuaguagaccacacuuugacauuggagggaaagaugaguauguaguaacuugacuguuaaguauaaauguuuaagaaaauuucaggauuaauauugaaaauagaacuguggugacauuagcuauacgcaucuaaauugugcagaauuugaauguaggaaacaggauuaugaaacaugacaucuguagccaugagcaaaaguaacacacacaaaaagccaguccuuaaaagguaauuuauagcguugcacuauuuguuaacaaauaaugaaugagagugaaagaauacuuaauuuuuguuuuucacaucugguuaauuugguacuagaucuggucauuaugagagcaguauuauaaggaagcccacaacuuccugauaacccuguaagaucccccagaaguaaaucagugaggaaugguauuaggaauaggcuuguaaugucuggauaugauuauucauuuuguuucucuauuuuauaggugugccauuaucuacacaauggggaccucaaggcuauuucuauccaauccagauugcacaguauggauuaagucauuacagcaagaaucuaacugagaaaccuccucacauagagguauaugaaacagcagaagacagagacaaaaacaagccuaaugacuggacugugccaaagggcugcuuuauggcgaauguggcugauaagucuagauucaccaaugucaaacaguuuauugcaccagguaaguuauguauuauaugugccugcuaauuuuauguugauuuaugggacccugauagucccuuaaaauuuuaauaugguuuaaaaaaacacauaagcagacccuuuauauuacauauauaaaguaacaaauggugucaccccaaugaaaucucuaaaaaagauacagcuaaaaagucaagguuauaaaaaggaauauuuacuauguaaagagccaagccauagauugaaugguaagguccagguuacugcacaauguguaccugccuccaggggucuauaucugauaggaaugaaguuccuccauuuaauauuucaguacaguauaguuuaauuuuuaaacuuuugcaguaaauagaaugguuuuaaggagacagccaucuuuuccuuugccuauuuuuugccaauagcuuuuaauuuuuucaggauaauagagcauuaccaaagaggccuguuucccauauuggauuuuguuaauguaguagauuaucucaaacuucauguaaagucauuuucauuaauaaaauaauuaacaaaaucaaauuaacuuuaugcaacauuuccccuuuuacuaagacagucucauuaauuagaauguaaugcauuuuccugcacuaaucaauaucaaugagaauuaaugaguccauuacuuaagaagacaaugaaauaauuuuaguuagcaccucagguuuaauucucuaugggggaauguugucaaguacagaacuuguucccccucccaccagucuugcaguugguaaauaaaaagagaggaaagguuauaagaccucuucuguauucucuccuuguucuucauugaugacuguguaauuuacagacccugaaagccacaauacaaaccuacucauucuagauagccuuaaguaaugaauuuaugaguacugaaugcagugcaaauaauagaugaccuuuaauuuuuauucugucacuagaacuccuuuucucccauggcauucugugauauucugguacacagagcaucuuugcuuauuguaaacaacagguuuggcugagugagaaaguacaacuaaauuuuuaagaauauuuagcuugugauaccuaagagguuauugcaacaggaaaugauuagacuaugcaaaagaacuuuugggugcacucaagaaacuuauuuuugcacuaguuaauaaugguugucuggauuaggguggaaucagcagcccucaccuugaucuccuugaguguuuggaagguuuucuaggacagucuuuugaacucuguccuauuuagagcaacagauuucauugugcacuuuugggugcuuugaguaauacaaaagauagguccccacaucuuaaaugagggauccuuagccccucauucuguagccaguagcuggagauaaaacuacuuccuaagaugguuuuaagcauauagaggagagaacucugucucuaacagccacucugcgagugggacacagcuguucuaaguuggaacucccuguugguggaagcgugcuagcugggaauggaauucugugugugcauguacagguugaguaucccuuaucugaaaugcuugggacuagaaguguuucagauuuuggaauauuuacauauacauaaauauccuggggaugggacucaagucuaaacacaaaauucuuuuauauuucauaugcuauacacauagcccgaggguaacauauuauaauauuuuuaauaauauaugcgacccaucaugagggaagaucuggaauuuuccacuuguggcaucauguuagcacucaaaaaguuuuggauuuuggagcauuucagauuucggauuuuugaacuaaggaugcugccucuccaguugcauacuauaagaguaugagagaaggugaguuggaguuacaugggaguuauugcucagaacagagcaggagaagggaaucaaagaggugagacuauuuuauugaagcauagguaugagaaaugaggcuuuuuagaggauauagaccucaugggagauaaauucagagaaucaccauuaagaggaaauuggaacuuguacauaaaagcauaggcucaagugaggugagacccuggaggaccacaagcugaaugcuguuggucuuuuuuuuuuucuuucuuggccuucgauuuuuuuuucugaaaggggauaaaaucaaauaugagugaagaggcauauaauaugggucugcagcauauuuuuguuguuuuauuugucgaauaauguuuuauuccuuuuucuaauuuuaaaauugaaugaauugaaacuuuaggccuguccuacucuauuaaauuaaauuagcuuucccuuuccccaagcacucuuuucauuugauuuccaugaccucacuuucuccuauuucuguagccauucuuucucaggcuucuugggagcuucucuucuucugccugauucuucuuucucuugguguuucuuaagauuuugaguagggccucuucucaugcugcauaguaaaucuguugauuaaacgaauggauugauuaacaguuuuuguuggaugugaaacauugauuuaaaggcuuuuuuucccagcuuuauugagguauaacuggcaaauguauacaaugugaugcuuugauauacauauauguugugaaaugacugccauaauuaaauuaguuaacacauccaucaccucauaguuaccuuucuuuguaugguguuggugguggugagaacauuuaagagauauuuuagcacauuucaggcauacaauacaguauuauaagcuguagucaccaugcuguacaucagaccccuagaucuuacucaucuuauaucugaaguuuguacccuuugaucaacaucuccccauuuuucccacccccccagcccgacaaccaccauucuacuguuucugugaguucaguuguuuggagguccacauauaagugagaucauacaguaucuuucucugacuugucacacguagcauaauuccuucaagguucgucuauguugucacaaacggcaggauuuccuucuuuguuauggcuaauauucuauucuauagguauguguguguguauacacacaugugugugcacgugcacacacacacacacauauuuacaccauauuuucuuuaucuauacuagacacuuagguugcucccaugccuuggcuauugugaauaaugcugcaaagaacaugggagugcagguaucuuuuugagguuauugauuucauuuccuuggguuguauaccaggaagugggauugcuggaucauaugguaguucuauuuuuaauuuuuugaggaaccuccauacuguuuccuaaugacuaugccaauuuacauucccacccaaagugcgcaaggguuucccuuucuccauauccucaccaguacuucuuaucucuucccuuuuuuaugauagucaucccaacagguguaaggugaugauauaucauugugguuuugcuuugcauuuauuucccucgugauuaaugauguugagcaccuuuuuauauaccuuuuggccacucgugucuucuuugaaaaagugucuauucagaucauuugcuuauuuuuuaaucagauuuuuuuuugcuauuuguauaaguuccugauagauuuuggauauuaaccucuuaucagauauauguuuguacauauucucuccuauucuauagguugcuuuucauuuuguugauuguuucccuugcugugcaaaagcuuuuuaguuugauguagucccacuuguuuuucugugccccuuuugcuuguacauuugaugucaaaucuaaacaaucauugcuaagaccaaugucaaaaguauucuuaaauguugaucauccuuuauugccuaaagugcauauauaugugucacauauaccaaaaauaaacaguuauaguaacuacugggaauaacugguuaggagaggaugggucauggcuuucaaacaauaaaaaaaaaacaaaacuuucuauuagauuugaaggaggaaucuucagauagccuaguaccuccaguagagcucagaaccuuaccugguacauugccaaacugguuuccaccaucccauuugcucccauucagguccucgugaaugaugccaggagguuauuuaacguccucuguauaucuauaaaaugggaauuaaaugauuuguaagauuguugugaagauuauaauuguugguugguuaauuuaaauugaggauugugacuucugucacuucuccuagaugacucaguaacacccucugcugguguuaaggucuuaggaaaauuaauacauuggcuuuuuaaaagguuacaucccuugacaucguucauuacugaguucuuuggacugguuugucauaugaagauauaaggugacugauuaaaccaugucauuucauuaaauuuguguaaauaaaauuguaauucugggaggaaauggguacucuuccagcuuccgaaauucugggaggaaauggguacuuuuccagcuuccucacacuuggacuucuaaagaugggucauuguuauccaguuuggccagaauagacgucauaguuaauaaucccaucugaugagaaugaaaaaauaagcacucaagauagucugcuccacugaauauaauuuaaucuugagugguucauaagucaguucagaauccugcaguguuucagggauguuguccugaacuucagaucccauuuuacuauagaugcagaaaaaugcuaguuaagagagagaguacauguugacauuuugccagauaagauggauuuuuuacuguauuagaaguuuacuucugcaaucaguuuuucuauuaaguuacucagagcauuguuugaugcauaagucuaugaggauguucucauucuugauacaacuuucagaauugucuguuccauccaaugaaguaauuaagagccuugggacaaauauaaccauacugcuugaguccaguguugcaagaguuaaaugaucaacucagcauacugacacccuccaaguauacacuaucaucaguucacauuccuuuuucccuuucuuuuuuuuuuuaagagacagagucucauucugucacccagaacaagaguggugugaucauagcuuacuucagccuuaaacuccugggcucaagcaguccucccacguuggccucccaaguaccuaggacuacacaugccacugcacuuggcuauuguauuauauuuuuuguagaguuagggucucgcuuucuugcccagacuggucucaagcuccucgcuucaagcaguccuccugccuuggccuccgaaacugcugagugugaccaguugugccuggcccaguucacauuucugaucuuugcuccuggugacacacuaaagauuuuuucaaggauucugcaaagcauagaucugcuucuauggcugcaucuaagagaaccuuucuauugaauauucucauaagaauaccaucuccaauaucauuugucuuuuucacagucugaaccugaguccgggaaaccuggauucuagucccugcucuacaacuaauuagcuuuuggcauugggcaaaccauuuaaccuugcaaagccuacauaucuucaccucuaaaauggagauguaauauaauaauuccugcccuaccagcuucagaagauuaaguaucaagugagauaauacaugugaaugcguuuuggacauuuaagcugugaaaagaucaagauaggaagauuucccuuuaauauuuuaaaauuuguacuacguauauuuuuguuguucuuauucuugcugcugcuacugcuauuuuaauaugcucaguuucuugguagaucuagaugagcaguauucaaaaugucaucuuucugggaauuagccaucauuaauacuauaaauauucaagagaaauuuucucuuuaauaauuugucaaauaaaacagcuuuaacuuuuugaccucugaagccaguggcuucggaauaauaaccaucauuuauuacuauauuccacuccauugucuuucuuaaaauccucacaauuacccugcaaaguaauauuaucucuauuuaacaugugaagaaacugaggcucaaagaggugcaucuugccagacuucucaaagcuagugguugaacaaaaauucaaaucugagguuuuuaaacuccaaagccugagcuuuacccugucacuccaccauucucucacuuuuuguuguacacaugagcccauugcuuaauuuccagaaauuuuauuagcacuucuagcaaguaugugaaaacaaaucuaucauuuucaaaaucaaauuaauaauguguuguggagcgagaccaggcaaccuggguucaagucuuguaccuugggcaaguuacuucuuugugucucaguuccucauccauaaaguaauaguaauagcaccuacccuuguaauuguucaggggauuaaaugaauaaauagguguaaagcccuuagaacauaguaaguacauauuaaauguuaaauaguuuaaaauucauguauaaccauuuuuucuagccucuuucuugcaauauuaugugcugagccagguuuuggcuuuuuuuuuuuuuucuguuugcagaauggguauaguagaauagucauugauuacugaucagcuaguacuagauuuaggaaaggcaguuuugaucaacaauaccuuagccauuugcucucaauccucugcuagaaccuagacagggcaaaagguaagagcuuuggccugaugcucacaagccaucgugaacucaccaauucugucauuuguuuuuguuuaauuuaauaaaaaauaaaauuacaaaugaucugauacuaaaaauauguaaguguuaauuuugugcggucaggguuuucaaggaugaauugcaauucaauuucaaauacaaaagugcuuuuauucuaaccagucuuuguugguauauucuccccuacagaaaccagugaagguguauccuugcaacugggaaacacaaaagauuuuauuauuucauuugaccucaaguucuugacaaauggaaguguguccgugguucuagagaccacagaaaagaaucagcucuucacuauacauuaugucucaaaugcucagcuaauugcuuuuaaagaaagagauauauacuauggcauugggcccagaacuucauggagcacaguuaccagggaccuggucacugaccucaggaaaggagugggucuuucaaacacaaaagcugucaagccaaccaaaauaaugcccaagaaggugguuagguugauugcaaaagguaagggauuccucgacaacauuaccaucucuaccacagcccacauggcugcauuuuuugcugcuagugauuggcuaguaaggaaccaggaugagaaagguggcuggccaauuauggugacccguaaguuaggggaaggguucaagucuuuagagccaggaugguauucugccauggcccaagggcaagccauuucuacauuagucagggccuaucuguuaacaaaagaccauauauuccucaauucagcuuuaagggcaacagccccuuauaaguuucuaucugagcagcauggaguuaaagcuguguuuaugaauaaacaugacugguaugaagaauauccaaccacaccuagcucuuuuguuuuaaauggcuuuauguauucuuuaauugggcuguaugacuuaaaagaaacugcaggggaaaaacucggaaaagaagcaagguccuuguaugagcguggcauggaaucucuuaaagccaugcugcccuuguaugacacuggcucaggaaccaucuaugaccuccgucacuucaugcuuggcaucgcuccuaaccuggcucgcugggacuaucauaccacccacaucaaucaguugcagcuacucaguaccauugaugaguccccagucuucaaagaauuugucaagagguggaaaagcuaccuuaaaggcagcagggcaaagcacaacuagagcucacaaccaaaacugcacuucagccucugcuguacacagaaacuacaggcucugucucaggagagcauaggcacauuuuaaaagguuauguacuagguuuuuguggauucuaucaaagugauaagugauccuuaaaaccagccuucuaaaauaauugcauuccauggguuggguauuuagaaauguagguggcauuuagaacacaauguuuaaucaaugggcugaacaaagaugcuucacuuugccuugcccaucacccuauacaguuucgcagauagucuagucacucuaugugagaaagauaaugguaaguaguugcuacuggccaacugucuagcacuuaccugaaaacuuaguauggagcucuuuuaaaaugugauuauuuauauuuauguugaaagcggacuuuaaaaaaaauaaugugcuguaacacaguaaauauguacuuguagccuggauagcagacuguguucaacuuuuuaaaaagauguuuccuuucuaaagauuaauuucuugggagcaaaugaguauuuguugcauuuguucaauuuguuguauauggugaauauuuaauuaugguuuucuugaaacguguaaauuaaaaacacaaucaguguucaggcuucaguuauauaauguaagcacaacuaaaaugaaacuuguugacugcacaagaaauuacaaaaauguuucuguuuugaaacuugaucuacaaucaguaaaaguuugauaaucaguauaucccuucccaacccccauugugacaguuucuuuuugucacugucuagaauuuuguauuuuauuucagacuauaccuuggaguuuuguauauuuugagagagauauuuuugggacauuauuuuggaaacuuauuacaaaucuaaauuuggaaaggagcuaguagcuuuaaggccaccaccauauuuuacuuuuuuaggauuuuucccccuuuaaauaaaaauauuagaucaaauacuauaugcaagaaaucauagcaaaguuuuuuuuuccuaccaagaucauucuugaucaucagcuucccaaacuaguaagucugugcaucauuggguguuuuuuuuuaauuuaauuuuaaauuaucccagcuauuagauagaagggauguuacugcacuuauguguaaucagaucuuuauuuagguauacauauccuccuauaccgcacauaaauagauuucagagcccccauacaaugggcagugucugcuauagggcuucaggcauuaaauaaaaccgaggguuguugauuuugcugugacaguacacuaaaucaauacuauaucuuauacaguuugaaaauaugauacccuacacuuucaggggaccgagucugacaaacacaauacauuuaucugugaccuauaucaaguacacauuuaggagccagguagguuaccugcuuacacacuauauuuuaauugaauucaaacuaucaagcacuacuuagaaacuggaaaacauauauauguuagcaucaaagggggcagaagcaaagaagauacagaucugcacugaagacauuagacuggccauagaaaaguaagcuugaacucccaauugaugugaccacacucuucuuaauuuuguucacaguaaaaacacuuuuuugaguuauuaggcuuaccccuagcuuuugaccuuugcauuucauauauguuagaugucucagcaagaauaucuggucuccccuaauuuuuauucccagugccgauguucaaaauaaacuuucuccagucugggaaccuuuuuuacuuccccauauuuguuauuauuuagaaugguucauacgucugcuuuguuugcauacuggucuucagauuaugagacucgaugauaacaguaugguacugcuucugugacaaauaucgugccuuaacaauguggcuguccuuuuccacugaagaaggaaagacguuuugaucuagaaauagcguugugauuuccuugcuguugguuuuacacugccuuccacauugcaacagcaaguugauuucuugugaucccagaauuuucuaagaggaugaguugaaucuauagcagcauugucaguacagaccagugguucucaaacuuuaaaaugccucagcaucacuugggagcuuauugaaaugcagaucccagagucaguaaaucugccugugaaguaugauagucugcauuuguaaugagcauucaagugauucugaugcaggugagcugggggcauacagggaggaacacugcccuggacuauccauugcauuuuugccucuaaacaacuacagaauuuucuaggguuuuaaauuauguaaaauguuuacuuauucugagcuuagagagaauggggaggguauuuuuaaauuuuauuguuuuauuucuuuaaguuuuucuuugcuuuaagauuauagguauuagguuuguuuuuguuuuuccacuuaucuugaguucacuuugauguuaaaucuauugcuacuucaguuguaaaaccagccaaaaguuucuggaugaaggucaaguuugaccuuuuaggaguuauuguacauaaaggcuucauccacgaaccauccagcgcacagaagcaagugcaaaaaugacacaagcacaacucuccagacguggcuccuucuccuuucucagugcagacucucacugaaagcugcuauuuucauccuccuugugguugcuuuucuuguuucucuuccauuguacauguggguuauauaccauauguuaaauaugcaauaaaguguuuacaggaugcccuucugaaggguaguccuuuguaaagcuguacagacuuugcaguuuaagcacaaugugcacauguuaguuuuauauacagcaaaacuugauuuuuugcagauggaaagguauuuuguuucuauacaaaguaaauggauuguuugugcuuaauguaaagccgcuuuauaaaacuguaaaauaaaguuuuuuucuuaaaaagaaua

SEQ ID NO: 16037 - RNA, 2756 nt, Homo sapiens
cggggcgugcggcgcgagccccgggaaacauggcugcucguccuauuucggcgucgcggcauggccaccagcucccggagcccaguugggagaggugccgaagguggguguguggggggcccaggggcagcgcggcggggaggggcgcagggggcgcgcuccgggagccauuugucuuaagaacguuuaaaaaaauacaguuccuccucccccaacccuuuugucccucuuucgcuagcuuucucccccucccccgcaaaugugcagaaagugcccccuccuccgccacccgcgccccaccccgccuccaggcagggggcaggcgugugggccgcgaggcugggaggcgagggggcgaagcgugagaaaucgcucccaguacggcgcggugcgcuccccuccccaacacacacacacacucguggaaguuuaaagagccgguucgacccgcuuuccugcuugcucccggggggccggcagcgucggucggguucgccaggccagccgcgcccccgcacccacccgcggcgaccccggccccgcgcuuggcgcccuucccccuccgcgcagggggcuuccggaaaguacgcgggaagaccgcggccccggcccccucccccaucaccacacccagcccccaaacgcuaggcgccgggucccggccgggacgaaagcggccggagagaggcaaaccgcccgcaaauagugcgcggaaacuccggccuccaccggcggcgcccccuccucucccgcggccgcccccuccccgcccugcgcgccauaaggcacucgcacgucuccaguccacagcugcguuaaggcggggaggggguagacaaaaaggaucuuguuuucaaaagucucacucagguuugggggaggaacuagggaaaagaggaagcgaggccugccuucgccgggauucggguuuaacgggcuagaggggcgacaggccagcgcacggugcugcccaaacucccaacuccauggagcucgggccaccgagacugggggcguccucccgccagcgcguccccgguccccccaaggggccaagaggggagcuggccagggucuccgccccagagccgccaacucgccgaaaacacucagguuugaaagcgagagggaggcagaaauaaaaaccagcguucgagucacccacccucaccuucccccuccucagggguaagcuuucgcucgagccucgcgauucccacccguguaaguuuccuccggccgugcucccgccgcugcccaaucaauaacggcggcuagcgggcaaacucccauccuagagcugcguguuugccaugcccgcauaaacguggacccagccaguacccaccacgggcgccagcuccgggcagcucgcguccugacaaaguuucccgugcccauuuauuaagcaggcgccgaauggcugccgacaagcccagcacugagaaagacgggccggggguucgagcuggggggcaccagggcccaaaggcuggcaucuuggggaagccggaaggagcuggggcgagggggcaccgggacguagccuuugggcaacuugcaccagcgaucgcuggaggcagggagacgcggggauuaucugugccuuagcacguucgaaaaucccucccccuccuucuaauuuauccucccuucggaaggaaaggaagaaacaucagcaucuggcccgaaggugggguggaaagagugagggagaaagaggaggagaggaagggaggcagagaaagggagggagggagagaaagggcgcguucacgaacacuacaaaguuacaaauauggcucccccgucucucgccucaucacugcaaagaaaugaagacgcacuuuaaacuccagccauucccaacuccgcugcagcccccuccccacgcgcucuccccgggggccucggcccacauuuaucagaaacuaaaccggacucgcgaagccccaaacuuauugugugugcgagcgagcgagcgagagaaagggaggggggaggcgcgggaggggggcggaaggggggauacauuuauaaaauguaaaacccccuuuuuuuguuguuaaauccaggaggcagccccucuccuccuccucccucguuaaucuuccccccagacggagucacgggagcagcgaucuccgagggugauuucgccucauucucuccgacccaaacgcgugcgcccgccggcccccgaugggugcacacucgcacgcacacucucgcacccacacucgcacacgcgggagcacacgcacagguagucacacaccaagggcagcggcggcggcagccggaacaugcucggauggcauugcaaccccccagccuugccaauucgcuugcaguccgacccccaaacccgcaccucccgggcgcccccccccaaaaaaagugccuccccccagcgcgcacacacacacacacacacaaaguaggagaauggaccgacagagauauuuuuggcaaaugcucacaucagagggcguccuguuccgcagcucuaaaugaauccgucugcccaucuccaucucucgcgcucucucucugcagaggcucccgcgccggcggaauucaaucaauaaaccccgaacccacggccgcgcguuuuaggacuuugaaggcucaaccagcuccgcucgguucucgagcccccagcacccgcggcgcacacuaaccugaucgccguggaggcgggaucugcggccccauggacgagcggcagcggcccgagccaaucgccgccgagg

SEQ ID NO: 16038 - RNA, 42062 nt, Homo sapiens
ccccaaaaaaauuguauaaaaagauuuauugaaauuuaucaaugacaaacagacauaaaacucaaaguuuggcucuucugaggggcaggagaaaaacuggugcagauguucuuuuauacagaugaaacauggguucagaaauuacacgucacuucuaaagcaaccagaagagggacacgaaagcaaaccuguacauucacuaggaauuugcagucauuucagauuuccacuagguaagaaaauacaauuuugcguuaguuuuuccgugcucggguguaugaaaaaaaaaacccagccgacaugcagcaacgucuccagcgcuuagguccguaaaaauguucuaagcacagaaguacauguggaagaauucucucaucauuuuuuguaaaacaaagcguucuaauauuuuacagaacaagauaggacaguuuuuuuuuucuuuuaaagaaguugaaguuugaagguguguuucuucuaauuuuaauuaccaaauccauuuuccuuguaacuuaacacaacaagccugcgguuuucagcucucuggcucauaagcucaagaguaacaucagaguccucuuuguagagcgaagcccaccaccaucugugaagggggaaaagggaugagagauggggaauguccccagaccagugccaaaauacgccuuuagguugcuauuuacaaaccagggcguuggaugccucuagcaggccugagaaaagcagguaucaucaugugaaccaaagcaaaagauauggcuggugcucagccccuccugggcauugaguaaccaaacugagaccagccacagccuuccaaccaacccaagagacuugggaaauaccaggaaacguaagagaacuccaaaccauccucuuugagagucaggaacaaaugcucacuuaguguguacuuagcuaucgcauuuacagggacaaaaaccggacacaaagaaaaaguaggggaaaaaaauaaagaguggcaguaaaaauaguauuuuauuccacccccacccgccaucccuccccccgcaacccccaguacacucuuccccucucguucccacagcaacguuacaaucagaaaaaaauaaguuucagggggcaggauuggaggggggggggagaggggauauggguaaaaacagucaaaucacaauaggaauuuuucaaaauagguuauuccacuuagucaucaucuucucccucaucuucagguucucguuuucgcuucugaccccuuucuucuucuggaaaaguaagaaagcggcauuuagauuaguuauuaaucccaccucuuuaacucaacccacccagugagaagucaggggacccaugacuagcaagcugugccauccuuggaaaccgaggcaagacaucugcacagcuggaaggggaaucugaggccucugacaggaguguccugcccacugccaggggccucugagucuaagcaaucuaaggccaaagugaaagggccaggcugcuaccagcugagaguaaaaaggcugccauaccaccaagcucuucuucaucuuccucgucaucuaccucuccaucguuauaaccuucuucauccuccuaggagaaaggacagacaccagaacauuagaaaugcccugccuugggacaugcugaggaagccacacagagcacaaaaaggccggggucacccccagccucucagagcccccaccaagacuugacaucucgggaggaauguaaagcagagguucuuaauuuauuucagaucaaggacucauugggaaaucugcagaaagcuuugaacuccuucuccagaaaauguccguaucauuuauaauauuugcaagcaguuucaggggguuauggauuccaggacccagguuaagaacucugaucugaagucccuguaaggcaggcagcucuccagucugcacauucucugaggagaacaaguucccgagcagacucccugacgugcaaaguaggccauccuuucuugcaucuguccucaaucuaguuuuggcuucaagagaagaccccaguuuaagcaaauccagauucugugggcaaguucaacgucaccugacccagccccuucccuagcuugcaaacuuggaccaccuggaaggguuggggaagauaaauucaagacccccugaggacaucauucccaaccggcuugagauucagcaagguguaugacuuucuuucucaacacagggcccuugcuuuccucugcuccugaaaguauaugcaaguugaaucucugcuuguuaaaccugguuccugaaguuuaaaagaacuuggugacagacuucuuuuuugucaagggaaacauucuuuuaaaaugucaccaaagaguucccucaucagucuguuugcuaagguucugguuuuuuuuugcauguauaagcucuccuuuacugaaagcuggaaauaugcagauggucagugagauuauuuaaaaaacaaaaaacaaaaaacaaaauccacaacccucccccauccccacccccccaaaccucacaugcagcacuccugugacaggaagaggaagauguaacagcuauuagccaauacaacuuacugcccuguucuaggggaaccuguuuuacuaagacuuuauuuuuaaaauacaauauucuuuagagaugagccuaagagucuagaccuagggagaaggcaaagccagcagcacaacuaaacagaaaccaagcucaucuggccagcuuuuuuuuuuuuuuuuaacugagucucgcucuauugcccaggcuggaaugcagcggugccaucucggcucacugcaaccucugccucccagguucaagcgauucgcgugccccagccuccuguguagcuggaauuauaggcauccaucaacaugccuggcuaauuuuuauauuuuuaguagagauggagucucgccauguugccuaggcuggucucgaucuccugaccucaagugauccgcccgccucggccucccaaagugcuaggauuacaggcgugagccaccgcgccuggccuccgcgauucuauugucauuggccugugucucucaagccugggccggcuggcuggaacuggaagacacuaucugagugaguccguguggcaagcggaugugucugcauccuccauugagggagacaggaaacugcggggggaguugggaggggacacaggcgccuuguccaugcuauugucacuuuaaaacucucuaguucuaacuuuugcaauuagcaagaguugauuuagaauucugagcaagucauagaaaaugacucugcuacagagagacucagaacacacaaacacaaaacccaacacagugccaggaaccuggaggagggugugaacgccuacaauaagcagucagacacuuaccccuugucagacacuguccuuaagcauuuuacuuacacuucacuuuauccucuuaacaacccugugagaaagcuaucaugaucccuauuuuacagaugaagaaauaggcucagaaaggucagguaaauugucuggggacacacagcuugcgagugguagagcugggacucacccccucacagaucuuguuaaaaaacugggaaccagccaaucucuuuaggaaaauggccaacuccuggugcucuauuuccauagugucacucucugauuugggauccagcaguguuauccugcuaccuaucaguucaaggcagacuuugguuuucccuagcacaguuuaagugcucaaugaauaucuuaauuagcauaugaaagcaaaaagcagaaaauggggccaugcauucuguacuucuucacauagaaacaacggccaggcuuaccccagcagguucagucccugccucuaaaauccucuuccccucuucuaauccagccuccccagagcuuacugcaagucuugucuccccagaaacagcccagugaaaggcucugaaauggacucacuucacuacccaucggggagcgacuuuccuaaccagggcuccggggcugccaagacugaucacagaggcagucagugggacugccucaaaggggcagacgguggcccugcccagcccagccuccuuaccuccuccucuccacucacguccuccucuucaccuuccuccuccucauccucguccuccucgucuuccacuaccugagcaucuucaucauacuccuccucugugcaaucgaaauggggaacggaaacagaacuaguggugagcuggcuccgccccccacacagcacaggccccuuguagcgucuucaguguggggcucaugacccucccacacccaccuaaguccaaagauggaacacacuaacucucaugaaaacagugcugacauaauuaaacacauccugaaguugugccaaagauaagccccccucacaaguguuaugcaugugaaaggccccuucuggaggccucucacaccgagaccaccaggaaauugucagagcacagcaacagguuccagggcccgggaaagcggcaagaucaaaucaaacuccucagguuaaaggugagagaucugaggcacagagagaacugacuuguucaaggucacgcaucgagucacuaguugagcugggccuaggggaccuggucccgggacugccaguuuuggcuccuuucugccauaucacaagauccccaccaaggcaaacauggucucugaguaucuugcaaaacacucccaauugaacaaagaaaaccaaaauccuguaucugaauuaauuaaucaggcaagugucuccauucucaacuuuaucuggccacgaagaugcaugggaaagcugcacugugcugguggcaagggagaaggggagggaacaggacucccuucuuuucccuccuuccuuccuguaggccucgacuacacaccacacugccagggaacccaacaaguggccugcaguccuccacuucugagcaccuggggcuccugagcaccugagccugugccccuagguguggggcuguaggcugcaaccaccagggggccccacaaccccucuagcucuggaccuccucuccacuacugaauaccuagaugggaaagagggguccucaggccacacacucuucucucucuauccccucccucccucccugggagagugucuaagugcgggucacacuacagaaagacuguagaaucccacucccugggggcuuuggaaaagggacaaaaauugaaguggggauucaguuggaugguuuuaaaggaguuauuaugcaguuggagaaucucaggauauuuccaugagcaugggacucaugcuuuguucuuuuagggaagucaaccaaugagacagauuagggacuauggaaaacaaagcagacagcccuacuccccuccauagcuuuggaaggugguagcuaccagacagacagccagccuucaguagcugggugggggccucccaacacccagcccacccaccucugcaaagccaaggacgagccccaaggccucagcugggccccugcagcccugggccgcacccugucacccaccauccucauccuccuccucaucauccaggcccuccacguagcccucagcauccgagucaggggccuccuugucgucccggucauagccgucgagauaugugaguugcgggaggagcuugaacacauuuucucgguagucguucagguugguuaccucgcaauugaaaaggucuaagcucuugagguuuucuaacuuuuucugcaagcggaaaaaugaagccaacaguaagugauuugugggaggaagguggaggaacagcccuagcaaacaggcaaggaugccaugagauagcaugcgcagaccaugacuuccaggugauaaggaagcuuggauuuggcucugcuuagccacaguguuugcccagacauaucaccugcaguuugugggccucggcgucuccaucuggaaaaugggggguuggacuggaggaucuuugaagccuuauccaauguuaacacuuuuauucugcaauuacagcuucugucuuaacagugauugacuugaaauuagccuggggcuuucuuggugcaugagccaagagguuuacugccucucccugagacuaaggagccagagggaaaccaaaagucaacuugaacuaacaaacuaacuccuucugcaucugauaaugaugaugauaagggcgguuaacauggcacuucauguacugagucacuuuaucucacaaccccuguaagguagaaauaauuauuaguuaauuucacauauguggaaauggagggcacaggauuugguaauucaucaggcagcccaacuucagaccugugcucuuacucuuugaauauugccugucaaaaaaggacaagagaaaaagcaauggaggaccccaauucuguccaugguauuugacacgaugugcucugucaaagcuuuacaccagacggguucuagccaauguuaucccuguuugaugguagaggaaacugaggcccaggaagugaagggucauacugcuugcaaguaacugagcuacauuuugacuucccaccucacccaccuuugaggcaccagguacaaaaaaaucccaucccaggcugaguccccauuccaaagguggccaggucuaacaagggagugaaaccauugcuccuuggagucaaugucgggagcuagguugcucucucuaugaccuugcaguugagaccugggucauucucagcagaagccaagggcagggaggaagucuugacaguggucugugugggcaagcccagcaccugcuaccaaaagcagcuucccgccccaggacgguaaggcaacacacacugacaagcaggggcggagaaagcacugagacacgugugaucugggcagggggcaguggagagugugaacaugaacgugccugagugccugaccccuaauggugacugaaucacaauguuuuacaaggauuuuauauacucaauccccauaccucacccauauacagaacuucaaagacuuuuuccuuuuguaaugacauuauaaaaucaagacuuccagacagaucaaaauaguuuggcuuuuuccuaggagaccagugaaaggccugaaaagaaguucugugggaagcacauucuacuaguuggccccaaugccaucgauggacagguaaagagcuuggaaaagaaaugccaguguccucuucugccacacuggccaccagcaagucccgugagcauccauggagagcaaggagugccuuuugggacagaaacccugaaaacuccagcccaaucugagggauacccaaccuccccuauaaacccagaagggaaauuuggcaaacguggccaauuguccuccuggccuuucccugauuuuaagaugccugaggugcugcugcugcugcuuuuuuuuuuuuuuuuuuuuuuuuggagacagagucucacucugucacccaggcuggagugcagugacgcgaucucagcucauugcaaccucugccuuccagguucaagagauucuccugccucggccucccgaguggcugggacuacaggcgugugccaccacgccgggcuaauuuuuguauuuuuaguacagauggggugucaccauguuggccaggcuggucucaaacucuugaccucaggugauccaccugccuugcccucucaaagugcugggauuaaaggugugagauaccacgcccggccuuaugaggugacucuuauauguauauucacaacagguguauuuacuucaugugguaguauuuccuauuccaaaagaguuguuuucagugacacaucuuacagcugauuuccuuaaaaucaaaggaauacagcgaaucagauccugguaauuauagaaaguguuguucugaacaugaccugccccuuucuggcugguaaaucagugaagcuuaggggaugucuaucucuacaaggaugagcagaggagccagaaaugcuacccaggccccugagagccuguucacuaucgcaacaaggacuggugaccaggggucacucuucuccacaccacguugaggaaggccugccugcacgaggcucucacaccacacggcucucagucauuccaggguucuaugucaggacugacucauuucucacaguucaggggccagcgacccaaggagaaaacuggaguccaccuccagggccaguuuaauucuuggauugcuccucccuucccaaaaaggggcaacaagccaugcccugaaccugaagacauuacagcucagguuuccaaagcugagcagaaacugaguggaaaagcaggagaccagaaauugaaacuaggguucuacgcuacccguacaauagcugcccauucugucugugaccuuggucaagguauuuaacuucucugggccucaguuucucuauggacucagcagaaacaauagcucaauucuaucucauagcacaucaugagagucaaaaaaauuaagugggaaaaggacaaaugcaaaaguaguauuugcugaugccaauuccucccaccuccuaccccugcagggaggggaggguccgaaugacuuaccaguggcucuauugugcugaggucuuuaauuuuguugccacuuaaauuuagaugcgugagguucggacacuuuucugccaauacuuccaggcccccugagacucuguuaucgcuuaguucaagcuaaauaaggcagggaaagaaaaagcagaaacagcuuuuaaaaugaaggcuaccggcucagagcugcccggcuuuccccagacgggcaagaagggaaagcagucucaggcaauugucuggcauguuggugcaagcacccggcuuucccuucaauuacucuuucuaaacauagguaauaacccuucccacuccccacccccgccucccagcacacacagacuccacucuauuuaccuucuuaaguuuguuuaacuuugguaaguuugcgauugaggugaggccuacguugauuguacuuaagaauuccaguucuucaaauucaucugugaggccuucgaguuugccuucauucgaccgacuguuguccaggacaaguucuuucaccugaaagaaggcccgaccgugugagcggggcugaggaauggggcugaagcagggggaggguguuagaggacuccucagagaacagggagacagacgcaggaagcagucagucacuccgucacuucuucuagcuuuccggaucacugugcugccaacgaccacaggauggauuugcccacccugacuuuucugccuuuucaacaucugggugagaggaggccuguggugagccgagcugcagaaccagggggccacuccagacaggggccuuggcuguaccgcagaagacaaacccaguaagcccugcugccucugcaagguugguggucucauuccaacccugcucucgcauucucccaaaacccacaugcaccagccacagcauuguuagggacuucugggccuugccccgccaccccaaugcccccacaagacccccacaugcccaguugcuuucacccacuccugccaucacagcagagccugccgcuguagcuggcauucacauggcaguacccauguggccuguccugaggcaggcgcagcagaccaggggcuccuccagcucucccaccucuagcccagcacuguccaacagaacuuccuucaaggacggaaacggucuguacuguucaagacaggggccacuagucacauguggccacggagugcggccagugagacuaaggaauagagcuuuuaauucuauuuaauuucaauuaauuuaaguguaaacagacacagguaacuacuauauuggauagcacagcucuagacuuugcucuucacgguccagcauagacguggaaggagaauggaaacccacaaacuuaggaugggcccauaaugaaaugcugagaucugucucaaagucugugcuuggaggcaccucuguggcccugucuuuuuccccacucagcucccuuacccacaauuuggguccuaaauccuuuauuucuaaugagguagaaagaacgaauaaaaagccacccucucacaggguuguuaagagguagacuuagcugaaggugaaacugcagguucuaaugaagaagguagaaagacaggccgaggaaaaguaaccaggucgcaggcaugaaaugacccugggaguaagcaaaggagacccgguguguggcccuccaggcagcuggcccagaguucuccuuccugccccagagcagccagcuucugggaaacccggccucucuggacuggaagacaccuuaaaugugaucccugcccacaccugguaucucaaagagucccuucagcccaggacacagcagcccaagcucccugcaggugccaggaaacacuuaccaaugucaacuggauuuguugccucccucccuggaacuuccaugcacaggcccugauuucucaccaaugggucacauggcacaagccuuccuucucaacagcaguccagcauuguucaaaggguugcuccugccccucagggccuuuucuucucuuggauaagcagccaggcuuucuaaccugucccuguccagggcugcuccugcuccuuugagcaggccaacaugccuagcuucuucuuucugggcccagaaugacuaggugccccucuuacucaggcaucucugggccaaguagagauaugggggaaaggagguggaaacagaguccacaugaggccugcuaugccccuccucagcccccucuugccagugggcagagcaggggagcacugggguacacaucuggaucucagaguccugcagggcccugcaacugcccugccuucauucuucacugguggguggaggcaugccacuccgcccgggacagcagcaauuuguggguuucaucuagcacagcccacagagcaggagaaccagggagcgcagcccucuccuggagcuaaggagcucucagccuaggaaauggucaccaaagcccaccuuccuguugggucugggagggggaggcucaguccuuucccacccccucagucccugagauccagauguccaggucaagccaccuucucaaggucauggcaagagugccugggaauaaauccugugaggccuucugcccuagggcaggaaagcaucgcagagccaggaagccaggccuuagggggccagugcagauggagggagaguaacuguguugggggaggggagccaucuccuucguuugcaguaaacacuggagucacguggcccacagucuucuuuaguaauugguuuccuuggaaggccugggaauucuugaagcuccaccaaagcaaggcaaauaugagaagagauuccagucuacccucaaagacugcagacaugcgguuuuucuagacgggucaauggcuucuccuuacugccguuggccgaggagaggagggccucagagagcagugcuggggagcccagggaauucguccaggaagucggucuccuuccuggagaggaacagugcugccugccaccccugcccacagcccaaggggcugcugcugggguaggcugccuaggaaugcuacagauagacauagguuucggagcccugacgaggccagucccuggcuccuaccacaacaccaaaacugguggcugcuccucuggaggacaauacucaagcaaucacuauuaaugcuuugauuaaaaauaaucgucauaucuuucucaagcacucgcuaggcacacucuaggugcuucauacacagucucguuuaauccccauaaccacuccuugggguguguucucuccguuuuaaaggcacguccgaacugcuuauccuaaaaucccaaaagaaggucacaggagggugggugucuacugcacucagguggcuaguguuagccacaagaugaggaggggccccuguuggcuucuugggacucuccccagacccccaagucaauucuacaaguucuuggcugugcuggggcucagaacacaauacccaaauguaaggggcuuuggcgugcuggguacuuugaacuaaaggagauuggaaggccucagaagcaagcucugugaauuucucuugcccuccugucucucacccucucuccccagaagucacagaauccagaacuucucuuccccaaggcgggucacagaaacuagaauuccucucucccaaagcaaagccgagaaagguuacucucuccugucccuucucccuugaagacccucaugccagggaaguccugccccauaucuaggaggaaggaaugcuacacagagaggccacaaagaaucugaacagacaggccuugcuggguucccucucagccuacaccccuuuguccagucccauuucuucauggcugucuauucuucaucaaaccuaaguauaaaaauaggcaguuucccugggucuuugguucuucuucucugaagguucucaugucacuuacaacuuugauuaaauaaauuuguuacgcucuucuuuuguuagccuuucuuuuguuauaaguguuggccaugacucuuacgacggguaaggaaagggaucacaccuucccgccccuacagcuguaacuguuucuuuucagcuccucuucuaacuguuccaccagccaggugggcaccaccccuagaggucucugcucugguuacacauccuuagcaaccaaagcacagagccuaacccugcccuggcucagaugacgcugcaggagggggcaaggauacagagaggggccugggacccugcucuuccccaaauagcaagagguugcuuccacucccuugggaaauccccaucguuuuaaagguggugucuucagaauccccacuguuucugcauuuccucccugguugguuucagcaccaugcagggugagaucacagaggggaaggaggggacagggcuuagaccugagguugcugauaccaccaaaaagcccaaaccacaugggggaaagacccacugcuuugucaugagaugaagaggggucccagugagagcagcaggugagcugugaaguaucugaaaugcaccaaacaggacaaaacaaaaaugucagcccaacagcugccugugaaagacaucccauucccuucccugccugccuccaugagggccacacuuuccuagugcucuaguuucaaagccuagacccaccccugaacucuugcuacaauaccaacccauuuccucuguacuugguucuaacccuuccaugcaaagagaacaucccuuuuccacccaggguguguucugcuuuaaaaagaaaaaaaaaaaaccaaggcccacuuccccugccaaguccugggugugagugaagcgcaaaguuaaaauuaaacugaaaauuuguacuuuuguagacuuuuucccaauuccacugaccauuuaaaaauauccaaaugugguuacccuaccuaguggaacugaaauuacucugcuuguaucagaagcuuuuccaacaccccaaagagaaaccuacacaggacccaaugcuucauuccucaagugaacaccuaaaaggagcccucauauucauaagagaggucagugaggaggcaaugaagguucccaagaugucagauugcuggggguccuguacuuccugaaaaacuuguccccaaagcaaagaccugucagucauuuuucaccaaugggaccugaaaauuccaugauaaacacaaauacguuauuacucuaaggaacaauuuguuguuuaaaacugaaaucuugucuuuacagaucucucaaauuuggccuuuccccucuguucccaacguugcagcacuggucacugucaccucgagucacuucaagccugcuuuugccuccacaccaggucucuaugacugugaggauggaaguggucaagaggcagccuggauuacugggaacaggccucgaccuagagggcucgacccaacuggcuccaugaucucagcucucucccccaggccucaggcuucugccucuguagaaaggggaugaugagaucuguuuaaccuauaaagaguaaacuccagccuggaaaacauuccuggcuucucacugccuugggaaaaauucaaguuccuacacaugaccuccaagguucuccauucuuggagcucccuccucuuuauccaaccucagcacccccaaucucucacucuuacccuacaaauccaguuccccuucccaggaagccuucuccaacccagcucugugcauccuggggcaccaagggcagcugcugcaugaaucauuuacucguguauuaagcauccgauccuccuagaggucagggacuguccuccguaaucagccuaccagggagcggagaccagagcaacugcuuaacaaauguccuguuuauugcgccagguauaacauuaggugcugggaauauagaggugagucaaacugucaugaaacguauucaacaguaugacgaauaaauguugaaugaacccuaucuuuuauaaacaccagugguuuuuuggagucuuucuugugcccaagacaagcauaagccccugagaggcaggucagcugugcacacucccccugaccugaaugacccagugcucugcaugcaggucuccagcccucuccacauggggcacaccugcgacacuguuggcugaggagacacggaagaaacaguaagccaaggucgggguccuugccagcaagaggugugguggccggcugggaggagacagccaccaguaaacaacuccaguccagugugccagguagcaggacuggggccgggccagggugcauucuucaaaugccucuaccagauagaacaggcaugcuaaaggcagaugagggggacccagaaggaccaacggaggagauacacuauaucaaaagccaggacuggcuuagagggcccagcauaaaaugaaaaacacggagccccuugcuuaaaaauuaagaauuccaagacagugacagcagcgcauuaaaccaagugcgugcugcacgggucacaugccugugaagcuggcccugauuaaaguggacaguuugggccugaaacagagcccuuugaaggacaggaccagagagaaggaagcuuagaguaagaacugcuccuucuuuuucuaguacuuccugaggcaacaaggaaagguggacagaaggcaggcucucgaguccgagagaacuggcucaaguucaauuuuucuucuuuuuagcccagcuuaccuuucugagcuuccguuuccuuuagugacuauaauguccaucaccuaggguuggauuaaauaagaauguacuuggagcauccccagcuuggaaaaagccacuugccuuccccuuuuuccauggcuaucuuuacuguugcguacagucaaggcacaagaauggaaacgaagggcagguuagcagauuugagucaacuaagcugucuguacggcuuccuuauaguaaauacgaggccucuuaaccuguuggggaaccaggaauggugugcuuaaaaccgaccccuuuggauuuuuacauccacaccuuguuuuguuuuucacacuaacccugaccacccuugauuuucuuuuccuucacggagcaagaauucaauacauauuuguagcuuugguuucaaccuugucagucccugacuaauuugguuuucagguuccagucuuugcacacaagagaagacucauaucaaauugacccuguguuuuuuggugcucguggguuuuaaauaggucagcuuuuaaaugggccauccccuguugcagaucccauuucagcuagaaggccaaacugucugagacaccaagguuuuagacuggggugauagaugcuugugauuuuguuguuuuaaccauaaaaucgaugguuuugcugaacagccaguguggcaaaaccugcagaaaucagucagguuccauguuggggaaaagugaaagcucugacagaaaaguuagacauuuugaaagcuagaagggccuuagggaucuccuaggccaguggcuuucuacauuuuacaccguggcucaguacacacguuuuuguguguguauaggcauacacaacugaaaacaaaacuuaacacuugcaauuacuuucuuauguuacuuagaacaaaauauguguaacgugaccuacagucugcaaaacucugguguaggucaguucucuuuuuucagaggaagaagcaagguccaaaguuggggccagagucacugugagcugggcgauucguuucccugcagcacacaccaccaccaggcaucagaacucacauccccaguggaagaccauggaauuaacagaucacucguguagcuuucaaguuucugcuaacaggaggcuauucugcagccucaacaguaguagacccagaucuccacaccucuagaagaucuuuuaaaaccuuaacuaggggcagaguccccuauuacuuuaaaacaaacaaaaaaucuccccaagaaaaaagcauccacgucucugauuuuuuuuguuguuuguuuccuacaauagagcucugaaggcaggcggggagcacauggcccggggaagucggugacgccauccuuauuauuuuagggagccaaggaacacaagcugaggcgcgcugcagcgguaauuaagcugucugccagggccccggcucauaggcuaagccgccggcgcggggagggcccgcauuaacauaaacccugugacuugcuccugcaccgccuggaaccggcuuccucugucuccucccgcgggugugagagggacuuggguuucugcuucaccaaagcagaggagcugguuccaccgcagauguuccuccagccagaaacacagacucagggcaguacuccgcaggcugggguggcugcaggaccugaguuuugggcuugccaaaugggccuguuuagcuggugaauccuagcugggccccucccugauauuguuccuuugcuuccucccccuuaaaccuccuuccuaccuuccagcugguauagacuccacaucaaggaccugucaguucuaccucccgcaggaagccuucccugacugcccagccucuagcccaggccugucugguuuaagagcguguauagcucuuaaaaguguucacagaggagcaggaacuguuuuggggucugaagaagggaaggagggguuuugggucuagcuuugcugggggaugggagcugcaguguggaaaaggggagaugaagguuuuagaacuggcaggguacacgacccagugaaaaucuuacagacucaacucuuuuuauuuugagacaguuucguucuugucaccuaagcuggcgugcaguggcgugaucucggcucacugcaaccucugccacccagauucaagcgauucucuugccucagcuucucaaguagcuggaauuacaggcgcccaccaccacgucuggcugauuuuguauuuucaggagagacaggguuucaccauguuggucaggcuggucuucaacuccugaccucaugugauccaccugccuccgccucccaaagugcugggauuacaggcgcccaccaucacaccuggcuaauuuuguauguucaguagagacgggguuucaccauguuggccaggcuggucuugaacuccugaccucaugugauccaccugucuccaccucccaaaguguugggauuacaggcaugagccaccacacccagccgcagacucgacucuuucuacaugguuguuccccuccuaccuucaguggaugcuggaagacugaagagguaggugcuggaggacugaagagguaggcacuggaagcagagucccagcagguggugugugaacaguaaccagggaagagaaggaaaaggggccaagaugcaccaagguguagugcacagaaugcuugucaggcacucugaugaccugggcuuugguccgccuugccgcuaacuugcugugugaccuucgggaagucacuaccacucucugggcuucuccuaguccucuaguccauacacuggacaauagagccugagugcagaaauaaggucccucuaguuucaaaauucucucgguacauacacuuugagccugagugcccaccccacauucaaacucagucacuguuccggaaagaacguggccaauuucaugggucaaggggcccaggauucaucacugagggaugccaggaaggaaaucugggacauggggcaguuacccuggguaauaagugaaaugggaaacucaaucaucuaaucucuuaaaacauaucagcacccccaaaauaaguacaacuauaucaauuuguaaaauuaauuacaacaaguuuuuaaaaaccacacaucaggauauaaaaacaccccccagaggccccgggugcuggguucugaaugugggaguccagcauugucccaucugaugucuauccucucacaggucauugaguggccuccaagaugccuggggugggaggagaggagagaccaggaucacccaucacuacucagauccaugagcugacaauucagugauucaaaacacaaaccacagccguucuuggugaucuuauuacagaaccacagcacugcacccaugcaacagaaaagccacagagaaugaagaccaaggccuagagagcaaagaggguaaauccugcucaaucuuccuaaaacgcugcuuugaucacaucacaucaugucucauuacuccccuguccaaaagcuuuuaauggccacagggaucaagugcaaauccagaguacgauucccagacccccacccaucagugcucccuggcaaaaccccugugcuuccucccaucucagcccucugcuagccucccugaugugcagcaaaaauaaugacaucacuuggcauugcauguuacgguuuacaaagugcuucuccccucauagacaauggaaauuuuaccccuucugucccucccaggcaaccugccccuguccaccagggcccugaaugcugcugaaggccagucauucuuccuccuaucucucccccaacacagccuugcuaaggucugaggucucagugucacccuagugcccuccccagaggggcuggcuuucaguaaaugcuugcugaauggccaaacaggcuaggggaggggugggguguggguggggaauggcucuggagaauaaucuagauuacagaaggcuaacccuuuauucacuuucugaggcaaagcuccccacuaaaaccacucuuagaaaaaucaacugucccagcugacagauacgguuaauucuggcugcugaaaucagauugggagauugaagcccagcuuggcugggaccgcuuguggacugcgggagcugucugcuuaggaaaucccacuggagucuucagggagcagcccaggguuucugccuuggaguccgggauggaccccgaguggaggaacugucagcaaaauagaaguuaauucauuucuccaguguuacuauucagagacccaggagcuggcaauucaaaguuucugccuauuccagcccccagcauaacccaucuaagaaaacaugccaaucagacucagaggccaggacgcaucccacagccgugguguaagcgucugccccauuuucagauagcuuuuaaaaaaugcuucaaagaacuaaaggaccccaucaaugccacuuuuggggaacuacuguaucuaauccaacuucccuagcaauugaugaagcuggguggaaacuaacucugugacucacccaaggcuacacaguuaccccacuguagaaucgaaccuuaggccauucucucaagacuccaaacuuagggcccacacccucaaagucacaggacucuccauccuccuugaagcaagaggaaagaaagguggaaaauaaaauuagcuguuaggaagagcccagaccugagcucagccccugcucuccccaccaccaccuuccacacauccaugcagagcugcaaguggagaagaggcagggaaagcuaaauggccucacagaagaaaccucgaccuuggccuccuucccugccaccucuaugcaaaaugacagcagcaucagcaaugacagaagcagagcaaacgccgccucggcacugaagcccuguuguccaaccaccaaugggaaaucgcugauuugggcagaaaugggaaccaaucaugcagaagaaccuaaggcuggggcugaaaguuuuuucuauccaaggccacaaaacaaauuagccaggggcuacacauaagaagcaauuuaacauuaguuauuucucccuuagacaagugugaaaugugcagcuuccuuaaaucugugaauuacacauguauggcaaaaauuauuagugaaggaagugcaagaaaugcuagcaguauauguuaacuccauauuucuaauuggaaggaggauuaauaaaagaaauggaaugagggaaagcaaggaaacuauggggaacugaggggcugcuggaaggaaggggagagggagagacagacacagacagagaaagacacgaugagggaagaaaggaguuggaggcuuggcagguauugcugaacuuccagaguuccauccucuucaucuggguuuggugguagaaccuuaccuacacuuguuguuuuuuaaaaagagugcagguugaguucauuguuguucacaagucuauggcugcuuuaaucucaaaaugcuaaaaaacaaaaacaaaccccaaaccaaaaaacuaugaagagagucagggaggguccacaugacucgagacaauguaaaaaggaacuuaaugauuuuagucuucaucagaggcucaugaaggaggcuucuaccauggcagccaacacagaugagccaucgaaggcugugcugauaggaacacgugggauggaccagggcuccuuggucagggucccaaaacacucugcacugacaggacuagaccugaaauuccaaaauuuaaagaacaaauuugaggaaggcaaccaggguaggaaggcaucugaaaacugggauacuagaagaacaauugaaggaacuagugauguuuaggcuugaggguaggggagaccaugaucacuaucucucuccacuuauuugaaggaaugucauguacguuuauuguguuuuccagugguucaagaacuaagaucagagugcaggaaucauaaagagacagcuuucuccccaguguacuuuguaagaaggucucuagaucauuauggcugucucacaaaauaaugggcugcucugaaaacuugggagcuuccugucccuguaugaaucacaaggcuguuaagugaccgugggcaaagagcuucauacauaaagagugcuggaugcuuauuagaugaauuaauaauauuguaugauaaagcccugcaaagagagcucugagucuuuuccccucuuaaaaugcuaugauuugauucuuucuucuuaagcauuacuugcuuuaggaugcaggcccgauacaaucauucaacaguccguacagaguauuuacuacaugccaugccagguacuaugcuagguguuaaagauaccgugguaaacaaaacuaggugccugucucacagaucuacauucuagcaggggagccaaagaauaaaccaauaaauguauacacauguauauaauguguaugaaugcugcaaagaaaaaaaaaaaaggacagaaaggcaccgggcgcgguggcucacgccuguaaucccagcacuuugggaggccgaggcuggcggaucaugaggucaggagaucaagaccauucuggcuaacacggugaaaccccgacucuacuaaaaauacaaaaaauuagccaggugugguggcgggcaccuguagucccagcuacuccggaggcugaggcaggagaauggcgugaaccagggaggcggagcuugcagugagccgagaucccgccacugcgcuccagccugggcgacacagcgagacuccgucucaaaaaaaaaaaaaagaaagaaaagaaaaggacagaaaagcaauagugacaagggacacuacuuuagagaggguaaccaggaaggccuauccaaagugagcuuucagcagagacguaaggccaagucaacaacuaggagggccuuccagacagaaagaaggaaaagccagggcaaagauccugaguggguggcaugcuuggccuuauuggggaacagcuaggaagccagguggguacgagagaauuuguggaagggaagaaaggagguggcagcaugagauugggguggagagaaggcugcuguagguuacacaccuuuacccacaggggacauuccacaugcaacuggugguaggauaguggguuucacaggcaaugcaagaagaauugcuuagaccacaggaaaguaguuaagaccugagaucuggccauaagccuaagaguuaccuugcucugccuuaaaggaagaagaagaagaaaaaaaaaaaaaaaagcaaaggaaaaaagugaaggagaagaagcuuuaaucaggauugugcuugccccauguuuccagguagaaaugggccuaaucuacaccccggacaucuccuaugggagaauguuuugauuauggggguuuggacacaugagaaguagucggaagaucugguuugguuucaggcuuuacugcuuacaaacuguguggcuuuggacaagacuucacugagauucaguuucuucaccuguaaaaugggacgagucccuaccaaucccaccugucuccaugggacccaaugagaucauggguaagccaggcuguccuagagguuacuaugauaaauuuuauaagcauguuucuuacccaagacuuugcaccccagaaagcagaggugagguauuaugcaacugauucccccacacugccuugcacuuagcuuucaauaaauguuugcagaacugaaaagcauuaaaaauaacccggaaaauguucugccauuuuuuuccuuccuauuaaacuguagcacuuugccagaaugcuccagaacagucucucuucacuguaauccuucacuuuggaggaagaaccaacugagucacaccagaggugugugcucagaggauaaacucugaggaauggggacaggaacaaggccugacuccucuggggaaggcuccuugcucucugugcccccaaccuuucucaaacauccugagagggccaggccaggcuaccaacggaagggacugcagauuacccuagcacaaggucaggaucuccuggaaaaguccaugaaagccugagaaauacaauauucacaacauuccacuucagacuaaggagucucaaucugguccaacugccucaccauacggauagggaggcuaacacacaggucaguggacucgcugguucaaggucaccucuuuuuuuuucuccuuuucaauuuuuugacuaacacauucauucucaugguuuuaaaaccaaaauauauaagauauacaguuaacucucccuccuaucuuauccucugucugcccagucaacuauaccaccugcuaagcaucucucuagaauguucacacacauacaagcaaauucagaaucuuauuucuucucucuuuuauuaaaaaccuagcauauuauacuaaucauugccuugccuuuuuuucauggaguuuguguaagaguacauaaaaacccucuucguuucuucuuugcaacuacauagugugucaucauuuuucuuaaccagucucuuauugaugaguaucuggguugcuuccaaucuuuuguguaauaaauaauuuugcaauaucaauaagcuugggcaugucaguuugcauucaccuagcuuacggauaagagcuggaaucagaucccauuucugaccuacaggguggcagucauacagccucagaguccuauuaucuuauuuauuuauuugagacggaauuuuguucuucucgcccaggcuggcgggcagugacgccaucucggcucagcgcaacuuccaccucccagguucaagugauucuccugccucagccucccaaguagcugggauuacagguaugugccaucaugcccggcuaauuuuuuauauuuuugguagagacgggguuucaccauguuggucaggcuggucucgaacuccugaccucaggugauccacccaccuuggccucccaaagugcugggauuacagacgugagccauugugcccagcccagaguccuacuaucuaaugucuaaguuacuuaaccuccauucauucaauacacgcuccucagaacuacuaaaucccaggcacuacaccaggugcugaggguacaaugauaaaggugucuuugacuucugcucccaaaguguccagccuggaagggacaaacagaagggaacauuccgacacacaagggccgcucagugugccccggaagccaucugaccuuuguaggccaaucucugucaggaaauggguggccuuaccuacaccucagggguguuuuaaaagguaaaaaagauaaugcuugccaaguaccuagcaagcaaggaccacacaaagcucauggcagauacucaauaagggguaagccuccucuugucccagaaugggucuuagugauggcagcagcaagguguuccaggcaaaggcacugcauugccaugccuguuccacaaugagcaauucucuuuucuuagaggagucuggaauacacugcuacuuauuuuuuaaagcagcaccuaagccccuaauuaugucuuagccuacuuuuauuggaaagccauuugccucucucccacauuccagacccucuucaauaucucugaggcaccuggguaugcuucucaccugcgugcacaagcccugguguuugauggagugucagagccacagaggaaacccacacacauuucuuaagacccuggcacagaaaggcacaggcaggcacauggaaagucgcuuuuacuaggauaccccugaaaguauuaaauaauaaauagaaaaaaaauaggacaaaaaucauuaaaucucacacauauuguuugguuuuaugugcucuauuucacaaacuuuuuuuuuuuuuuuuuuuuuugagacggagucuugcucuguugccaggcuggagugcaguggcacaaucucggcucacuacaaccuccgccucccagguucaagggauucuccugccucagccuccugaguagcugggauuacaggcgugcaccaccaagcccaguuaauuuuuguauuuuuaguagacaugggguuucacuguguuggccaggauggucuugaucuccugacuucaugauccacccaccucggccucccaaaguccugggauuacaggcaugagccacugcgcccggcccacaauaaaacauuuuuaaaaaucagaacuuuuggcauaaucuauuucgcuuucccaggaaaagaaauguagcagauuuuauaacagagaagagaaaguaaagucaagucaagagucuaagguauuuccauauuaucaucaaaguugccgggagaagguugggggucaaagcuaagauuccagguuggaugaccugguuuuguauccaagcacagcuccucaguacuaccugaccuuagguugguuacuuaaccuuucugagccuugguucccucauuggcagagugagcauaauuccauucauccagcagcauuucuguauagauuaaagaauaaauauggugccuggcacauuggcaugaacaaacaguuaaaaacaaacaaaacacauuuuuaaaaagauauuacuuuuucuauuuaguacaaaaaugaaaaucuagugucuucccuuguuuucugagucucgcucuguggccaggcuggaguguaguggcacaaucucgguucacugcaaccucugauucuccugccucagccuccugaguagcugggauuacaggcgcccaccaccacgcccaauuaauuuuuguauuuuuguagagaugggguuucaccauguuggccaggauggucucgaucuccuggccucgugauccaccugccucgaccucccaacgugcugagauuguaggcgugagccgcugcacgcggcugugucugccuuugagaagcuucaagaaaaacagugggcaugaaauuauccagcccucauaauacugggaaacuauuuuccuaacaggcuaauuaauaaagucuuacuucagccagaagcuccuuucaaauugauguaggauuccugcuuuuagaugaaauuauuggccaauuauagcucagucugguccuugggagagguggggucugcugcuguauuugugaccucugauuuaacugugggcuucucucucccuaaaauaaacccugggggcccugugaguccugccucaccaucucuggucagaggcaucaguagggucucuccagcccccauucaaaagcaucuaacccccuaaaccagguccagauggaauccagaaaguacaaauggggguccuccaggaaacacugcuauuucagaaacaccaauggaaauuccacucugacagugacggcagcuggugguacaaaauugggcggugucuccgccuaggcaggaaaaacaccagcuccaggcagucagccguugccuuaccuggagggcugaucaaccgucacaaauguguuuaaaauuucuacccccuccccacacccagccaugagaaaauaaauguauuauuguuaauaaaugcaauuuggaagucuaaaucuuucaaagggcugagucuugaagauaauaaaacacauucugggaugaaaaggcagagggcuggagcccaaggcuggugugagcagagcaguggccggcuauuauacuuguccuucuuggguuuaauuucaucuuucccaugaaucaucccaugaauucacaccuuaagcucacugggccuuagcuuguuuauugggaagaggacuucuagagguacuucuagaucagauauccuaaguuccagcucauggggucagaaguccaguguaaggcacuugagugcucaaaugccaccuccucagagaggccuuccuggaccacccaucuccuuuaacgcagccuuaugggucuucauggcacucaucacaccagcagccaugccuuugcuugaaggcuuacuacugacugucucccccagcggaacagaagccccacaagagcagcauaggugaugugucugucuaguuccuagaacagaacccaguacagagucggcauucaucaauguguguggaaugaaugaaugaaugauuagccaagccaagggucaaccagaaagacagggauuccaaucuuacaccuucauuugcuaucugggcaccucuggguaagccacauaaccccuccacaguauuguguauuugcagaaaccacccccauaacucugguuaacaucagacaguaguggccaagugcugcucaccaucagggacauuuguggcaguaauaagccuccuggggcuaauaagccauuggucgauacaagucugguuucugguacagugggugccucucagaccaagaugcacaucuugcuggagucuauggccacuggucaaucucagaggcacauucucacucccauauccaacccugccacuccugaugaugaacaccggccgcugaaacugaaggaagacuccugagugccuacacaugccaacugccugcccugaaugaaguacccuucuggcuuuaagagggcagucagcguuccauuuccgcucccacuacucccaccccaaagagcaacccuggagggcucuccucuagaagccuucccagacucacagaccacaccuaaaugcaaagacacaccaguacuuuuaaccaagacacagaaaggcaugucugcaacagagccauaaacuagacaagggcuaaaaagaacagaacugcucauuauggcuucaggccaaccucugcagauaggcuucaucaggccuaccagagacagcugaaagcuucacaaaguacaggccugcccagucuucagagaccacaaccaggguacacccaaaucuucauggggaaaggaagacgugcagaaguggaaggaacgccuggguggcugugaaggccaguuucugacccuccauauggaacagcccccugugccagaacagacaggcuacucccacuggcagccaggcaagaggcuggagaaccacaucugccaucgucacagagcucuucuauguccccagcugcaggagagucacacugggcucuguacaccgucaaugcugcccucuggcaggggguauggacauauaaaggagcacugaccagacagagagaaagccacagaugcacaccuaagugagugcuauuggacuuggcugagaggcgaacgcugcugcgugcccuggaaguccccaggacuuuuaccuuuaugucaccuagguggacacaguuugcucccuuucuuccagugaguugaggagggcuucccagaaaaggggaccucucaggagcuguaugaaugaaagauaaaggacugggagaggcuggcccagacuucugcagccagaggggaguuuaaaggcaagaaggcuagggucacggagcaacugcuaugggaaaggugagccagcgcgacagcccccaccccagaagaggcccggggcaaggggaugccugcagcuuggcugguauuccucccgccccaccuccacagaaaacgggggggggggagucucuccuuugcccagagccucccugccccuccccuccgcuucacagcuccaggcgaggccuccuccuggggcaggccgagacagcucuucucagacuugcucccaccccagcaagcaccuucuggagaggggcugacuccaccccacccccaccgcugaccaaacagcucauucaagcccugacggguagaaucuaaccuucaggguccgucuacaacccauaccuggcauaaacgauauuucuuuccgugcuaacaacaagcucugggaagcagguuauucaccguuucacagauguggcaacugaggcucagugaggugaccugccaacauccucaggcucagcaguucucaagcacuacugcccacuguaccugacugccugggucugcgccugggcccccgcccuuuuacaaaagguccacggccucucaagagcuggacaugaaggaugggccaaguccagucuugaucgguaaugcccacuugacacucccaggagcagcauccugagauacacguaaaugaaaaauuccaagugugaugagcagaacgugguugugugaacaaucccauggugguggggauguggggggcaggucaaggagcggaucccugaaccccagcagauuaaauccugcauccuucuuuccuauuuccugguuucucugcuccauuuuccucuaguuuccacuuaguuacuucuuccuaccugcugugaagcucugcacccugcuccauggggugguucccaacugugcuuuagaguccccuuuagagcuuucuaaaaauacacggacuggggcaccacccucagagacugauucaguucaggcagagccuggguauugcuucagaugcuccccuggcaguucugauccacagcugggguugaaaucggcuuuacuaaccacacaccuucuucccugcaguguaugugcuaugcuccaucacuccagcuccaccacaggagccaggcaccaccauccacuauaaccacucucuucucuccuacccagcccaggaugcaaggacuggauucaagaaauuaaauuugcuacaaaaauacuuacauagcauuuauacaacuccuugucucauucccgaugcugggcacacaggccauaucaguggacuccccucacccguccauucaguuacaccacuuaggccugcccaugaagccaauggcuaaggugacaguugguuacauaaauugaagaugagucccuccuccagaugcauggucccugaagaaaucugaaaguaauuccucuaaauugagaaugacaggcccuugccuccacccuaucacccccugcacacgcacaugcauacacacguaguucucacgaauucuacaggaggcagcagaauccagaaacccagcacugggcacugcuggcugcagaguuccagcacaacuuugcugaaaucucucagcaaacacacucugcgggccucucucuuucaagcuucacugugcaccucugucucugcccuuccagcccacacauccugccucuuacuuguuccccacuccaagauaacuaggagaaagccaccuucccacccacccugagucuauggcugauggaauccuuaucguagcuacuuccuggccucucaggacaugggcagagagaacccggggguuuaccucugugggaccccaggggugacuggaggggacuuugguggaucuguccacacagccuaaacaaagagcaccaagcugacacacggcaguggagccuugauucaccaaggaucucgggcaagcuagcuuauuguauuaaagggagacugugaauguccccuaccccuacucaucacacacuagagcuggagagaucuuaacaagcagugucuaggaagguaugagcguuucuuuuacagagugaacuuuaguaacugaauuuaaaauaaaacgagcaauuaauuagaacaguagucucuuauguggacugcccaagccaauccacugggaugcaagaauuucaggacuuuuuagauguuuaaauguauccuuuuuaauuuauauuuuuggcguuacauuuuauaauguccauauuuauagguaguguaugugaauaauccauaacugcaagguagacauacuggggcucagguucaaauuguuuacugauaagggaugugauaaugagaaaaacaugaugaccagcgaccuaagaagugugcaucacccacccagagcaacuccaucagaaagucacaccagcgggcgugggggugcgggugugaaggugugcgcuucguuucaguggcuucgugcuugauguaccaaccgguaggugaugaaagugacaagaagguauaaguaccacagauccuucacuccaucaguacuucuagaaugcuuaccaugugccaggcacaguguggagcucugaagaccacaaugaugagcaaaagcaagucccucaaaucgugcagugcacccauuaggcaaggggacagagaugcuaauuaaacacucauaaucuggaauauguaguuacaaacugaagcacucugagggaaaaguucuguaagaguuuucuggcaaaagaacuagaucuaaaccugacggaggaggcuggagaugguaaagaugacuagaugcuaacuggauacaguggcaaucucaguguggcacagguuugcaggaaugagaggcagccagggaggcccagagagaguggggcaagggaacagaugacgggaaguggccagaccaugcagcaccuuguuggucuuauuaaagauuugggacuuuauccuaggaacaauggugaauuuuaaguauggggugacauuacauguguguuuugauaagaucauucuaguugaaggucacagcauggcuucaagaagacuagacuaugauacagggagaucaguggcaagcaacagagcauguuuuaaacagacaagacuugugaugaugauggauggaaagaggaucaugagugugugugugugggcaguggugggcaagggacagaggacauggguucccuuuggacuuaagaguagggcacuuuuggagcacccagguggagacaucaggugggucucaagcuuacucaagcaguaaacuucaaaccucagagagcagcacgcaguaccugcagcugucagugaggaaggacaaauuuccaacuggagagaauacaggauaagaaugcccagcgcccaaguuugacuaagucaauacuucauggcuaaacaggagagcaacaggacaccagaaacugagcagugacuagagccguagaagauauaccagagaaagggagagcaucuaucauaaagucaagaaugcugaaucccagccgggcgcaguggcucacgccuguaaucccagcacuuugggaggccgaggcaggcagaucacuugaggucaggaguucgagaucagccuagccaacauggugaaaccccuucucuacuaaaaauaaaaaaguuauccgggcguggugguggacaccuguaaucccagcuacucgggaggcugaggcacgagaaucgcuugaacccaggaggucgagguugcagugagcugagaucaagccacugcgcacuccaacaugggccacagagugagacucugucugggaaaaaaaaaaaaaaaaaagaaugcugaaucccgccacugagacaucaugcaagauaagaaaugaaggcuguugggauucuuggcacuauuuaggaagcaaaccagacuucacgugguggaguaagagaggugacaggauggagaagauagacaauucagaaaguuuagggaguagggagaagagugggaugggcaguaacuacagcgcaacacgggaucaauuagagucuuugcuuuaagaugggagaagcauccccagcuggagaagaauccaaaggacaggaguggcuaggugcccaggaggaacaagggaacugagggagggauggacaagacaagaagaccacugaacugggagggauuaaggcagguucagccucacaacuacuuaagaaaccaggagguuuccauuuucugugaagaggacguccuggccgggagggaagggguggaggccugaaauagcugcugagggcaguaagaaaaagaguugcccagaagagggacgagucacuuacccucaguagaaacuaccuagaguccaaugucaggacuguagugaauuccuagugggaaaaaguaacuccugguaacuuugaaucucuagcuucuaaaccuccuuucccauugaaagaaaaugguuacuuuuguauguaaugugucugcggauaauguaaguuggguuuuuuugagaccgaguuucgcucguugcccaggcuggaaugcaguggcacgauaucggcucacacugcaaccuccgucucccagguucaagcgauucuccugccucagccuccagaguagcuggaauuacaggcaccugccacgacacccggcugauuuuuuuuuuuguauuuuuaguagagacaaggccagccuguucuugaacuccuggccucaggugcucugccugucuuggccucccaaagugcuggaaguacaggcgugagccacugcgccuggcccuaaguuguuuuuuuuuuuuuuaagugaaugccagguaugguauucuagcuaugguguucuaacggcaacaacagcuaacauuucuugagagcuuacugugugccagacagugcggcaggcacuauuacaaccucauuuugcggagacaaaaagggaaggugcccugagaggggcgugcccaagugccacaguuggaaguggcggaagcaggacauacccccacgcagucuaugugggggaaaccaggugcacuguccucucuccacaaucuucccugacccagcaugcaaagugugcaaugcacugaaggauggggcccugggugacaagaguguggagaaggggcugggggaacauggcugauggggggccacuggcaccaggaacguuggaaggcacccgucugggguaggagccuaggauugaguccuuaugcugagaagguuggaggggagagaagcaagacauaaggagagcagcuggagaagaugggaugggcugguuuaaaacagaagucaugauugacccucaguggagaggccucacaaagguaccaagggcauccucucauucccccaaacaaaacuacaaguauugaguauaaagaaaccuuaauauucaucuuuuaauggcuuucaaacauuaacaaauaaugaaacuaauuuguagguccaagccagucaguuuucuuuuuaaugaauaaaaguguuuuacauguagugagggaggagcauggugucgguuuuucacaaaacacaggaaugcguguacauaccagggaguggaguaaaauguauuucucacuacuaggagcagaaaguucgaaagccacugaucuaauucaacacucccauuuuagaauuucagaauggagaaaacagaggcucaaagaagccaaacaacuuguccaacuuacuuaauagcaaagccgagaagagcauccaagucuuuaauaguucucugguaauuuccucaccaaaccagaaucuccaaauguaaauaccucugggaaaaacagugcugacuuuaauccacauuagaguaaauaacaguggaguaguaaguaagcugaucuuuuagaucugcugccuggagcaaguuuugguaaaggaaacaguagcugaaugaauucagggggcagcuguggagcuaaaacaaaauaaaucugagggaaagcacuggguugcaggguguggcccagcaggcccaggacagggcuuggugugguagaauaaagggacuuuuaucuuccuuagagucuguauaucaucaggacaacuaguucuagacaaggaggcugcuuccaugucugagaagguggcucagggccauggugcuuugcucaucuaguuucaacaaauuuuauuaaaugagaaguucugaauaacagaugccuucacaaaucucugucccugccagacuccaucucuuuaaugaaaacaucauuguuggguauuuaucauuuguuguauaauucuauuucaaagcuauagaagauucagagucagguccauguuucucuacuugaaggcaguggugcugggggacugggagaggguaguuccuaggagaccagagaacuagcuagaguaagggauggacugccaaaacaaagaggagggaugcugguggcaaacauuucuaaaggaaugccucucuagacaccagagcuaugagccuccucuuaaacuaaguuagaauucaggccagacaauugggccacguucauugggccagggcccaaucaccaacaagcucccggcuccuuuccuaagugacugcaccaaaauagcaaaggcaugagaugucuaaagaguauccuacacaauuuccaggaaguuuuuuuuuuuuuuuuuuugagacggagucucgcuuugucccccaggccggagugcaguggcacgaucucugcucacugcaaguucugccucccggguucacggcauucuccugccucagccucccgaauagcugggaccacaggcacccgccaccaugcccggcuaauuuuuuguauuuuuacuagagacgggguuucaccguguuagccaggauggucuugaucuccugaccucgugauccacccgccucggccucccaaagugcugggauuacaggcgugagccacugcacccagccuccaggaaguuuuuuauuucaaugugauguaauuaauuuggacccaagcucugggauggacagcucugaaagcucaagcagaugucuuuccaaugguauugaagaagggggccaggcacgcuggcucacaccuguaaucccagcgcuuugggaugccaaggugggcagaucacuugaguccaggaguuugagaccagccugggcaacacggcaaaaccccgucucuacaaaaauuauaaaauaaauaaauaaaaaaggaaacaagucucauacugcuauggggaaagaaaaaaaaaaagaaagauggccaacuguguaagucuagaguaagccaccuugagaggcugguggugcagcagcagcaggaaagagggaauuggggcuguggugugcugucauaacacaggcugcuguuauggggacuaggauuuguccccuugaauuuaucuccuccuccccuugaccuggccaauuuuauaaccauuccuuccguucauuagcucaggcacaagacgcuagagggaaaaacuucugaaacucaaagccacuaugcugcugguucauuccccaggaaacacgcaugguagaaaagcagcaggccaaaaacuagagauuccaggauuaucugucauuuucaaagaucugggcucugaaaggcugaugugagccacugggugcacagcugccccgccuuugguucaagccucaaagcucuaaccguugcaacccaaagcucuuucuaucucugagaugacaucuagaaccuaagagugaccauucaacuacaagauacacagaaggcuuugacauguucugaguacacaacgaagaauuucagcuggcuauacagaacucuagacgagaagugcuucauacuaaaccaguaacaaggauaauuucucuuccuauggagguuccuggguugaggcugauuuccacuaggcaccaauuacuuacagggcacagaacacauaaaaggacuuaaaaagacccugagaguaccacccaaauauauggcuugccauuugcuuaaacaaagcaaaacacuagaucccuggggcccacccuccaaucuacugaaccaccuuuucagcaaaccucuucugcaaagggggcagauaguaaacuuuaucaagagccaaaauuaagaacacuacauagggacuuuuauaacaagagaaaaaucuaacacauuuccacaauucuuuuauugauaaaguucagaauauauugaguacaauuuuuuuuuuguaacgagaucuguuaacgagacaaguggauuucuuauuuuuugggagaauaacauuucaagucauugggauucaaagaguguuccauaccaucaaauugacugcaacguuuauauguacaaauaauucuuagcucaugacuguacaaaaauugggagcucaguuauaguuuggugauugcugugguacuccugugauugggguggagcccaggaaucugcauuuuacaugccucucacgugauucugguaaugggccauggacccaauggacuauccaauccucggaaucucuguccaccaaaggggccugugguuuugcagugcgagaacccggcugugccaccuaccaguugcucaaccucuccaaaaaucagaugauucauccucacaacagggguggcauugcacugcuuggccuacccuuaaagaguugcugggaugauuaagugagaugauccaugaggugcuaugagcauacuaugucccagauacuaaagacaugccaguuauguugaguuuuuuuggcugcagaugcagacugccugagcagcuccugcuugucuucuccuuacucaaaaugugucccccagcaccuugaaggccagauccacuucaaccuaacccacugugaugugcuaaagcaaacucagugcaaggcuucauaaaaugauaauccacagccccugguccugaaccuccuggcccucuaauaucuccaaccaggaugcuauccacucuucauuucagcgucuucaauaauagaaaacucauucucuuucuacgguggcaccacuccaaagcuggagaagaaaaagcucuuccuuacaguaucuuaagaaaaaaaggguguuucaaaggaggcaguagaguguagagguugaguaugcagacuggcugaguuugaauccugguucugccacucacuggucacaugauaaccccuguaugccucaauuuccauaugcacaaugacgaugauaauaauaauaccuaccucauagugcuguuguggggacuaaauuaguugauacauguaauccacuuaagaaaugugccagacacagcgugguugcuauguaagcacuagcuaauauuguuauuauccuaaaccauggaggagcucaaaguaaugccuggaagcacccugauaugucuccgagacuaaaacugucauauagacagcauauacugagggccauaucaaaccaauuuugucaucauuuacugauuaaauaggauuauuccguuuuacaggugaagaaacaaagcuucaaaaagguagguuaagcucaccagcccaaggucacaagggcagguaaacguauccuaccuccuuguggcaggaggaauucaaacccaggucuguguaauuccuaagcccaucuucaucauggagccccucagacucgaaacuacuaucagcagcagaacucaacugacuaugaccacaggggaacucaggcucaauuuucugccugcgaguuccugguuggcuugcauaaacuguaguuaauaucaugcuacuugaacccaauuaggcaguaagucagccuggaaaacaucaugcgauguauuccaaaggucaaaguaaaagcuggcuuccaaggcagccucugcuggacacugccaugaaaguuaguuucugcacagauaccagaguucagcucgugaggugcuuaaccagcaccuauaucggcuuuuuaaaauucucagagaugccagcaucggaggacccgacgcgacgaauugccuggcuccuaagucaacauccggagaaaggcgguuuacuuuuuucaaaagcaaaccuucaucccucucuuucgcuuuaggaucucauuacuauuguagcugccuucucccaggcaaaaauaaaagggggaaggagcagguuuagaccgaggaggaggguuccccuagccugcagggcgcugcaacauccaccugaaacacggagcucgaccuaccuucccggagagcccagcccgggagggcguuuccccaacggaucgacaacucuucccucccggggaacaggcugcuguccuuggcuucagucagggccacuagagucgcgugcgcgacaccccucacccccgccaaaagaaccucauguuuaauguuccccuuacucuaucacuuccgccgaaagagcaaacaccagagcgaucgguuaguccuuaaggccacauuuaacuacgucugagcgccugcaggaggaacggcgaaaccccggagaggaggcgggggaggcagggagcgcgugggggggggcauuugcacagaggaucgucguccucccggcgccgcggccgccgugacucuccagcacagccucaggccguuggcgcggggcggaaacccccaucggggcucauagcacaacuggggguccccaaagccggcucccccugccuccuccgcgcgggaggccgucggggugauggcgcaagacuccgcuccccccgccccccacagcgacaacagccacggugacaaaauggcagcccggcgcccggcagucgugccacaggcgcgcagggcccuggaggcggcuccugccccccaguaacgccucggcgcccuucgggcucagccccgagugggccuagccguuaaaaaaaauaaauaaauaaaaauaaauaaauaaaacaccuggaacucaaaaccagccuagaaagccacaaggccggccccgcgcguacugcacccccgccgcccgccugccagcgccccgcgccacauggagcccggagcccgcauuccgagcccugcgccccgcgccggggaggaggggcggggcgugcggcgcgagccccgggaaacauggcugcucguccuauuucggcgucgcggcauggccaccagcucccggagcccaguugggagaggugccgaagguggguguguggggggcccaggggcagcgcggcggggaggggcgcagggggcgcgcuccgggagccauuugucuuaagaacguuuaaaaaaauacaguuccuccucccccaacccuuuugucccucuuucgcuagcuuucucccccucccccgcaaaugugcagaaagugcccccuccuccgccacccgcgccccaccccgccuccaggcagggggcaggcgugugggccgcgaggcugggaggcgagggggcgaagcgugagaaaucgcucccaguacggcgcggugcgcuccccuccccaacacacacacacacucguggaaguuuaaagagccgguucgacccgcuuuccugcuugcucccggggggccggcagcgucggucggguucgccaggccagccgcgcccccgcacccacccgcggcgaccccggccccgcgcuuggcgcccuucccccuccgcgcagggggcuuccggaaaguacgcgggaagaccgcggccccggcccccucccccaucaccacacccagcccccaaacgcuaggcgccgggucccggccgggacgaaagcggccggagagaggcaaaccgcccgcaaauagugcgcggaaacuccggccuccaccggcggcgcccccuccucucccgcggccgcccccuccccgcccugcgcgccauaaggcacucgcacgucuccaguccacagcugcguuaaggcggggaggggguagacaaaaaggaucuuguuuucaaaagucucacucagguuugggggaggaacuagggaaaagaggaagcgaggccugccuucgccgggauucggguuuaacgggcuagaggggcgacaggccagcgcacggugcugcccaaacucccaacuccauggagcucgggccaccgagacugggggcguccucccgccagcgcguccccgguccccccaaggggccaagaggggagcuggccagggucuccgccccagagccgccaacucgccgaaaacacucagguuugaaagcgagagggaggcagaaauaaaaaccagcguucgagucacccacccucaccuucccccuccucagggguaagcuuucgcucgagccucgcgauucccacccguguaaguuuccuccggccgugcucccgccgcugcccaaucaauaacggcggcuagcgggcaaacucccauccuagagcugcguguuugccaugcccgcauaaacguggacccagccaguacccaccacgggcgccagcuccgggcagcucgcguccugacaaaguuucccgugcccauuuauuaagcaggcgccgaauggcugccgacaagcccagcacugagaaagacgggccggggguucgagcuggggggcaccagggcccaaaggcuggcaucuuggggaagccggaaggagcuggggcgagggggcaccgggacguagccuuugggcaacuugcaccagcgaucgcuggaggcagggagacgcggggauuaucugugccuuagcacguucgaaaaucccucccccuccuucuaauuuauccucccuucggaaggaaaggaagaaacaucagcaucuggcccgaaggugggguggaaagagugagggagaaagaggaggagaggaagggaggcagagaaagggagggagggagagaaagggcgcguucacgaacacuacaaaguuacaaauauggcucccccgucucucgccucaucacugcaaagaaaugaagacgcacuuuaaacuccagccauucccaacuccgcugcagcccccuccccacgcgcucuccccgggggccucggcccacauuuaucagaaacuaaaccggacucgcgaagccccaaacuuauugugugugcgagcgagcgagcgagagaaagggaggggggaggcgcgggaggggggcggaaggggggauacauuuauaaaauguaaaacccccuuuuuuuguuguuaaauccaggaggcagccccucuccuccuccucccucguuaaucuuccccccagacggagucacgggagcagcgaucuccgagggugauuucgccucauucucuccgacccaaacgcgugcgcccgccggcccccgaugggugcacacucgcacgcacacucucgcacccacacucgcacacgcgggagcacacgcacagguagucacacaccaagggcagcggcggcggcagccggaacaugcucggauggcauugcaaccccccagccuugccaauucgcuugcaguccgacccccaaacccgcaccucccgggcgcccccccccaaaaaaagugccuccccccagcgcgcacacacacacacacacacaaaguaggagaauggaccgacagagauauuuuuggcaaaugcucacaucagagggcguccuguuccgcagcucuaaaugaauccgucugcccaucuccaucucucgcgcucucucucugcagaggcucccgcgccggcggaauucaaucaauaaaccccgaacccacggccgcgcguuuuaggacuuugaaggcucaaccagcuccgcucgguucucgagcccccagcacccgcggcgcacacuaaccugaucgccguggaggcgggaucugcggccccauggacgagcggcagcggcccgagcca

SEQ ID NO: 16039 - RNA, 1143 nt, Homo sapiens
augaggcuugggcugagggggugguagaaggaagagcuggaaagugaaggggggcaaaaaacuagggguggagggaccagguguccaggccagacaucugcacucggccaaguccggcccagcccagccuggggcucgcugcugcagcccacgcagccuccaggaagcuccugaugagacaaacaggaccagucguccagggucucugcuucccaagcacgggagcagcccaggacacagaggaagaggccaaggccagacccgggaagcccugaauuuuugcccuggaaggcuggacuccaccccaggccaugaggagcuaaggaagggcuugaaucaggaguggacaccucccucuggcuacuucaagggaagggauuggagggcaacacaagccgggaaacggugggggcugguggguuguccagguaggagauaggaguggcccagccuggggcaguaguuauggcagaauuaagagagcuugcugagauaaggaacugaccuugaucccaggggugggugggaggaggggauagggaggcaacagggaagagggaggaagaggcagguuaggagaacucagaaauggaaccagagcugggacagggaugacccacccccugcugucuaauggggcacuccccaaagauagggaucguguucucuaauccccuuguaaaccaacaacagcagugcuggccacaccuuucuuaacgaauguuccuuuggcuaccugagagaggaagggcuggucuuagaaagcauguuggaugccggggcgagguggcucaugccuaugaucccaguaaucccagcacuuugggaagccaaggugggaggauugcuugaggccaggaguuccagaccagcccggucaacauagugagaccucaucucuauuggaagaaaggaaggagagaggaagaaagaaaagagaaagcuuguugggcuuuuuuaaucacugaaagaccuggcaggcccuagaacuucuuagcagugugauucaagugauucuaaaucccccacccaccagccgucucccauucuaacuuaucccccaccggccugaaauucacauagcucucugaaagucauuuauaauaaugaaauaaugaaaacagcuuauuuuucuuugccuac

SEQ ID NO: 16040 - RNA, 18119 nt, Homo sapiens
guaguuuuuuucaaacauuuacugaacacaaacaccauuuuuuccuuuuacacagcaagauuguuaguuucaaauuagcugaguuauuaggacugucaauugccaugaaacuaaaaaugacucuacaugucaaacucaaauagaaaaugucaugcaauauauaaaucacuaauggaccucuggugcagucagcaaguuuacuauguuuauuaaagucacauaaaugguuugacaaaagugcacaauagaaugacaucaccgguuuguuauaaaucacagugaauuacuagaauacaacaguguaguuccucugcacggaggauugcaggauggggugaaaaggacagggucuuuuccaucgauuaggccagucagauuuuacuccccaacuguguaccuuugaaaagacugugaggaaagcugaguuucuuuccucaucuuuucuccucuaccaguuacuaagcaacaacaacaaaaagccaugcacaaauuuuacaacaccugauaaaaaauagauacaaaaucuuguucauuucaucauuuggcaagcuugcaucuucgcuccuucacuuuucugauuaggccauucaucacaugacucacccugaauaaaagcuguaaauaauuuagcaauacuuaccccuauacacacaucaagauacacuccccauaaccaucaagucacugucucuucccuacacauuaacacaaagguacacaccacaaaccuagagaccacauuuacuuuacaguuuuaaaaauuaauauaucuccacuaucaauaguguaguauuuauuucagaucccuuauuugggggagggcaugcuguauaacccagcccaucuaaagauuugggcaagucugccagaaauacauaagaaagcccugcaaugugauaaacacauaggaguuuucuacuuucaagagaugacauccagaacaaagcuaugcauuuucagaguaggaauggacacacagcuuaaaaccucuggacuaaaaauauuucauagcacaaaaggcagaguuuuguuuucuuuaaccccuuuuuaauguuauauagucagugagaaaaacagaauagucaugugugcaucaacacaucuaauuugaaaaggaacauuuaagauucuuacagaaaaucuaucauaaaaaacaaguccuuuauacuuucauucauuuacucacuaauucagccacuggcuguuucuaaaccagcaaacuaaucaaaggucuggcaacucacuccucaucccaccccauuccaaaaaaaaaaaagaaacgcuucugcuuaaauaacccaaaguggucuuauucauaaaguagcugccucaacuauagugaaaacucuuaacaggguguugcucacuugaaauuuuaauuuucaaaacauuugucaaacagaguugguauuuagaaagcugcugcccccaaaucauauuuuacuucaaacaauguuaucauaccuaaguucucacaauuaccaauuauuaguccacuauuaguauaaugaaauaaaacccuucucagaaacaagcagaccaaagcuuacagauggucugcuuugggguuugguuuauuuaaaauucccacagcaaagaaccuuaacgugauugggcugugggcuacuagagcaaccaggguggacugaaaaagcuauguuuucagugucaguucuaauguaaaaauguuccccuucuuuaucaaucgaggggauggguuugccgcccauuccuugaguuaaauaguuaacuucauaguucaauuuugccaacucuaucaagugcauaaaacccacuuaaguuucucaugauuugcgaaugaaaacauccaccugggccucccuagcucauccagauuuauauaacaauuacugaacaggacagagaaguuuugguugaaucuguaauaccaucaaugaagauuuacaauucaaagcauaaguauaccaauaguaaacaucaaaugaccaaaguggcugcaaaauggagacagccuagaguucacagagggcugagauauagaacuaucauuuucuuaccuauuuuccuuuuuuaaaaaaaaauuaaguuggggaagggucuggcuaaacauauuuucaaacaauucuaccaaaaacauuuuaaaaaaacaggcauguagaucacuuauuucaaaaaugauuuuauacagguguuucacaauacacauuuggauugauuuuacaagauagaauuagauucucagcaagauacuacacaauuuaccacuauacuaaacaaacaaaaaaucuaauuaccauuagcauaguucauaguuuauuccacugucuucaaauucguucuccacccugucagcauuucaaucaacaguuuuacuuucuucagcauugucuucccuucucaaaauagaaugucauuaaauuuugaugucugaauauguacauauaaucauuauucucauuuuauaaauaagcagugucuuaaauagugcugguccuggguagccaaagggaugaaauguguuuuuaaaacaugcaacauuaucugauauuuuaaguuuugauguuuaaauaaaaauaauauacauuaauaauggaaccaacugaauaccaaguaucaaagcuauuccuuagacuguccaauaagcaggccuuguaguuugaaaaauaaagggucugaucugaacuguggaaaaagcaugauucacucaccuugaagaagugcauuuucucuuucaggccacugagaguugcuaagagcaagguacaguauuuccuugauucauaccaggaggaucaagucugguaauuuucaaauuagggcucacucaaauaaauaccuccauuuaagccaaccuaaaaaccuuccuuguaaaaucucagguuaggaaaauagguaucuauuaccaugacagaauuuaccaucaaaaccuuccuaacugaagcaagaagacaaaguauaaugauagcaacuguaaaaaguaucuugcauccuugggggauaguccccccuucuguccccucccauccuucaaaauauuucauuuugugggguaucucuauuuuauuuaaggcccuagggugcugauuuuggcuuggucauuguuuuauacugauccaacugcaaccuuucucuuacacuuuacaaagcauuauccauauauaaaauguuaauugaaaccuuuuuuuuuaaguuuauaucugaugcugcuacaucauuauaaugcuuuucauuaaagaaaaaaaaaaagcuacaggucuucacuuacaguaccaugcacuaugaguagcuaaggcauucauuuggcacuagagagaaaauuacagauacagcuaauuuugcuuucauuaucauuuuuaacaucaauagaaauaagcauauaacuuucacuugaauuucuguaaugcuuaaaagauaaucacagaauacccuuuuaguuugacaguuacaauguugccauuaaaacaaaacaaaaaaaccauaaagaccucuguauagccuguaggaauaagugacauuuugugguugaaaaauuugcagcucucagacacaauuaccuuucaaguggcauugagaauuauuuucaucauaaaaaacauguaaguuccuauaccacacuagugauauuucuacuucuugucacagacuaagaaagugaaaaaauucaaacauauccugguuccuuuucaucugucauaaguaaaauaccuuauuagggaggcauaaauaaugccuucuggaaaaguaguuuccaaauuuuaaaagauacaggagaaaaagggaaaaggggacaaaaauagaauguauaacuacacugugacaauuuguuucauaagaaaacagcauucauaauuuuuacaugucuaugagcugaaucaaauagacugcugcaauuuagauaaauuucauuaaaauagacuuugaagaauucaagccuaaaggcagaguccaucaagauucucugaaaaguugguuuaagaugauaaccauuuuguauauacuacccagcauaaugcaacaauuucaaauggauuuaaauuuauaaauuuguaacuauuauuaaauuagcacauuuuccagauuaaucugcagcuauuuuuuaaaaauccuccugaaugcuaaaaugugcugcaucacuccguauaaauaauggaagaguguaaacuaucuacagcaguuuggcaugugcagaacaccuggauaucccauuccucuuaauguuccuuuuuagcucuuuuucuucauaaaauccucaaaacugcugcauggauaacaugcugacauaggcuuaacagaaauacuuuuguaagcagcuguuuaaaacauuaucaacuugaaauuauaaaugucccuuguuacauaaacaaaacauuuuauaucuguuccuuuaaaaaaaagaaagacaaauagguaaccaauaugcaaauaccuuauaguuacaccaaaacaaugugguuuuguuaaagucugucugaaaucaauuaccaugaggcaagaaaaacaaauacagaacuaaggaaggaugggaugggaggaaggguaguggaaagaaaagcagaauuuaugaacacauaauucuacugucugugauuaaaaguccuuuacuuuuuagcaccacauuaaacgacuuuacauauccagucacuuaaugaaauccaacaaacucuucaagaguucuggggaucuggucuugguaguuaaugucauuagcccgaacugcucgggcagccaggcacuugagacucaucuucauuugaguuuuaagcaguauuucagauaccccaguuguacuuuugucuagcggagucuuauucuguuuauucgucaugucagugugagcuccggcuucaacuaggcuaaugaugauggagugcaaggucaaaaaaucacugaugggccuguuguacugaacgauaauaugaagggcacuguuucccucauuguccacggcauucaccucagcaccacaguccagcaggagcuuugugacaagugcauuuggaaagcugcagacgucauugguguggaaaucaucaacuggaguauuggaauugacagccagaugcagcaaggugaaaccuucacgaguucugggaucaaggugaaucagguuguagaucugcuuguuaauuuugcacugaucuucuucgcugcacuguguuuugguagagaugcacacuaaauacagaaagguauagagauuacauucauaauuguccauagcauuguggacaucagcaucugaaauauuuuucacucuguucauacuuuguucuauuuccaaaacacugcaucucaaaacacauucuaugucuggggccuucacaguuucauucaaauguaucauuugugagaaaacuugagcaaaucgaagaagauccuuguggguguuccuguuaccuuuuugucugaggugcagggcaugaagccacaacuugauacacugcucaaauuccauauuauccgcauaaacagcuccucuguaaaugaugggaugagaaacaucaauauugucagcaccuaaaauccguucccgaacuauaaggccuuccauaugaagagcaucucugucuugccgaauggacuccaguuccugaggauuucuacauucaguucuauucccauaagcauggauugguggaagaaccucuuuuucgagaauguuaucaccaucuuggaaccucucuaacauggcuaaauauagauagugguaugucuuuaugaugucauaguucucacggucauuugcaaaggaggcacccaagaguuccaaagcuucaauccgacuucuucggucgcaaucagcaugagagaguaacaguucuacgacaucagcuuuacagcuuucggcagcuacuuucaauggcgucaucccauggccauucacuacuauagcagcacgccauuuuaucagcucuuucacaauaucuaugugcccagcuucagcugcaaagugcaaugcuguggcuccacaaugugcuuuggcauugggaucagcacguuguucuaaaagguaucugaccacaucagugugucccuuauaugccgcaaucauuaggcagguguugucauauuuguuggcaaugcugauguuggcauuauuuucaaccaaguauuucacaauguccagucugccaucaaagcaugcugcccgcagggggguugaauuaguuacugugguaugguucacguuggcuccauggcugacuagaaguuuaacaacuucaaaauguccugcuccagcugcacaccaaagagcaguggcaccaucaaugacauaccuacacaugaaaagaauaagcaguuagauaacagaggccacagccuaacauauguuuaagggauguauucacucccaccgaccaagaccucacucuccagaacauuaauaaaacaucaguucucaugaaaauaaaaacagguaauuuaaggaaagcacuuugcauaguacuuguaccuaauauaaagcucaauauaugcuagcuauuacuguuacuacuagaguauauaacccuaaaaaacaaaccugaaaaaucacgaacuuucuacuagcaaaaguaaagacacuucagaaggcacagaggaaaugcguggagguagcuucuucaucaccaaguugauucacugguuacuaggagaacagcauguuccuccuucccaguagccuccagguagcaagcaguuucugacaauuaugaaagccaccccaacccuacauuaaagcuguguuagacacugcuuuaagaagaaaaaaauaaagcagguaaguuuccccuaagcuaauugaguacuauacuacagcaaugagaaugaaauaauuacugcuccacacacaauaugaacagauaacauaaaccugaugcugagaaaagaagucagaugaacacagcacauauuauauuauuacauuuacauaccuaucugcaguguuagaagugaggauacugguuacuuuuggggagagguagugaaaugggagaaagcacaaaggggacucuaguaaacaaauauguucacuuugugaaauuuuuauauauuuauaauuagugcauuuuucucuaaguuacguuaugcuccaauuuaaaaguuuuaaaauguauauguauaugugugugcauauacugcuugucuguguguuccucaaucaaccacuacaggaaaaaaauacuaacagcaggaaauaauuagcacuuuuggaaaaccaagcagauaucuucucugacaugacuggacuuguggcuucauacuuaucacuuacuuacuaaacaucugauaugugcuagauucacuacuuaacauacaaaauuagacuauugcuagagucugaucuuucccaccuuucuacugucaauuuuuccccaaccuuaauuucuaaauuucuuaccacuaaccaaaagaccugauaaguagauuuuugcuggagacagucuacugugcuagaagcaauaaguacauuuggaaguguuaagaagaaagguugaucaaaggaauauucacuagggcaauuaaauauacacaccaaaaaccacacuagugagcuucucacuauacaaccuuauaacacuggucaaauuauaucccccaugaaguggaaaagagaauaaugcuccuggugcuauaguuugaauguguucccaccaaaauucagguguugccaaacgugaauagcauuaagaggugaugucuugaagaggugauuaggucaugagggcuccuccacuugugaaugaaauuaaggaccacacacaagaggcguuaggccuggcaugguggcucacgccuaucaucucaguacuuugggaggcugaagugggcagaucacuugaggucaggaguucaagacgagccuggccaacauggugaaaccccaucucuaccaaaaauacagaaauuagccgggcaugguggcacacgccuauaaucccagauaggagccugaggcaagagaauugcuugaaccugggaggcagagguugccgugagcugacaucgugccacugcacucagccugggcaacagagcaaaacuucaucucaaaaaaaaaaaaaaaaaaaaaagagacguuagcaacguuccgcuggcuugccuuuucaccuuccaccaugugaggacacaggauuccuccccucuggaggaugcggcccucaccagacaacugaaccuacuggcaccuugaucuugaacauuccagcuuccagaaauaugagaaauaaauuucuguucauaaauuacagugucagguauuuuguuauaacaccacagaacagacuaagacauauaaauaucaugguuuaaccccaguuaacaucaccacaaaaaacaauacccuuuaucacuucuacugaaaauacucauuuuauaauaauuuaagcaauuacuucuucaguuucaaauaaugacacaaaauguuuauaaacaaaagcccucucaguaacaguggcuaccuacagagaagaggcuaggacuggcugggaagagacuugaagguacuggaaauguccuacauuuucaucuggguagcagccacauggauauuuagggaaaaaacucaccaaacugcauacuuaagaccucugcauuuuacuguauguaagacauaccucagaaaagaucagaagccuccuaaaauuauuuuucaaauuuuuauuuuuaaaaaugcauuuguuaauugauuuuuuuuaacuaaagaaugaaucaggccgggugcgguggcuuaugccuguaaucccagcacuuugggaggccaaagcaggcggaucaccggaggucaggaguucgagaccaaccuggccaacauggugaaaccccgucucuaccaauaauacaaaaauuagccaggaguggugguggcacaugcuuguaaucccagcuacgcaggaggcugaggcaggagaaucacuugaacccaggaggcagagguugcagugagcugagauugcaccauugcaauccagccugggugacaagagcaaaacuccaucucaaaaaaaagaaugaaucaagaaaauaagacacuacaucagugaugccaacuauauguuuugcaaacaauucaguuuaauuaaaauucacuuuuguuauuuuuuuguuauguuuuuauugucaugauuauguaaaguucaauaaacauuuauuuauugucaaaaaauaacacuugcaacagcaucagaaaauaccaauaaauaguaauaaaucuaaugaaaaaugcacaagacuucuacacugaaaacuacaaaacacuccugagauaaguaaaucuaaauaaaugggaaaauauuccauguucaugauccagaagacucuauaauguuaagaugucgauucucccucaaaaugaucuauagauucgauauaaaccaaaugaaaauccuagcagguugugugguauaugugugugugugugugugugugugaguccaagaggucgaggcuacaaugagccaugaucaggccacugcacucuugccugagcaacagugcgagaaccucucucuaaaaugggaaggagagaaagaaagaacugacaggccaauucaaaaaagaauauggaaaugcaaacaaccaagauaaucuucaagaaaaauaaaguuagaggacaaacuacaguaauuaaaauaagugcuggcacggggacagaauaauauuaucaacagaccaaaaaaaaaaaaaacuccagaaauagauucacacauacagaaucccuugauuucugacaaaggcuccagugaaauucagguagaaaacauggucuuuuuaauaaauaguuauggagcaacaagauaaucuauauggaaaauaauuaaccuugauuccuaccucacaguacauacaaaaauuagagacacaguauagaccuauagugugaaaagcuucucaaaauaaaaaaaaagccauagacuauucuuaaugaauuuaguguugaucacaauuucuggaacagaauaccaaaaaaaaaaaaaagcauuaaccguuaaagaaaaagaaaguauuuauuggauuucauuaaaaccagaacuuccauucaucaaaaaacauuauaaacaaagcgauuaaguggccaggugcaguggcucacaccuguaaucccagcacugcgggggggcuaagaagaggacuguuugaaccuaagaguucaagaccagccugcgcgacacagcaagauccugucucuacucaauuuaagaaaaaaaaaaaaagacugaacaaguauacuucacaaaagauauccaaauggcccauaagcauaugaaaagaugcucaagauaauuaguuaacagggaaaugcaaauuaaaaccaguuuaccaauauacacacccagcagaauagcuaaauuuaacaagacugacagggcaauaauaaguguugagcaagauguggcaacugacauucucauugcugguggaaacugcaaguaggaauguaauuugguuguugaacuuuggggaaacuauuuggcaauaucuguuaguuaaacauacaccuaccugaugacccagcaauuccacuccuugauauauaccagauaacuaaaugcaaauguccaccaaacaacauacacaaauguucacugcaguuuuauucauaacagucaaacacuggaaacaaccaaaauauuaauuaauaggaaauggauaaacuguaguauauuuaugcaacggaauaccacacaucauuaaaaaaagaaacuacugauacaugcaaguacauggaugaaucucaaagacacuguguuaagcgaaaaaagccaaacaaaaagaguacauacuacauaauucugcuuauaggaaguucaaguacaggcaaaacuaaucuguggugacagaagcuguauuaguccauuuucacgcugcugauaaaggcauacccgaaacugggcaacuuacaaaagaaagagguuuacuggacuuacaguuccacauggguggggaggcuucacaaucauggcagaaggcaaggagcagcaagucacaucuuacauggauggcagcaggcaaagugagcuugugcagggaaucucccccuuacaaucaucagaucccgugacacuuacuaucaagagaacagcacgggaaagaccugcuuccaugauucaguugccucccaccaggucccucccacaacacgugggaauucaagauaagauuugggugggacauagccaaacccuaucagaagucaaaauaaucauuaccucuggcaaggaaagggaggaaacugagaaggggcacaagggaaacuuuuagagugauaaaguguucuacacauugaucuagagagugacuagauggauguaaacauauuaaaaauucauuguacaguauuguacacaagauucauguacuuuacuagauaugauauaccuccacuaaaaaaacagauauaauuaaaaacaaaaauaggcacaaaugacuucaaagaaaaauaguuuaaaugaauacgaguaauuuauaccaaauacuuucauuucaaguaauuucaauuucaaguaauuucaauucaaguaauuuauaccaaauuacuuugguaauuuauaccaaauacagugccaagcacuguauucacugcugaauaugcaaaauaucucacuuaaucuucacaauaauccugugagguagguacuauuauuaugcccuauuauacuauuauauuauaguuauaauauuaacuauuaugcagauaaauaacuaaaaaguuuauaugagggcugggcacaguggcucacgucuguaaucccaacacuuugggaggccaagguggguggaucaccugagguggguaguucaagaccagccugaccaacacggaaaaaccccaucucuacuaaaaauacaaaauuagccaggugugguggcgcaugucuguaaucccagcuacucgggaggcugaggcagaagaauugcuugaaccugggaggcagaguuugcggugagccaagaucacgccauugcacuuuagccucggcaacaagagugagacuccaucucaaaaaaaaaaaaaaaaaguuuacgugagauuaaaaauacaaaaguacuuggaauaccauaaaaugcaucaaacguaaggaaacauaguacacaucauuguucaaacauuuguuucaauuuaaagaacguuuccaaacugauuaauauaauaaaaaaauacaaaguuaauacauaguaacaauuacauaguuacaauguuuccuuccacuggauuuguuuuguuuuguuuugaaacagggucuugcucuguuguaccggcuaaguacaguggcacaaucacugcucauggcaguggcacaaccacugcucacugcugccuagaucucccaggcucaagggauccauccaccucagccuccugcauacuaccuuuuuuuuuuuuuuuuuuuuuuuuuuuuuuagguagagaugaggucucacuauguugcccaggauggucucaaauuccugagcucaaaugauauccccaccuaggccucccaaagugcugggauuacaggugugagccacugcaacuggccugguuuuuaaaacauauaauuauuauaugccaggaaacaggaaucuaaacuacuucaaacucaagaaauguuagauuaaaauaggcagucacauuaucuuuaacccuagcaauaaaccuauaggaaaagcauuacccucauuuuagagaugaaaagagacaaaaagugauuaaaauauuuuucugaucucaaacuucucagaaucuaugauguaagaguaaaaauuaaauuacaaguauucacuugguuuuuauaauggaaacuacuuggucaguuuaauauuuuuccugguauagucuaauaauuuccauuuuuuucccuugagcuacagucauuugacaggagccucaaaaaaguuccaauuaccuauuucuauugaggcaauuaaaaauuuuaaagauauucuaugacaaaagaauucaaugcagaauguuucacaagacugguccuucagaaacauuagccuugguaaauuuagaauuucuacaucuaaaucaaaauauuaaacagauuaaagagaauuacaauacuaacauuuaugacauuccuccaucuauaaaaucuagcuaaaauuguaagacuauacugccucaaaacaaaauaccaaauacauuuaacagaaauuaaagauaaaauaaaauuaaugcaguauuuacuaaguuccuaaaggagaagcacuauaaagcaaugaucuuucuaggcccaguccaaaauuacaaugcaaguucucuauuauguauucaucuucaaaucaagaaacuauaaucugauauucaccuuuucaaacaaauaguauccaucagaugauggaaacuuuucacaauaagagauaacauuucugaucacaaggcugagcucaucuauuaccugguucaaucugaaauagaaaugccugguucaagcauuugaaagggaaauaaaaauucauuaaauauaaaugauccacacuuuauuuuaaccaaaguccuuaaaaaucauguauuacaugaaauguaaucccuugaaauauauauugccaacgacuuucuaaaugaagucaaauacuggcaugccccucaugccuuuccuccgccucaacauuuaucagaaguauuaguacuagcacugacuuuaaaagaacaacacucaacaaaaagccucaaaauucucggagguccuauucuccccauccacaucagcaaaccccuucaaggacagguggucuccacaaacucuggcagagagcagucagacccucagaacucaggccagcacaauguuucauggucauaugacaccucccccuuguucuguucccuuuuuauaacauucuuaacaaacagcuucccauuauucaacuaagggaucuucuuucauucccacucaugugacuuuucuucuuguccacucaucuauaucaacaugguauucacaugucacgccacaaguaaaauaaucucaaauguuacuccuaaaaaugugaacaagaggccgcgcacaguggcucaagccuguaaucccagcacuuagggaggccgaggcaugcggaucacgaggucaggagaucgagaccauccuggcuaacacggugaaaccgucucuacuaaaaauacaaaaaauagccaggcaugguugugggcaccuguagucccagcuacucgggaggcugaggcaggagaauggcaugaacccggaaggcagagcuugcagugagccgagaucgcgccacugcacuccagccccggcgacagagcgagacuccgucucaaaaaaaaaaagugaacaagaacucaaauaucaauggcuuaaucuagguggguggucccuuuccccucgaggcucuaucaugaauccacuuuaguuuccuaagguauuauagaagguuuuagguagaauagacuuuuuaaaacuuuuguaauauuuauuuuaauguaugucuuucucacgcacacacacaaaacacacagcaaacccauaauuacaugggaugaagcuaagaaguaaaacauucugaagacaacuaucaagcaaauaacagacaauuuaaagaaaagauauuuauuaaguaaacagcagguuagugaacaauuuggccaaaaauuaugaagcuagcacgugaaugacuaaaaauuagaaacacuaaucuacuucagcacacagcuguuaaucccuauauggccaugugucucaagugcuggcuauguguuuuucaaaggucagcccccaagggucaagucagcuuucuauuguuaauguacucaggcuaacauuuucacaaugucugaaacaaaugcaaagugaaaucaucacacucuuuuuugguucuaaaauccuaaaaugacugggauaaacugcaaaauaaucucacagaaggugugaaugcacagagaguaccaggaacuucaauaucucuuuuauuaauuaauuuguaagcuucucaaaaguagaaaccuuagauuuccuguaccuuacauuuccuccagaacaugacacaggcuaggcccaucacaagcauuuaauaaggacuauuuuuacauagcagcuaauaaauucauaauuguaauaauccauaagcuaaacugauauacagaaucaaggagaugaaaucuuaaaugauggaaacauuugagauugcaguuuaaccagucuuacucuuaguacuuuauacagggaucaccaaaaucugggcuccagcucucuccagucucccacaaucucuuucuuaauugccccaacuugaaucccuucuugcaacagcacugaaacacuagucacugcaagggcaccaagcugcugccccucuucuucauguccuacuacuauucuuuaaaacacagcucgaacgucaccuccucugugaagccuuucuagauuccccccggauaaaacagcacuuccuuucccuguuuucucucaguaguccaaaugauuucuacaacccuaaauggcauggcaucugcaaauacucauuuguguuauuaauuucucuccccccacccagacugacauccuccaagacaaaagaguauguuauucaucucugcauauccaaucccuaccacagaaccuagcacgcaguagguguucaauaaauguuuacuuaccgaacucauuaauuucucuggccaguacagaacauugggcaagauaagccacuacacaggcucaaugcuacauuucuagucauuucagguucuuuuaauugccaccucaaaacaucucuuugacgacugaaaaagauggcaauaagcaaaaccuuucgaaauucuuaacucuuuuuucuccccacuauucucccuuaugcacauugccucagcagcaguauucccaagcagcuguuauuacagaaauucauaucucaaugacuucauaugccuauacagguggaacgguacuggagguucagaggucacugugcuucacuccuucucuaggugcgggaaugcaaggaguuacagagaagacacgaaagccaguaaggaaaagcaaacaugaaucagguugccaucuuuggucaacaugaaaaaaaacaucuccuuaauguguauaauggugauacccgugauauaagccauugcccaugggcuaccauuucauuaagauguaaugcuaugaauauuuuccacucaucuaaaauagaagaaaaagcuuuuauuguuuaaaccuaaaaaagaaucaaccgaaacagaacauuucccuagucaucuuaaagaagaaauguuuuuuucagucgaguuuuagccaggcaguuucuaaucaccaaaaacuaaagauauauauuuuuaugcucagacccuacugacuucaaaagaaaaaaaaaaugcuaaaauagcuuauguacuaccacaagucaaccaaaacauauguagcaaaaucguuauacaguuguaaucuguaaaacguguuauaauccuccagcauagaaaagaggauaaugucaaaccugacaauucuggucaaauacccaaaaauucguacaauuaaacucaaagggcaaaucuuaggcauaacaaugugcauuuuuaaacuucccaccucaacuaacaguaaaugaucaagcuuccccacaacaucacgggauaagauguaauuuaagaauggcaucaucucccacaucagguccaaugccaucuuaguagccaauauaucuacaccgagcaacguggaggaaucagaaucaugucuugagaugucuggcugcgugacaaucccucaugaugcugcagcugcugcugguucuaggugcuuauuuugacauuaaagcccagcagcccacugaagguuuuacggaaccacucacuugaagggaguaaaaauggaugcccaaauaacucuuucggaguucuucaauguuaaccgcugaccuccuuaauuucugaucaguuacaucaccaguuccacuaaaaguaaaaccuggaaaggcagccaccuccuccaaauggcuuguucacagacuaucuaguagagaagacgacuauuagauuucaaggccgagggugugguuaucuucccacagagggaaugagggguaggggcugaugaggacgggcagcaaaacaugggauggauuauuagcccuggaagaugaagugggcauuaguggggcaggaggugguacaaaaaggggagaagugaguaccuacaugaagagaggguaagagagggugagggaggggagggcccgugaauuaacgaguccgcgcgcgucggagagaggcuggcuugggauguaccuacccgucgaagcggacggugccagucugcugagucugcacccgguaauguucuaagagcaagcguaccaccuuugcguguccauugcgggcugcgaugaugaggggcguggagcgcugcccucccugcuggcugacauagccaagcagauagcggaugucgcuuucagaccgguugagaagcaaggcggccagagucagcaccuugcccucgcuggccgccuuguauacauagccagccaggcccuccauggccgccgccaacuccaacacccguuuggucgccaccgcugcagcugccgugcgcccccggaggccgcguucgccagcgcuuuaaaccugggcccucacagcccauucaacagggcgccgucgccgccgccgcgcccaggcagcagugcggcccagggaaggcggagacgcagaggaggccgagugccgcgaagggcacguccgcgacccagcccgcgcagggaggaaggcggucagggccgcccgccaggucccaggcgccggcccuggaccgaggggaucuccauggcggacgccgccccgggccucaggccggaccccuccuuccugcgggaugcgacaggcgcgugcccgagcuacgggucgccggccgggucccgagaggaccucgcgcaccccggauggcgaaagaugggcgcgucucuccugacccggcccacccggccuaaggccuaacacugccuccuccugcgcuuuccgcccuucgccgucccugacuggaggaaaccugcaggcucucguccgccgagcucagaagugccaggcgcugccaacggccccggagauccucgcguaggggcccccggggcgaugcggaacgcucccgcaagagcggcgccggaacuugggcggggaggaagacgagcuuucgcagacagggccgggagga

SEQ ID NO: 16041 - RNA, 22296 nt, Homo sapiens
gccggcccgccccgaaccgccccgcgcugggaauuugcggcggccuccgccggggcagccgagcugaaccggucucuuccucggaaaggcagggccgaggggccugcggggcagccauggaggcgacgcggaggcggcagcaccugggagcgacgggcggcccaggcgcgcagcugggcgccuccuuccugcaggccaggugggcgcgcgccggggugagagggcgggcuaggcgccugugcgcuggggccucgggacccgccacgugacgcuccuagggcugccgggcgggaaccucgugugcggcgcuggccggggcggagcggagcgcggggggcuuggaggcgcgcuaccguggcggcggugcccccgcguuuccuucucugucuggggagccuggggcccagcggggcucggccuccccgcuucgccguugcucgggugggaggagcgcccgcccgaaguuugggguuuuccucccuucccgcguuccagcgacccgggcuggcgccgggacagccgcugcgcugggagagcuccccagggcgguggguacacacaccucgucacucggacccccaacuuauccgcaaguuccgggcgccaccuccgcguucucggggucccuccagcccugaguaggacuugauucugucauuuaucaggaggcugucugcuugaccuggggcacccaagaaugugcgaauguaauggaagagacagcggggaagggcggaagcugccguccagagaaugaaugaggagcccuucucaguuuuugguuuaucucguugggcgagcagagcuccauucuaccuucgucccguuuuacugaccagaaacauucacugcauucagcaggcauucuuuaagcgccugugguaugcccagcgcugugccaggcaguaaggggguaggcagggugaaggugggagaggcuuacgguccuguagggaucaggagagacagagcccaagugggagugagcggucaucuuggagggcuucauggaggaaguggcacuugagcugagucucagaggacuugguaggggacccagggaagacaggcuguuccauccagggaaacaguggggaagggcaaggaguuuaguggugcuggagcuuuccggcuguaaaagaaagugacaggaggaugcagacugauugugaagggccuuuaauugcagcaagucuaggacucgaguugaggaccuagauugcaaaacuuagggguaggcgcacugccgugaccgugagugccgccucaaauguugggccuuggaggccuugcuugucucacccuaguuccuguccuaggugacagguuaaggacacagucuuuaucccauaggcacuggggagucgugagaaguuucugagcacuagcaugcgcaaaguccuuguuaggaaguuuuugguacgaccuggaugaagggagaagucugagcgcuugggcugaggugagggauggcucguuucugcugcugcggacaugcgggcugagcagcugcggacuguguccguuuucacuuagaaacaauguacuggccauagaccgcauacuguagcucaccugucucccucggccugugaguuaaguauuauuuuacugaugaggaaauaggcuuagaugggcugaggagccugacuggcugaguccccgggcugucugccccacgccguguccagugguuucaucucugcugugacccaacccauuuaccagcuccccucuuccaggcagccucuucugccugcgggaugucucuguuccgaauccuugccaaguugggggucacugacugcccugaacugugacagcccaaugggaacagccugugggucucagauagggucaccacuuuaucuccuguguggggcucccaugucuagcaucuuacucagucuugacaaugagcugccagaugucacuuccaauguacagauggggaaauggaggcccaaagagguuacaucauuugcuggcaagaaccagggccuaaacccaggguuucugacuuacgggcucugcucuuacgacuccacuuuggcugcuaaggagucaugucccucuuccccugugugagcuccccaccagccaggguauucccagggggguggugugagggugggagcucucugucucccagggugucucugccccccacaauguggcuucagcccauucccaguaucauugcugcucaagagaguaggcagaaucauccuguccaguuccuaggaugcuuggauuuccucugcugcauccgugcuuugcucacuaccucuuaagguaacccauuccaacguccaccugcuuuguugccaguuuuuguauuauaaugaaaguguuacaauuaggccgggugccauggcucacgccuguaaucccagcacuuugggaggccaagguggguggaucacuugaguccaggaguucgagaccagccuggccaacauggagaauccccgucucuacuaaaaaauacaaaaauuauccaggugugauggcccaugccuguaaucccagcuacucaggaggcugaggcaccaggaucccuugagccugggaggcggagguuguagugagccgagauggcgccacugcacuccagccuggaugacagugagacugucucaaaaaaaaaaaaaaguaaaaaaagaaaagaaaagaaaguauuauaauuagugcccgugauaaaucaaauagcaaaggcuucaaguuuuaaaaaguaguaaucccugucccacucuucccuagcaccagagacaaucacccuagcuucuuuuagcucuuuuuuccagagucaaauuccuauuuccaaauaauauguuuauaacaauaaaaaacacuagcacuuuuuauggaucaggcccugcucuuaaguuuuugcauguauuaauuaaaccacgacccuugagauacgaucuacuggccaggugugguggcucaugccuguaaucccagcacuuugggaggccgagaugggcggaucaggaggucaggaguucaagaccagccugaccaacauggagaaacccugucucuacuaaaaauacaaaaauuagccaggcauggugucaugcgcauguagucccagcuacucgggaggcugaggcaggagaauuacuugaacucaggaggcggagguugcggugggccaagaucgcgccauuauacuccagccugggcaacaagagugagacuccgucucaaaaaagaaaaaaaagggauaggaucuacuauuaucuccauuuuacaaaugaggacauuaaggcccaagaaguuaagugacuugcucaagaucugguuaguggcagagcugggauaugaacccaaacagucuccaaaguccagacucuuuuuuuuuuuuuuuuuugagauggagucucacacuguuacccaggcuggagugcaguggcaugaucucagcucacugcaaucuccgccucccggguucaagcgauucuccugccucagccucccaaguagcugggauuacaggugcucggcaccacgcccagcuaauuuuuuguauuuuuaguagagacggcguuucaccauguuggccaggcuggucucaaacuucugacuuugugauucacccgccucagccucccaaagugcugggauuacaggccugagccaccgcgcccagccaaguccacacucuuaaaaacuacacucaacugcuauuucuugguuuauuuuauuuuauucuuuuuuugagauggaguuucacucuuguccccuaggcuagagugcaguggugccaucuuggcucacugcaaccuccaccuccagaguucaagcaauucugccucagccucccgaguagcugggauuacaggugcccaccaucacgcccaucuaauuuuuguauuuuuaguagagaugacguuucaccguguuggccaggcuggucucuaacuccugaccucaggugauccaccugccuuggccucccaaaguacugggauuacaggcaugagccacugcgcccagccuuugauuccuuuuagaaaaaaggaaaaauuuuaaaaauuagccaugugugacagcacaugccuuucuguggucccagcuacucaggaggcugagaugggaggauugcuugagccugggaggucaaggcugcaaugagccaugacugugucacugcacuccagccugggugacagagcaagaccuugucuccaaaacuaaaauaaaaagaugauauuaguccccuacccuaaacuuuagcuuuccucaccccuuccuacaauuucuguccucuguuuucauguuaucaaaguagacuauaauuaucugcugcuuuaaaaccguaauuaucuuccauguuuuaucuguggauugacucuaaacauugaaaauuaauauaaaauguguauguuauuuaagccauguauuuaauaaauauuguuccaacagagccaaauaauguuuaacaguuacauuugcuuucuuauguuacuuuuguuuuucuuggaguuucuaguugccuuucuuuauucucucauuauauuugccuucauuuccuuaguuuuuuuucuguucaagcuuuucauugucuuguaugucaccauucuuuaaauagaagcaaaauuagucucucugugguccccauuuguggguuaccgcuugacuuguucaggaugaaaccccuuccuuuucugccaggcagcccugcagaugcugcugacugccuugaggauuuuaaguguauggcaugcacuccucaacugucguggugucauuguccccauaugguagacuuggaaagcugggaaggagagaagagucuaaccuuguuucagguuaucugccauugugccaucaccauuguuuucagcagcauuugcuagugauugagaccuagcuggcacaggcugggggcucagugugcuaagucuguggagccaggaacuugggacaggguugagguugcucauccucaggacaugagcugggggagaggaugccuuuaccauuccaugaucugccucccgugggcagaguuccaggagaagaaaaccaggcaggugcugauuaaucuuuuuuuuuuuuuuuuuuuuugagacagagucuuuuuguauugcccaggcagugcaguggugccaucucagcucacugcaaccucugccugugagguucaagcaauucucaugccucagccuccccaguagcugagauuacaggugugcaccaccaugcugggcuaauuuuuguauuuuuaguagagacggaguuucgucauguuggucaggcuggucuugaaugccuggccucaugugaucugcccagcucacccucccaaacugcugggauuacaggcaugagccacugugcccagucuaaucuugauuugcaagcugguugcugaguguccacucugugugccugcuuuuuuuuuuuuuuuuuuuuuuuuugcaauaaggucuuacucugucacccaggcuaaagugcagugguacggucauagcucacugcagccuugaccucccaggcuuaagugaucauccuguuucugccuccugaguagcuggaacuacagaugugugccaccauacccaguuaauuuuuaauuuuuaauuuuuaauuuuuuagaguuguuuuuuguuguuguuguuguuguuguuguuuucuuuuugagacaguuucacucuuacugcccaggcuggagugcaauggcgugauccuggcucacugcaaccuccgccucccagguuuaagugauuguccugccucagccucccaaguagcugggauuacaggcgcacaccaccaagccuggcuaauuuaguauuuuuauauagagacaggguuucacuguguuggccaggcuggucucgaacuccugaccucaggugaucuguacaccucagccucccaaaaugcugggaguacaggcaugagccacugggcccagccccccucuuuuuuuuuuuuuccuguccuacuaaguuaggcuggacuaaugacagggauucucauugaccaaggugcuuccugagguggaggaggagguagucacugagccucuaguguaugcuggguacacauaacuuccagauacacacaucuaaguguucaugcuuccaaaaucccuuuauuccucguaccgaacauccuacuuuuugccaaguuuggagguaucagagcaagaaacugaaggcuguuaccucuuucgccacccaaguucucugggccuggagguuaucacucucugcuuuuugaggccuuacccugauggcuacugaggaaggagcuggguggggccucuguguuggucacucgucucagaccacugagcaguccucaggguuacuggcuaucuguccagucugaagaucgagccgcccgucccuucucuuucucuggcuccaguaagccaggcaucucagcuccaugcagaaccuucuucacuuccaccuccaggccuuuacccugcuuuccugcuuuucugccuaguuagauucauccauccgugcuuugaggcucccuucccucaugcaagcuuuguguauugcccuaggccacgcugauccuuuucuuuuuuuuuuucaguauuuauugaucauucuuggguguuucucagagagggggauguggcagggucauaggauaauaguggagagaaggucagcagauaaacacgugaacaaaggucucugguuuuccuaggcagaggacccugcagccuuccucaguguuuaugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacgggguuggggguaagguuauagacuaacagcaucccaaggcagaagaauuuuucuuaguacagaacaaaauggagucuccuaugucuacuucuuucuacacagacacaguaacaaucugaucucucuuucuuuuccccacauuucccccuuuucuuuuugacaaaacugccaucgucaucauggcccauucucaauggucgcugucucuucggagcuguuggguacaccucccagaccgggcggccgggcagaggcacuucucacuucccagacggggcggcugggcagaggcgcuccucacuucccagacggggcggccaggcagaggugcuccacaccucccagacggggcggccgggcagaggcgcuccucaccucccagacggggcggccgggcagaggcgcuccucacaucccagacgaugggcagccgggcagagacgcuccucaccucccagacggggcggccgggcagaggcgcuucucaccucccagacagacgaugggcagccaggcagaggcgcuccucacuuccuagacgggguggcggccaggcagaggugcuccucacuucccagauggggcggccaggcagaagggcuccuaaccucccagacggggcggcugggcagaggugcuccucaccucccagauggggcggccgggcagaggggcuccucaccucccagacggggcggccgggcagaagggcuccucacaucccagacggggcggccgggcagaggggcuccuuacuucccagacgggguggccgggcagaggcgcuccucacaucccagacgaugggcagccgggcagaggcgcuucucaccucccagacagggcagccgggcagaggggcuccucacuucccagacggggcagcugggcagaggcgcuccucacuucccagacggggcggccgggcagaggcgcuccucacaucccagacgaugggcagccaggcagaggcgcuccucacuuccuagacggggcagcugggcagaggcgcuccucacuucccagacggggcggccgggcagaggcgcuccucacaucccagacgaugggcagcugggcagaggcgcuucucaccucccagaugggguggccgggcagaggggcuccucacaucccagacgaugggcggccaggcagagacgcuccucacuuccuagaugggguggcggccgggcagagccuguaaucuuagcacuuuuggaggccaaggcaggcggcugggagguggagguuguagcgagccgagaucacgccacugcacuccagccugggcaacauugagcauugagugagcgagacuccgucugcaaucccagcaccucgggaggccgaggcgggcagaucacucgaggucaagagcuggagaccagccuggucaacacggcgaaaccccgucuccaccaaaaauacaaaaaccagucagguguggcggcgugugccugcgaucccaggcacucggcaggccgaggcaggagaaucacgggagcccgaggcagggagguugcagggagcugagaucacggcaguacaguccagccucagcaacagagggagaaggaagaagcgagggagagggggaggguugggggaggggggagggagaucccuuucuaaccugaucuccugauaagccuaguaaucaaaaacagaauagcaagcuguuggccagacaugguggcucacagcuguaaucccagcacuauggauggcugauguggguugauuauugagcccaggaauuugaggccagccugggcaacauagugagaccucaucucuacaaaaaauaauaauaauaauaauaauaauaauaaaauaaaauuagcugggcauaguggcaugcaccuguggucccaguuacucaggagacugagguggaaggaaugcuugagccugggaggccaaggcugcagugagcugugaucacaccacuguacuccagccuaggugacccugucuccaaaaaacaaaacaaaaaaacagaauagcaagcuauuaagagcacaggucuugaauuaacauaaacccagguuugaauuguguguguuauucaggacgacuggguugcaagugacagaaagccagugugaacugcaccauccuuagcaaaaaggaauguguuggcucauauggccagaucaugaacuggcaacaugaacacugucagcacuuuuucucccccuuucccugauccucucugcgaggcuacuucauucuuaccuggaugucccuugaggguggaaccuuggcuguaggcaguccugggcuugcacccuuagaacccagcacuauaaaggaaggagcucuuuuccucaccugcaguuggaaaagucccacugggccagucuagaucacuggcccuuccuguggcuaagaaaauaucaugucuuaccagaagaagcagugggugggaaauaggcugacaaaaggaauuguugccacagcuccuuacuacacggguggcuuuggcuaagcaccuaaucccucuaagccucaguauccucaucuguaaagcagaugcguggauuagaugagauagugcagguaaagaccuagcauugcacauaguugguguucagugaggggguggaagauaccgaguagaggggacaggaagacuuagcugaccuagggaaggccuacccaaccugucuugccugccacuagaaaaugagauuucucccaagagcuugccucccuguccugggguacucuaccagccaguauggaucauccuuggaacuggcaggaagggaucucagaaaauuagggaagcaacagcaguaucgacagaagacagucuuugcagugccucuaagcuaauguuugccacuacaaaaggaguaacuggucguugugacuguuuuaaucagccaguaguugcugagcauggaccagggccugagcucagaacucuggaggaauacagauuugugguccauggcgccuguucuuggcacaaacgagacgaugaaacccacaccucaguccucuuaggauguggcuggcugcuugucccuggaggugugcaaguaauugcagggacucuguaaagaggauuuggacucugauagggaggugggugaguugggagaaccuuaaaggucaccccuguucucgagggucuagaugggagaguacagcuccagccccauuaugccagacuggguuggcguugaaaugcucccugcagugggcugguggggcuuugggaaaagcuucaucagggaagccuucccagaggaggcagcacugguccuggaacuucagugcaucugugaacagcagaugaccaacuguuuagugagagggacaggccuccaaagauguaucgugaggcaguacuccacuuccugcugugucucucacaucaccuugcuucugcuggcuccuucucagguucuacuguggacugcugagaagaggauuaccagcagcccaaccugaccuccucacagugcuggaaucaagcgagcaggaggcccuauccauuucagucucucuaaagcacauuucauuggagggcucugauuggccaagcucuggucacaugcccaucccauagaccaauccugauggacccaacuaugggauggagguuaaaaguauaagcucaggagcccaaucauuuggguucaaauccuuagcugugugaccuugagcaaguuauugagccucuugggccucaguuuuuucguuucuaaaauggagguaauauuucagccuugaaagguuucugugaggauuaaaugagauaauacauguaaacagcuaacaguagugccugggauauaguaagugcucaacuaaggucagcugccaugauccaucaucaaguuucaugcuuuucagccacgauugcguccuuugccuuucuugauuuccuccaucuuucaguagcggagaaaccccagcaauuacaccuguucagcuguuuccuuccugaaucagagagaagcuaaggucggggcagcugaaguccaccuucuccuugaccacagggccagaccccaguauauccagcaaaacccuauccauagaacucaauuaugugugucuccuccuguccucaaguccccagaccucuuuguggcuaaucucaggggaagauuuugguggaggaggagagaagagcugacuucucucgucugguuccuucccaggcauggcucugugagcgcugaugaggcugcccgcacggcucccuuccaccucgaccucugguucuacuucacacugcagaacuggguucuggacuuugggcgucccauugccauggugagugugaaauggugcacagggcucugaccagcacugaggacacuuaguguggcuugaauuugccgagugaccuuagacaagucacuucuccuuuaucuccuaguaaacugagagaauaggccuggaugccuucauauccuuagcucuaugacuuggcccgucaggcaacugccagcaaguggggggccugaagagucauacuuugccccaacucucaugggggaacuggugguccugaacagucauacuguaauacuguaacccccucuggccugugucuggaagcaggugaaccagguugaaccaaaucaccaagacagacaaagggguauaggaaaggaaguggagcaccgcacccccaccuccgucuccccuguccuuccccauuaccuugggauaguauuauuuuuucuggaguugaagggcguaggcugauuuugcauauuauauaugacugugagccauggguaauuuuuaaugccauccagugaaaccauccccugccuuccaaggcuacuucaugcuuuaguauccagugguggccuccacagacaagauuaaugcugggagggcaccagugccccuugcuuguagugggaggauggaagauagauagguagguagguagguagguagguagguagguagguagguagguagauaauugacagaugauagauaauaaauagacgaacgugaagaaaauuaagugagauaucaccagguaucaagucauuauuugguagugggggcacagugugacuauucauggcccccagaccccucccacccaacuugcugacaguugccugacgggccacagucauagagccaaaagauaugaaggcauccaggccuauacucucaguuuacuggaagauaaacgggaagugacuuuucgaaggucacucagcaaauucaaguguaaaaauaacaauauccagugcugaaacuggcacuuuguacauacuagugaucaugcaaauuagcaaagcccuuuuggggccgggcaugguggcucaugccuauaauccuagcacuuugggaagcugaaacaggaacaucacuugagcccaggaguuugagaucagucagggcaauauaaugagacccugucucuauaaaagauuuguaaauuagcuggguguggugaugugcaccuguagucccagcuacucaggacugagcugggaagaucuccugagccugggaaguugaggcugcagugagccgugaucacaccgcugcacuccagccugggcaacacagugagacccugucucaaaaaacaaaacaaacaaaaagcaaagccuuuuuggaaagcaguaauaauucauaaguaacaacuuggcaagauuaguacuuagaauagugccuaacacaauaaguguuuaaugcauuuuuacugaaugaauaauaauuauagcaaaguuagaauaguggcuaacaucgaauguuuacucuguucuaagcucuuuauguguuucaguuuauuuaauucucauaucaacacuauugcugaucucaauguuauagaugaggaaacuugaggagagagagaauaaguaacuggcucgaggucaagcauagaggccagcaucugcccaggcauucuggcccuggagccccuuucugacaagguugaauucucugucacauaaauauccagaauccuaauauauucaucccucugacccaguaauacccuuccgagaaucugcccguagggauauaaucagcaagaagacagcaguuuccucuaacucaaagauguucauugcagugguguuuaugauagccaaaccuuagaagugacuugcguguccagcauuagggacuggguaaaucaguuuugcuauguccauuauagagaauguuuccuggcaauuaagcagaaauuauggauacuauagagcaaccuggaauauuuaaggagaaaaaagguuccuaaaugacaugcagacugacuaauugcaagucaauaacgagcuugucuaccugggaucaaagacuugauagguguaaagaaaagcuguccuggcaaugcugucagggagugauggugggugcugguucuccuuccugcagucuuuuugaagguugccuuuuaaauguggaaaaauaagaggaauugagccaagaguuggggcaucugguuggguuugugggugaccuagggcaagucacuguccugggcuucauuucucucuccaagaagacuggcuggacuggcugcucugaaccuucuucuagcaugaaggaaccacauacugggggccaaagaagcugcccaucaaacuggugcuagagagagagaugaggccaggagugggcucguggcucccuucacucacuaggacccagcuucuacuggcauaacagggucuccuauugggcaaaucacuucccccauccugcuuagagcugcugugaccacuguaacccuaaguaggacuugguggaacguagacauuugaaaagcucuuguauacgcuagagauuuucaaauguaugcauaauaguugcaaauuuguuaaaaacaaaaacauuuacaaguuauaaaaguaacaugucauagauguaacauaguuguaacauaaagaaguguuagacucucccuaccccuuuccugucccacugcugacaguuucgggaacaccccuuucacucuucucugcuuguacaaacacauauauacauccuuuucccuucuaaccauaaugggauuuugcuuuauacuuuauuuugcaaccugcuuguuuuccuuuagaauauaucauauggugggcaugguggcauguaauuccagcacuuugggaggccaaggcaggaggauugccugaggccaguccuggcaacauagcaagacccuguuuuuacaaauaauuuaaaaauuaauggugcuuggugccuggcaccuguaaugccagcacuuugggaggucaaggugggaggaucgcuugagcccaggaguuugugaccagccuggucaacauaaggagaccucaucucaauaaaaaagaaaaaagaaaaaaaaauauagcucucucuccaugucaguacauauaaggugucauuucuguuaauggcuacuuaaccuuccaugguaagaaguacuaucagggauucaacugguccuguuugauugaagagucagccuauuucugauguuuugcuaucacagaguauuuuagcaaguauauauaugauguagguaaagaggcagauaaacacaugcacacugaguaagagagagagagagagacugagauugcugcauucugugaguuuuauuucugcggguuuaguuuauccaauauggcauuucuguguuaaaagagagaaccaucuaaauccuuccuugaaacuugugggccuuauguguguuuucaaucaacagauacuagaaguacaguuuggggguugugaaaugcuuuaaccccgcauagggguuuucacacuggccuggacaaggccagggcucagaagagagagcauugcagaaggaggaacugccccuggccugccuuccucucucugggaaggaagaguugcagcuacuuuguagagcauucuuguuuucuccuuugucuccuaacguguacuuugaaccugguuuggaagcagucccuccacaucagggccuagcacucaggagacugaucuggcacucaggagcgccagaacccgaacgguccaaguaggcccucugggccaccucucuuguguuauagauggggaaaccaaggcccagagaagggaaguauuagcccagggucacccagcaaguuggugccacaacggagucccugagaagccuaccaacucccaagcuggcaucagggucauuuauuugguaucugcugggugaggggcacagggucaggccuugacuggaauugcaucugcucugugucuggggacaaguccguuaccuccucugggacucagcuuuccugucuggauaaaccuuugucccaaggcugccgagaagguccagcgaucacaggaagaauuaaguguacaugaugggguggggggugaaaggaguuggggugggcggcauuaggggcagacucccuugaggcccgagggccgcguggggcugugcccaggugagcccauucuuccauuugcuccgcagcugguauucccucucgagugguuuccacucaacaagcccaguguuggggacuacuuccacauggccuacaacgucaucacgcccuuucucuugcucaagguacugucccagggcccccacucucuccugucauccccauucuuugcacaccuggcaggaaggugaugcuaagcccuguguccugacucaagcacgcuccugccugcugcuggggggugaaggcugugacagagcagcauguccagggccuggggcccggggaaggcggagcugccgguggccuggagggauggaaaauaugccccaagaaagggcuuuugauuugagccucagccuggcgugccagugggggaagcagagagguguucagguagaaggaccuaaagacaaggcugugcuugggaaaccguaaaacauuuggggaggcugaggcagaagugacuggagguccagggagaggucaaggacccacugggaagagaggaagaagccagguggcaggagaggcagcagcagcagcugaacuccauccucugcccuggagagcccugagaugucacugggagcacuagcaggaacugcuggcuuugcacuuugccaaguaaggccuuuaaaacuacuauagguugagcaucccuaauccaaaaaucugaaaucugaaaugcuccaaaggagucugaaauuuuuuaagcacuggcaugauacuauaaguagaaaacucggccaggcgcgguggcuggagccuguaaucccagcacuuugggaggcugagguggguggaucacuugaggucaggagccuggccaacauggugaaacccccgucuccauuaaaaauagaaaaaauuggccaggcgcaguggcucaugcguguaaucccagcacuuugggaggcugaggcgggcggaucaccugaugucaggaguucgagaccagccuggccaacauggugaaacuccaucucuacuaaaaauacaaaaaaaaguagccgggcaugcuggcaggcaccuguagucccagcuacucgggaggcugaggccagagaaucacuugaacccgggagguagagguugcagugagccaagaucacgccauugcacuccggcccgggcaagacagugagacuucaucucaaaaaaaagaaaaagaaaaaaauacaaaaaacuuagggccggcaugguggcuuacgccuguaagcccagcacucugggagcccaaggcaggcagaucacuugaggucaggaguucgagaccagccuggccaacauggcaaaaccucaucuccauuaaaaauacaaaaaaguuagccaggugcgguggugugcgccugcagucccagcuacuugggaggcugaggcaggagaaucacuugaauccaggagguagagguugcagugagccgagauuccaccaccgcacuccagccugggcgauggagcaacacucugucucaaaaaagaaaauucuacacauauguacuuaacacaaacuuuguuucauguacaaaauuauuuaaaauguuauauaaaauuaacuucaggcuguguauguaaaguauauaggaaauauaaaugaauuuuuccaggcaugguggcucacaccuguaaucucaauacuuugggaggcugauacaggaggaucacuugaggccaguaguuugagaccagccugggcaacauaguaagacccuaucucuacaaaaaauuuaaaaauuagcugggcauaauggugcacaccuguaguuccagcuacucugggggcugaggugggaggaucucuugagccacuauacuccagccugagugacagagugagacccugucucaaagaaaaaugaaagaaaugaauuucauguuuagacuugcauaugcauucccaagauaucucauuguguauaugcaaauauuccaaaaucugaaauuugaaacauuucagauaagggaugcucagccuguaucaccauuuacuaucaccaucauuuuguauugaagaaagauacuucaaaucuccagaaguaggagggguauaaucccagaacuccgguguguuuucaguuaaacaguggcauuucagaagcaccugcccccaucccugacauuuucuucauguuugcugggaccacucagaaaucagaaggugccuucagcaggcugggccagccacccagggacacagccagggacagugggagggcugggccugagccuggacuccugcacugaaggcugggcuguccccuccagccuacagcucaugugugacuuugggaaaggaguugggcccucuggucuuuuugcucccuggguaaagucagcggggggugcugcuccacauucccuccgggguucauaggggucacgggaggaucuggaggcugggcuggccugcuaaagggaccagccacuuuuuggagugacauuccagcuggaagcguccaucccaccccaggugugaggggggaagcagagggugucacauacugugacagagguggggucaugcugccaaccccacucugaaccccagcucaucgagcgguccccccgcacccugccacgcuccaucacguacgugagcaucaucaucuucaucaugggugccagcauccaccuggugggugacucugucaaccaccgccugcucuucaguggcuaccagcaccaccugucuguccgugagaaccccaucaucaagaaucucaagccggagacgcuggugaggccaccuccugcucccugccuguaagcccuaggagcacagucuguccugggaggcugaagaaauggcccccaccccucgccgcaccuguccuuucaccaaaggcauucugcuaggugagggcacugucgccugccccaagcuaggaugcucaaguguucuuaggaaguggugcacagacugccucccaccugggccccuguaacagaaggcgaggccccggguagggaauaaggcagugggggaggccugggacugggagaaggguggucagaggggaugcuuggggccccagcaccucccuggacugacaucgacaucccccgacucugcccugcccguuccucccucagaucgacuccuuugagcugcucuacuauuaugaugaguaccugggucacugcauguggugagugaugggcccaucugucuaucccaggggccccaacuaccggcuagcccugucacuggcucagggacacacugagcaaggcugucugggcugcgggucuccauguguugagucucauccccuguaaaggcacugugagcucaaccuccagugaaguuguccccgagguugcccgggagacccagcugcugucccaggcuccaggccccggcuuccagccagcauccccccagcaucgccacccccgcccagcccucagugcccgcuguggccagcagagggcagcgaguggcuuugguccuuccucgccaagccugagcccugagggugggggaggaggacgcgucccugauaaacaacccccagauggugauggcagggggugggggcacagccagggacccccacccgugucgggccugcucuuugggaguggaggaagcugcggggagccagcuggaucaggcuggggaggggcgugcuguuugcgcuccccccucuucagaacucccagaggggcaccuuuuccuaccuaccccgucccucagucgggggagaccucagaaauguggucucagccucaggagaucccgggcccaggcugggaggcuucaucuguuccacccucccaucuuacccaggagaaacugaggccagagggaggagggcuccgaaggcugcagcugggaggugagggccagcccuggacccggcucacuccugaguuggugcucacagcacacgcacccugcacgggcauuuccaggguguuucgggcccugcgaugucaauccuccuggcucagcugguccagggucccuggacaggccuccugccaucuuucccuggccuuugccagagccucuucccacagaagguuggggaaggguggaggggcuaggaacagagagcuggagccccagcaggaagggggugugggugagaagaggcaggcggguauacuggugaaagcacaggugggagaaagggagccgguguguggagaggggagaggguaguauuuuggggugaggugucugagguggggguggggcugugugcugagagugggugcagugcuucaccaagaggccccugcaggugcuguucucuuuuuuaacauguggaccuccauccucagcccgggaggugccucugucuccaggcuaguguggugcugggcugcuggugucugcggugcaugagacagacaaccccccagacaccccuuacccccacggagugagugaggugcccugggcgguguggaugccucugggccucugacucacacgugcguugccuuccuguuucuguuucugucccaccuuugacgcccagcacaggcaagguuggguggagaggagcgccucucacccaggcuaggcguuuuguaaacugugacguggcacuccaugagaccccaugggagugguugcagagguuguggggaagagggccgcugagcaggccucuaagacacuggccuuccugucacagguacauccccuucuuccucauccucuucauguacuucagcggcugcuuuacugccucuaaagcugagagcuugauuccagggccugcccugcuccugguggcacccaguggccuguacuacuggugaguggacaucagcaugggggcagaggcaggggcacugagagagccacggcagcaaaauucugcacuugccaauggaccugcuguguggccccagggagacuggcccucuuugggcccgugcuucuucuugugucuaguggggacugugacaaugcccugugguggccucuuuguuuccaugaagcccaggccuggguguggcagggaggugggaggagagggcgagguugcacagucugucuccauccucaagccccucucgcucugugccccaucucaagaaccccaguguugcccuggggccgguacaauccaccuccgacaccaagcccuguagugggcugcgguuuccaccucugugaaguggggaugaugguaccugccugucugccucucagaugaugaggaugcugaggacagagaggggcuuugucaaauguaaagcacuauggcgaggccagacugggggguuucauggcguaggggcuucuggccuugggucuuuguucccucuggcucucucuucuucccauugcagaggacuuaggccucagccagucuccuagcccucgucugucacuucugcccuggagacaggucacccugggauuguggguaucaugggaaggacagggucggggcaggacuggacccuucucugaugggaggccucccucaaaaugaaaagggccuccuuuccugggccagcucuagauccucuccccggccuguccccuauguggcugagauggcccacuggggcucaucuguaugcucucuggggauuaaaaagaauggguggcagcuacagugagcgggaaagacguuaggggagcgcuuccugcugguucuuaccccggcauccugccgcggggguggcugccgucguaauggcaauuguuuguugcuuucuccucuagucaguuuuuguuguguggaaguauaaacuuaaugugaccagagaagccagaaauauacauuuguagguauucuguuauuuaaauauuggcaacaaacucaacauuuaaaaaacaguaacuauaccagcuaaaucaauaugcugcccaugggcuguggcuuagagcggcauaguucucugagcccuggcaccagaggacucuucugccugccuggagggcagccuggcucucgcacacaggaagggaugccaggcaggacgggguugccacggcagcugccucacucaccccuggccuuuccagguaccuggucaccgagggccagaucuucauccucuucaucuucaccuucuucgccaugcuggcccucguccugcaccagaagcgcaagcgccucuuccuggacagcaacggccucuuccucuucuccuccuucgcacugacccucuugcuuguggcgcucugggucgccuggcuguggaaugacccuguucucaggaagaaguacccgggugucaucuacgucccugagcccugggcuuucuacacccuucacgucagcagucggcacugagucccuggcaccaggcucuggcgcucugcugggugggagggugggccauggagggcaucugaauacaggaguaggggggguguggguguguaaccagagaccgagagcaugaguggggugugccucgugugcguggauucgugugugugugugugugugucuuguauaugugugcgcagagugcaucauuuucagacucuacuauuuccgucaaguuucuguuugauuuggaucaucucaggaucggauucuguuuuagaguguuucugggccaggauccgggccccugcccuccucugcaccugaccacacucccuacucagggcuagucuguucuucccggacaucuucugguagccgugcaggagagggcuggguggggcagaggccaggaggggaccuggugugucaccugcccaccaccuggcucaucccucaggcccacccugacccuacauuacauagguuacgucagccuacuguggcuguugagcaaagcauuucuccuuucugggccucauuugcacuagaugggccuguggucccaaaguaggucaguagguugggguugcugacaccccuugggugcagcuuugggacagaugaguggcucuguccugucacugcccucucccugccugggggcuaugugcacuccagaccccugcccaggcucaggcccaugagguauggagacacccuggcccccaggagcuggaggcaccgcccacuccc

SEQ ID NO: 16042 - RNA, 11024 nt, Homo sapiens
cgcgccgucacccggagagcccggcggaucccggacucccgcccgccgcuccucccgccgcgcaccuccgcucaccgcucgcccggcuccagccgccgccgcacugugaguacccacguccgguagcccgccgcccccgcgcucugcuccugcagcuuuuuuuucguuuaguucugauuugggcuccuguggcuguuguuuuuaugauuauaccuaaagacaccaccgccucgcucccaccacugccagucucccgcuucgcugcccuccccaagcucguccaucuagcuccgggagccgacggggguuccucaagcugcucuggcugcugcuccuugucgcugcauauggcucuucgccugugcuuuccgcuuuggcccccgaaauuccguuccuuuccuagggacccccuucuucugacuccgggcccggaccccccuccucucacucagggaaaaccgcgcagggacccaggacccucaacugggguacgcucucggcucgggcgcugucuucacuguaugcgggccaggcauaguugccgauuucgagaaaccgagaagcugucauuucccagcgcugcgcgcccuccagccaccuccaggagggcgcgaggcuugucagccggggaguuaggacaguguuuuugccuccuacaaugauauaaaggacuucaacgcgaaauaagggucaacuuauuuuaguucgauccucggagauaaagaugaaacagacagauaauacauaaauagcuugauacuugaagaagguacaaaacagaugagagaaagaggaacgagccggcagagacagcucagggacagauaagaucgacaaaugagggucuccuagacaaauagagaagaagggagagagacagauaaacagaagauuccagucuccuugcugaaggcuuuugaacugggauccccugucuggagcugccccucugaaaacggaguuacauucagggccgacugcaggggaggagcccucaggguugggcugcccuggccgcaggagcgccugcagccuugggccggaugggagccuggcuugucugaggacauguggcugggucaggcgaccuagagggccccaaacaucaguccccaaguacccccgcugcugaggucugccugcacagcucccucccugccucagccagaaagcaaagugcaaggaccagcagcaacuugugugccuggagccuugcaauggcuacgaagauggcugagauuccuucuagcccauaugagccgggacagcgaggcaugaaggauacucagagaggugaugccccucaaagaggaagcccagagccccgaauccugcaguuggcccgagugggaaacguauaucugaaggaggaaagcucaaggagugggcgacuggaagcuaagaaguggaucccaacaaaguuccuugagaaccucucugucccacacguugaccucgguggaaaccagcuuuggucuggaauacagcuaaaaaugcagaaaaugugguuagaacugcaggauccuggucucacuaauagcuggaaagaaaacgguuuauauauccagccgaaaucuuucugcucaacgaacgcgggcgccagccgugagaggagaagcucggguuuguggaaacuggcaauguuguccccugaagccggcucgggcaccaagcugggugcggugggggccgcgcuagguccgggugcgcaccgagcgcuuuggagagggucagguucagcaccgcgaacagcgguagccuccgccucucuccuucccuggcagacacgguucccuccuccuucuccucaccccccuccuucucuucaccccccucuacccccugcugucuggagaugggcagugaccgccccuccccccuccccaccccuccuugcacugcccccgcccgcccgcgugcaugcgcgacugagcagaggggcggccgauccccgaaguccgggcuucaggacccgggccggcagcaccggcugcgaggguugccgaaggcgcacggaucugggcgcugaaaaagccaggauuuggcaauggcuuugcuguguggccuugggcaagucacucugcguaucuggguuucacuuccuucccaauccgaaaacgggauuggguuccuugcagcccgggcauuccugaggucuccuuuaccccuucuccucccccaagccccgggggcuguuguuaacggcgccaacaugggucugaguaacaaaagacgccuguccagggggugaaugaguuuggacuccccacugccaaguaucccccgcgcgcccaacucggagcgcccugcugggcgggcccgagccucggcggcggcgcugaaaauggcucaucugcucucugcuuucucuauuucgcaggagcggcggcauggaggcucucaccacucagcuggggccggggcgcgagggcaguuccucgcccaacuccaagcaggagcugcagccguacucgggcuccagcgcucucaaacccaaccaggugggcgagacgucgcuguacggggugcccauugugucgcuggucaucgacggccaggagcgccuaugccuggcgcagaucuccaacacccuccucaagaacuacagcuauaaugagauccacaaccgccgcguggcccugggcaucacgugcgugcagugcacgccgguacagcuggagauucugcgucgggccggggccaugcccaucucgucgcgccgcugcggcaugaucacuaagcgagaggccgaacgccugugcaagucguuccugggcgagcacaaaccacccaagcugcccgagaacuucgccuucgauguggugcacgagugcgcguggggcucgcgugguagcuucaucccugcgcguuacaacagcucucgugccaagugcaucaagugcggcuacugcagcauguacuucucgcccaacaaguucaucuuccacucgcaccgaacacccgacgccaaguacacgcagcccgaugccgccaacuucaacuccuggcgucgucaccucaaacucagugacaagucggccacagacgaacugagccaugcuugggaggacgucaaggccauguuuaauggcggcacgcgcaagcggaccuucucccuacaaggaggcggcggaggcggugccaauggcgggucgggugggcaggggaaggguggugcuggcggcgguggcggcgguggcccagggugcggugcagagauggccccaggcccgccgccccacaaaagccugcgcuguggcgaagaugaggcugccgggccuccggggccaccuccaccccacccgcagcgcggacuuggccuggcgacuggagcuaguggcccggcgggcccaggagggcccgguggcggcgccggcguacgaagcuacccggugaucccggugcccagcaaaggcuuugggcuccugcaaaagcugcccccaccacuuuucccccauccuuacggcuucccuacggccuucggccuaugccccaaaaaggacgacccgguuuuaggcgcgggcgagccaaagggcgguccuggcacugggagcggcggcggcggcgcggggacaggcgggggugcggggggcccgggagccagccacuugcccccgggggcaggggcgggcccgggcggcggcgccauguucugggggcaucaacccuccggggcagccaaggacgcagcggcaguggcugcagcggccgccgccgccacuguguacccgacguuucccauguucuggccagcagcaggcagccucccgguaccguccuaccccgcugcucagagccaagccaaggccguggcggcagccguggcggcggcagcggcggcggcagcggcagcugcuggcagcggugccccagagccccuggacggugccgagccagccaaagagaguggccucggcgcggaggagcgcugcccgagcgcucugucccgcgggccccuggacgaagacggcacggacgaggcgcugccaccgccccuggccccguugcccccgccgcccccgccgcccgcacgcaaaggcuccuacgugucggccuuccggccgguggucaaggacaccgagagcaucgcuaagcucuacgggagcgcccgggaggcguacggcgcggggccugcucgggggccgggacccggcgcugggagcggcggcuacgugagcccggacuuucugagcgagggcagcuccagcuacaauuccgccucgcccgacguggacaccgcggacgagcccgagguggacguggaauccaaccgcuuccccgacgacgaggacgcccaagaggagaccgagcccagcgcacccagcgcagggggcggcccagacggugaacagcccacuggacccccuuccgccaccuccucuggcgcggacggucccgcaaacucucccgacggcggcagcccccgcccccggcgccgccucgggccacccccagcuggccggcccgcauuuggggacuuggcagccgaagacuuggugcggagaccugagaggagcccgccaagcggcggcggcggcuacgagcugcgagagccuugcgggccccuaggaggccccgcgccggccaaggugagccccgcgcccgccccgccaguggcgccuucccaccuacccugugcgcggcagggcugcggggccgggcggagaacgggaauuuuguuccgcgcaggcgugggagcagcaggccucggccacucuccgcaggcccagccuugggcgcgcugcgaaacugggcccacccgcacccuccagugaggguuucgaagggaagggaagcugggggcggcgggaggacuggggaacuugugugcuuuguuuuuguugaugggaauggggaggagaccggcugagacugccagacacagagacagaaaagggguguggagaaagaaagaggagguaagaaaggaacccagagccagagaaaagcgcucgcccgggugggcaucagagccccaaggaagaggagaagagaggacaguguggccucucccugagucgggccccagcaguaccggguccccggaaucucccaccaccccaacucgcaguuuuccgagucucuucgcacucccgccuugggaaccacaggguucguugcugggaagcugucucgggaccgcgugcggagcgggaggggggcucucaagcuggcagggccggggcuugaggggcaggaugcagccaggcuggagucguuggccauuuugaaagugagugcgcauaccuguacauucgguucauuaaaacacgaaucauuaaccggaugcgaaaggcgucauuuaugccgcggacggggcacuggcgggagggaaaaugccuaaaaggaggcgggugcagaggguggaggacacuuugaacgccccucggcuugggagccgcuuuguguuuagaguaauuuucccgagggcgcuaacaauuacccugaaucuacaagggggcaagggugcgccgcgugcgucacugugcccgcucaaguccagcgggcgcaccaaccuuugccacuccgucggcuuucccucuuggccgcgggguagggcugggcgucuuugggccgccgcagggcgccacccuaaucgccugucauuucucggccgucgcagguguucgcgcccgagagggaugagcacgugaagagcgcggcgguggcgcuggggcccgcggccuccuacgucugcacccccgaggcccacgguaacgccugucgcggccgcuggccacuguaaugggggaaccgcagacagagggccggggucaaggaaggccugcgaaggaagacaaggagagagacgcagagaaagagggagagggaaagaaaaauaaugaaaacaaggaagcuaagcuaguacucccaacaacuuccaaucuuuaguuacuuaaaaacaacagugacaacgcccucuccaccacacgcacacacaugcugcaguacacccagacacggcguuaaacccuuaacaaaaucacgcccgacacggccuucaaauccucucauuuauucagcaaguguguuuggccgcgggguccccuuuggcuaggccggaucggggcggaggaugggggcacauggccgcgcgcuuggguaccccagaagcgccaggguagcugaggcccaucgcgggguggugggggccgcccugcacuugcgcgccuuaccagguuccucacagaggagggguugggggcagcggaaaaucgggcaggucgaggcagccgaaccccggacgauguccccccacccaccccgaaggucgcagccugggccgcguucucagcaggagucgggcggacagacccggcggccacgcgcgcucgcggugccccaguaucugcgcgcgauguaggucgcucgucccuggugggcucggcugcucgccuagcucuuuuccaaggggcuggggcgggggccugaagcccggagaugagcagaccaggcgcggggguggggggugcccggcccaaagccucagggcgcgcuccugggcgcacagccgggaaccagaggcggccacgacgcuuuuaauuagggcuggggcgccccgaccgcggcagcuccggcaguauccgggucacgguuucuuugccucucuugaaauucgguuuguugccuucaagagccagauaaggaagacaaucacucgcccgccgaugauuuggaaacgaggaaauccuauccagaccaaaggaguaucucccagccaaguccugcaaauacagacagaggugagccagcccuugaacccaucgcucuccaccgcacccaggagcugggacccaggucgcccagguucccagaggcuugcgagaaaggcuuuuaaucaaguguaagcggcugccagucuucuuccucggcgagcagauaaauauuuaacgcgagcagggugcaggccagguuuucugaauugcugccuccuugguggguuugagguucuuucagguaagggcagaggauguacuaaaaggaaauggagggacguccucacccacauaaaauaggucaaagggcauuuccugcccuuagauggcccaucuucccugggccgucuccuccaggggucacucuccuacucucuacuguaauguccuagaagguggauaguacuggauuccuguaacugucuccucuaaaggcagaaggucuaggguaggucccugauucgaugugguuccugggaagcucaccccuccccucucaagggcuuuccuaggacagaaccccucuuaccugccccuguaucccaggcgaagaugggcuuaccuuggaugucacaggaacucauuugguggagaaagauaucgagaaccuggccagaggugaggauaaauuugugaaaaagguguacgcugugcuugagagugaugggucauuccuguagagggguguuaucccuguagggggugaguguggaaaagacacucaccaaggccuugggggcaugaguuuuccuuucuuuggguggaaaguaagauccucuggacacauuacccuggcacagagguauguauguguggguagagcaugggaguaaaacaaacccccagaaguuuauuggaaguuuggguucccaaggcccgggucugucugaauagccuugccagaaagagaaaugaguaacaaugaucagaauuuuugaugccuguggacaaucagacaggacagucuggguccgcugaauucaauggaaaacaggauuucaaugcaggauugcaggaaagcauuuauuuuaggaaugugagagguguuuuccuuucuccuggcauugagguauaaccaccuccaccuuacccuaaauggaguguggauggagcuuguuugcagaauggggaucccuguguuacugcucagccuguaaggaggagacuauggcuuggggugcagaguaggggagucccuagccccacuuugcccuucuaccuuccauucuugcauuucagaggagccucuccuggaggagggcccagauaccaaugaccucauggucagggcaguugccacaucuaucccucuggaguugguucugagggcacuaacagaggccucuacaccuagcucccugccccucaacuagcccauagauggucuugggaauuuguggcaggaggaagacaagcauugguggucuuccauucuuccuaguuacagauuuacagaaaaugccauuaccuucaaaaucacuggugcuuuauagugaggguucuuagcauggauuuggcagucuucagaccuccugaaauugcaggcaaacuguuguauguguauuuuucugggaaagguguccaaggcucugaccaaagccucccugauuuauauugaaagggcggcggugcgggggggggaggucggggccggggcgggggcggggucugucacuugaagugggaaaucaaguuuccgugggccagccucuuagguuagggagugaggaacaacuuaaagcaguugcccagcugcauaguuccuggagccagggccuagauuccaccguccugaauuuauucuccugggcauccuacccacagcccaguuucuucacccaaauccuuugaaugcaguugguaaagccagagagcggagggccuccaccuacuggucauccuucucaacucuccuuucaggguuguuggccaaggcagaaccugagcuccaaauaacccugcuuuaccucccacuuuaccucccacuuuuccccuuucacagaggaauugcaaaaacugcuccuggaacaaauggagcuccgcaagaagcuggaacgggaauuucagagucucaaagguacccacugccauccugccucaccccaccucaucaccgagccuuccaccagggugccccgaccuacuccgaaagccgggugccaggcaacugguacuaggugcccugcaggagacaagaaacuguccuuuuccagggcugcaggcgaauggcugggugggaguuggggguaggggugaaagggggggccaggagugagaaaguggagccgggagagggggcugugcguaacagcucucacuuaaucaauuugcacagauaauuuucaggaucaaaugaagagggaauuggcuuaucgagaagaaauggugcaacagcugcaaauugucagagguaagacgggagucaggugagcucgugcacgggccguaacugccucucgucuggcaggagccgcaauguuggcucagucauuuggauuuaaauugaagguaauuuaacaauuauuuuuuuauuuaauaugcuuuguauacucugauuagccucagaauggcaagcgagcccagcaaacggcuugcaggcaucauuacauggagugauugaacuucuuaucgcggcaauuuccaugguuucuaaauuaaaaaucgaggcguaaaauuaccugggaaguaaugccuaaguuugcuuuaauuuugguuagauccaucugccuuuaagcgccaucccaggccauuuccuuccuccgccagucugcaguuaggagcuccgguacccccucccccaucccuggaguuguuucugcgcggagcuuagcccuggggagaggaggaagcccgggcugugaccccggccuuucggaggguggucugcguuuccucacuggccccuccccuugucuuccagauacccuguguaacgaacucgaccaggagcggaaggcgcgcuaugccauccagcagaaauugaaaggugcggaagccgggaaacaaagauaggaggggugcugggugccggccgugcugucgacugaaugaaugaauagugggacuagugaggaaggccacgauccacguggaucaggaucugugagggagaaaagugggaacugauuuuaacgggaagauuauucuaggaugguggggguaaaaagaaagagccccuugggcuuuggacgucagaaaaaucugccuucuauuaccaauucuggcuuugagcagguugacuccucucuuacugugccucaguuuccuuuucuguaaaauggggcuacugaaccagagcagugguucugaaucaccagcuuuuguccuacccuccugccuccuccugauccgcucgguugagauucccugaccccaaaggguugguaaggccggggaggggaaaggguggacugcgcggugaggugagccuggagaggcgcccagagugacccucgcgacugucuccccagaagcccacgacgcccugcaccauuucuccugcaagaugcugacgccccgccacugcacuggcaacugcuccuucaagccaccgcuguugcccuagggccggccuggccgcaccccugcgcccucaagccaugcugcuccuuguaaauacccgcugcugcgguggcccugagcgaggaacaagccauucggacccgaccgauguaaauacagccgcccguccgcccgccuuccucccgggcuccccggccuugcccgcccccucccgggcgucccuguccagggccccggcuugguuuccaaguguaaauaccgccucgcgccucaaaucccccuaccccgugugaacucuagggcaucggaccucaagggguuaacuggacagacggggggcgggaggggagagcgcccccucccauuguauagccuugaacccgauugugaauacaauguagcaacuucgcuggcgccugccccgcacuccccgucccguccacuucugaaacuccuguuccuaaugacaaaguggcuaugugcaauggauauaaauguacugugagucucucgguucaguauuagguucacuuuaauuuauuuaugcuguaaguuauuuuugcuuccuucuccuggacccacuuccagucccguuuugcauuccccuuuggauuuugcuuuggcuauuuuuuguuguaaccucuugauguaacagcacuuuaaaagggcgacaacugacucacgagauggcaaccaccuggagccuguuuggggagaccacccuguacccgugacuuucguuuuuaauaauaauaauaauaauaauaaaagaugucacuucugggg

SEQ ID NO: 16043 - RNA, 1843 nt, Homo sapiens
uacauucgguucauuaaaacacgaaucauuaaccggaugcgaaaggcgucauuuaugccgcggacggggcacuggcgggagggaaaaugccuaaaaggaggcgggugcagaggguggaggacacuuugaacgccccucggcuugggagccgcuuuguguuuagaguaauuuucccgagggcgcuaacaauuacccugaaucuacaagggggcaagggugcgccgcgugcgucacugugcccgcucaaguccagcgggcgcaccaaccuuugccacuccgucggcuuucccucuuggccgcgggguagggcugggcgucuuugggccgccgcagggcgccacccuaaucgccugucauuucucggccgucgcagguguucgcgcccgagagggaugagcacgugaagagcgcggcgguggcgcuggggcccgcggccuccuacgucugcacccccgaggcccacgguaacgccugucgcggccgcuggccacuguaaugggggaaccgcagacagagggccggggucaaggaaggccugcgaaggaagacaaggagagagacgcagagaaagagggagagggaaagaaaaauaaugaaaacaaggaagcuaagcuaguacucccaacaacuuccaaucuuuaguuacuuaaaaacaacagugacaacgcccucuccaccacacgcacacacaugcugcaguacacccagacacggcguuaaacccuuaacaaaaucacgcccgacacggccuucaaauccucucauuuauucagcaaguguguuuggccgcgggguccccuuuggcuaggccggaucggggcggaggaugggggcacauggccgcgcgcuuggguaccccagaagcgccaggguagcugaggcccaucgcgggguggugggggccgcccugcacuugcgcgccuuaccagguuccucacagaggagggguugggggcagcggaaaaucgggcaggucgaggcagccgaaccccggacgauguccccccacccaccccgaaggucgcagccugggccgcguucucagcaggagucgggcggacagacccggcggccacgcgcgcucgcggugccccaguaucugcgcgcgauguaggucgcucgucccuggugggcucggcugcucgccuagcucuuuuccaaggggcuggggcgggggccugaagcccggagaugagcagaccaggcgcggggguggggggugcccggcccaaagccucagggcgcgcuccugggcgcacagccgggaaccagaggcggccacgacgcuuuuaauuagggcuggggcgccccgaccgcggcagcuccggcaguauccgggucacgguuucuuugccucucuugaaauucgguuuguugccuucaagagccagauaaggaagacaaucacucgcccgccgaugauuuggaaacgaggaaauccuauccagaccaaaggaguaucucccagccaaguccugcaaauacagacagaggugagccagcccuugaacccaucgcucuccaccgcacccaggagcugggacccaggucgcccagguucccagaggcuugcgagaaaggcuuuuaaucaaguguaagcggcugccagucuucuuccucggcgagcagauaaauauuuaacgcgagcagggugcaggccagguuuucugaauugcugccuccuugguggguuugagguucuuucagguaagggcagaggauguacuaaaaggaaauggagggacguccucacccacauaaaauaggucaaagggcauuuccugcccuuagauggcccaucuucccugggccgucuccuccaggggucacucuccuacucucu

SEQ ID NO: 16044 - RNA, 54205 nt, Homo sapiens
uggugcagcccaaggcggaagcggcugccugacggaaccggcucgcgagcgcagcuauggcugcuggcguacccugugcguuagucaccagcugcuccuccgucuucucaggagaccagcugguccaacgugaguagauaggcgccugggccgaccuccaaggccccugagccucagcgggcgacggacccagcaccacggccucucugggccuuguccccgcagcgggcccugcguucuuccuccagucaguggaggcgcccagucuccccagguggcugccccuaucucuuaaucucgugcuuuucugcccacucggccuucuucggcguuccuuucggcuuccuguguaaagugagacugauuucccgcucugcucagcccaggccacagguuuuugcgaggauccguugagaugaaccugaaggcucuccggaaauugcgcuagguuacaggaguguaaggugcuggaauuguugauaucgugauguuguuauccuugcugcuccgggagagaguguuuacucugaauucugaaguuuauucugcguauuuacucugaaguuuauucugcuucuuaauguguacauuauaagacuuguuagcuuuguccgcuccacucuaguuauucacgccuuucaucugaggcaugggcucuccgccaacaugaguuuuuggguaugauugggcuagugcuuuugcuuguagacccucauaauggcugucagacuuacuaacucuuaaaagagagaacaugggacuggauaauaagccaacucuacuaaagggcucugugaaguugaauuauagguaacucaagacuucuguuuuaaguguauggcuuagaaucagagcagugacuuagcuguaugaucucgagcaagucaccuaaccuaccuacauuccuuccuucuuuucuuuuuuuuuuuuuaaagagacgggaacuugcucugucgcccgggcuggagugcagugaugcgaucauagcucacuucagccucgaacuccugggcucaagcgauccuccugccucagucucccgagcaacugggacugcaggcucacaccacgaacccuggcuaauuuuuuuauuuuuuguagagccagagucuugcuauguugcucaggcuggucuccaacucgugguuucaagugauccuccugucuuggccgcccuaagugcugagauuacaggcgugagccacugugccuggcuacccuucacuuucucuuuucucuccuuuuuuuuauuuuuguuuugagauagggucucacucugcugcccaggcuguagugcaguggcguuaucucggcucacugcaaccucugccuccugggcucaagccaucccccuaccucagccucccaaguaucugggacuacaggugugugccaccacgcccggcuaauugcccccccccccccccgucauacgggguuuggccauguugcccaggcuggucuggaacucccgggcucaagugaucugccugccuuugccacccaaagugcugggauuacaggugugagucaccaccgcgcccggccccuucaccuucuaucuauaaaauagggauaauuuucgcaagauugugcuuauccccgagucuggcacauaguaaacauuugauaaaucauagacauuauuauuaaggcacauuacuaucucuguaacccucaauuuccugauccuuaaaauggggcauaugagccuauuucaggaguauuugaaggacagaugaugugacauuuugaacacacuuuguaaacuguaaagcauuguauaauuauaauuucuuugcuacaccugucaaaugacagaauuagguaagaugucccuucagugcagauauuauaugacuuaguuaucauuugugaucacuuagaaaguuccuugcuaggguaaaagcuuaauuauagcauuuaacuaagugguuacuaacuggucuaauuaggccauuuucuuaccuuuaagcagugcuccuuccuauuuucucccuucccuccuuucuuccuucuuuucuuccuuccuuccucuuuuuucuuuaauuguuucauuguaaaacuagugcauacuaaguaaaauuuagcauacagagaaaagaaaauagccauagucucauuacccaacuacaaauacugcuaacauuucuuuccagucuuuuuuuccauugcaguuucuuaaaaagaaauaauuguaauuacauuuaauacacaauuuuuucuguuuuuaaaaauuuuuuaaauacacaguucuuauccucagauuuaucaaaaauuaguuucucacauauauccaucuagugaauaaaccagaauuugcucaagauucuuaaagauguaacuaacuuuccaaaagacuuacaugcauuaggaauccuauuagcgauacauggaagucuuuucaagacaaucucaggaauauuaauuauucuaaaugcuauggugcucuguugugugcuuuaaugaucccaaucggcaaacauggucccugccuugaaguagcugauuaccuguaguuagcaaauaguaacauuguacuucuguaaaguguauuagcauuauuggggguaaaauuaauucuguaaaauaauccauuuuaucucuguauauaaaaugcucuuagauaauuccaguucggguuaagaucagaugaccuuuccauugcaacucguuacugucguguaguaaaaaauaaaagaagaacagcuagugagcagauuacuugaauaaggaaaagugaaccauaaaagagggcuuauaauuucuuccaagguugugaauaggguagcaguggauagcguuaaaaugaaguauuugcugagcauucauucuuugacuauaauuaaagcugggauuaaauuaaucacagguugacucuaauuuugagguaagagauggagcccgcauaauauuuugucaaguguucggugauauuaggccguggaauaguuuuggauugaauuggaucuaccuuuuugggaaaguuugguucuacuucauguaucagcgagagaaaccuuuaggguucuccaauuucucuuucuuuggacaucugaucuaucuuagugcuuuuaaccaccagugggaaauauaaccaaguaacagcuuauuagaauuauucuuaaaacaguccaaaugcaguggugcaugcuuggaauuccaacacugugggaggccaggacgggaggaucacuugagcacaggaguucaagaccagccugggcaacauagggagaccuagucucuacaaaauaaaaauaaaaauguuaacaaauuagccgggcauagugguaugugccuuucguccuagcuccuugggaggcugaggugggaggauugcuugagccugggagaucgaggcuguagugaguugugauggugcuacugcccuccagccuaggugacagagugagacccugucucaaauacacacacacacacacacacagacacacacacacacacacacgcacuuaaaauaagaaucaguaggccucuacuaugcauaaagugcaugcauggacuucauuagaaacuuuuucuuuuugucacucaaaggccuuauuugcaguauucuggguggaugucugacaucggauaaaaggggcauuacugacgggguagauuuuuuauuuuauuuuauuuuauuuuaauuauugagacggagucucacucuguugccugggcuggagugcaguggcacgaucucggcucacugcaagcuccgccuccugggcucgcgccauucuccugccucagccuccugaguagcugggacuacaggcgcccaccaccaagcucggguaauuuuuuguauuuuuuaguagagacgggguuucacuguguuagccaggauggucuccaucucuugaccucgugaucugcccgccucagccucccaaagugcugggauuacaagcaugagccaccgcacccggcgacaggguagauuuuuuaaagggaaaugaagccucaggaugcuugagggacuuguaauacacgauaugagagcaaauaucuacuccauggccagagcucuuuccaccucacauauauuuuacaaaaguuuuacuuuauucuggaaaaguauauucugaugaauauuuauuaaacacagagacagucucuguuccaguuacugcagcuaaaauaaugccuaagauacuguuccugcccuugagaggaauguagaaaguguauccuccaugugccaggcaugguggcucacgccuguaaucccagcacuuugggagguuaaggcaggcaaaucacuugaggucaggaguucaaaaccagccuggccaacauggagaaaccccgucucuacuaaaaauucaaaaauuagcugggcacgguggugcgugccuauaauccuagcuacucagguggcugaggcaggagggucacuugaacccagcaggcagagguugcagugagccgagaucaugccacugcacaccacccugggugacagugggacccugccucaaagucuccaguaaagaaaaaaaagaaagaaagaaaguguaugguccaccugugaaaauauuaaaaugaagauauguaaguuuuaacaucuuacucuacuucccuagaaggaacuuuagauagaaaagucccuggaaacuuguuugguuuuaaaguguguaaugccaacucagcaacuguaguucauucaguuucuacaucugaacaaaauucuuccuuuuagugaaauguagaaauuuagagcucuuauaaucauagcaagcauuuauauguauaucuguacucuucccaaacauguuuucacauuuaguuuggucuuuguaucccugugaagguagguuguguccauuuugcagaugaagaaacugugcuuuggaaauacuaaaugacuugcccaggugcuggagcauauguucaaauucaggauuuauaugcauaggaaugugugaauguaauguguugagauuccuuagcagucagaacuauuuuaauuuaaggugguggcacugguguaagcaaugagagagacgauuaaccccuaaacgguuuuaaaauaugcucacauugccacuucggaugauuaaagucuuaauucugaauggaggggaaaaaaauuguugccaucgaaaccaauaaauggagcauuauuuaauauguguauuaaauuaaauacauauuaaaaaagagcauuaugcauaccugauagguagucuaacagugucuggauuuuuauuuucucaauugagugaacucagagaugcuauguauuggugauucuuaccguacaggauuaacauuaaaaauaaaggguuauuugagaucauuucuaacaucucuucuagauguaaaauucuguguuauuggccaggcaugguggcucacgccuguaaucccagcacuuugggaguccgaggggggcugaucaccugaggucaggaguucgagagcagccuggccaacauagugaaaccccaucucuacuaaaaaugcagaaauuagccgggugugguggugcacaccuguaaucugagcuacucgggaggcugaggcaggaggauuccuugaacccgggagguggagguucuaguaagcucagaucacgccacugcacuccagcaugggugacagagugagacccggucuuaaaaaaaaaaauuucuggguuauuauguuacuuauuuuuaugcaagauuuauauaaugcuucuuaacuugacuuaauguuuuuucucuuuuaguuuuugaaaacuuaggaaucaagccuuauuuuaagguugcaguagauggaguagaaaauuuaguuauggaguagaaaauuuaaccuuuuguguuugaaauucacaugcauuuacccauagaaauaacccuccgguccucagguuucugaaacugcaaaaccagaaagcacaauuauauaauggguaaacuaggccuuggagaguuacacaggaaagccagccauauucaugacauugcuucuuuggaaaacaugcauucuucugcaagauugggaauuuguuucuaggucugucagacuccuauacuugcaaaaguaucuugaaguaauuuacuaaagagaacauuguuauuucaaagguagaggcuauugugcugcuuugacaccauugucuagcaacagaauggggauaaaagcuugagucuucaaauguguguuuuucuguagcuucuuuaaguauuuugagugcacucuuugguuuacucugggaauaaguaauuuuuacuuaagcaaaguuacuuauuuuguugugguaagaggauucugccuuugauuggauuguauauuuccaugucuuuauuuucuucaaagaauggaagauugggccagcaagauguaccacaagggccuagaguugucaucacagagugauucaguagauggucagaugagggcagugauuucaacugaugacuggggugagggaacugauuguuuuuagcuaugauacuuaauauauuuacauuuuuucaaccaacauuaaaagaaggauugauuuuuauguuuauuaaaagagggagguugucaucaaucuaaagaggaggagaagcauaaauguucauacuuucuccagacccaaagggacuuaaaaaaaacauguccacauuacauuccaguauguguguaugugaaguuaaaguucaguaaagcugugguuucccaaaguuguucaguucccaaaagcuggggagcuaagauucaauuccaguucuauacauguaaaauauggucaacuuagcaacuagacuguguggauucagagugcagguagcaagcaguaggagaaauugcaguaggugauuuuacuauuaaaaugaaaacuauggcucucaaaaucaguuuacaauuaguuuauuuuuugaugguaguugaagccuuaguagauaaagugugauaaguuaaauaauaaaugaaaaugacucuauugguauacaguuuguuuccuuacuuguagaguagagaauuugacuuuucgugcgaaguuuuagacuagucuuuuagauauuguugaugugugaaaugauuauaagguguccuuucauuaaauggcauaccguaaaugaggggguggcggagaguaggaggagaaauaccaguggaaaaguauuacacaucagcccauauuguacaaaaccacuuaugauacagaaaauauuuuaucauccuggaggguucugagcauguuuagaaucagacuuuuauuucuggaccauuuaacugcuuuguuuuuguauggcaaaagguaaaaaucuagaaaguaugcaguggucauuugguuuaaacaacuuacugccuuuucucuuuaggaauaugccccaguaauuccucaacaaauaaugauacucaacaaauaaugcaaucugauauaaaaucauuuuuuguaaggucaaggugugucuggaauugguuccuuccaguggguucuuggucucauugacuucaagaaugaagccgugaacccucguugugaguguccggaguuucuuccuucugguggguucguggucucgcugacuucaggagugaagcugcagaccuucgccgugaguguuacagcucuuaaaggugguguguccggaguuguuuguuccucccaguggguucuuggucuugcugacuucaggaaugaagcugcagacccucacggugaguguuacaacucauaaagguaguacggacccaaagagugagcagcagcaagauuuauuguaaagagcaaaagaacaaagcuuccacagcguggaaggggacccgaacggguugcugcugcuggcuuggguggccagcuuuuauucccuuauuuggccccgcccacauccugcugauugguccauuuuacagaaugcugauuggugcauuuacaauccuuuagcuagacacagagugcugauuggugcguuuuugcagagugcugauuggugcauuuacaauccuuuagcuagacacagagugcugauugguguguuuuuacagagugcugauugguacauuuacaauccuuuagcuagacacagagugcugauugguguguuuuuacagagugcugauugguguguuuacaauccuuuagcuaguccccacucgacccaggaagucuagcaggcuucaucucucaaagguaugaaaauuguuuuaaauuuggacauaacauuguauuuauguuggagccaguacacacagauaccacaaauacguuucuaauaauucuuauucaggagucaauauugauauagauuaagauggaccaggacaguugugaaacuguuuuuucauuuuuuuuuuuuuuuuugagacaggaucuuccucugucacgcaggcuggagugcaguggugcaaucucggcucacugcagccuucgccucccgggcucaagugauucuccugccucagccccccgaccccaccgcaaguagcugggacuacaggcucaugccaccacaucuggcuaauauuuguauuuuuuguagagaagggguuuugccguguugcucaggcuggucuugaacuccugagcucagcugauccgcucaccuuggccucccaaagugcugggguuacaggugugagccagcgcaccuggccuguugugaaacuauuaaagaggcuuuaugauauuuuagguucaguaacaaaaaccuauuuagaguuuaauuuuccauacagaccugauggcugguuugacacagaaguggaaaaaagugucacuguauuuggaucaaacuccagccugcugagaucaggaaaauguuugaucauuugguaauaaacaacacugugaucuugauguaacaggguggcuguucugucugaauuuuccugggguuguauaggauuucugugggggaaaaaaaaucuguggauugaguacugaauucuauccuuuuuuaagcgaucugacuuuaaacaaguuaacuucauuccaugaauauugaccagauuuguucacaugugccauccauuguucuaaguaccuaaaauauuaugugucucacucaccuaccuuauuaguaauggggucaguaucucccaguuucugugguuuuuagcagcuuuuuggaauauaaguaguauacaaucugccuguuuuaauuguauaauucaguguuuuuuaauacauuuacggauuugugcaaccaucauuacaaucugauuguagaacauuuccgucaucccagaaggaacuuugugacuauuugcagucacuccucagcuccgugaaaccacuaauguacuuuuugucauuauagauuugccuuuucuacacauuuuauauaaauggaaucauaauauguggucuuuugugucuggcuucuuucacguagcauaauguuuuugaaguucaucuauauuguagcauguacuucauauuccauuguauggauauaccacauuuuguuuauccauucaucaguugauggacauuuggauuguuuccacuuuuuggcuauugugaauaaugcuguuaugaacauucuugugcaaguuuucaugggacaucuguuuucauuucucuuggguggaugccugggaguggaauugcugggucauaugguaaauuuauauuugguauuuuaagaaacugccaaacuguuuucuuccagaguggcugcaccauuuuauauucccauaagugaggauucuaauuucuccguaucuuuggacaauaacaauacuuguuauugucaguauuuuuuguuauagccauucuaguggaugugaaguaguaucucauugugguuuugauuugcauuuccuuaauaacucaugauguugaguaucuuuucauguucauauaguccauuuuaauaucuucuuuggugaaaugucuauucaaaucuuuuuugcccacuuuuuuuuuuuaacuauuuuauuuuuuuaagacggagucucacucucuugcccaggcuggagugcaguggugugaucucggcucacugcagccuccgccucugggguucaagcaauucuugugccucagccucccaagaagcuggcauuacaggugugugccaccacacccagcuaauuuuuuguauuuuugguagagacaggguuucaccaugcugggcagccuugucucacauuccuggauucaagcaaucugcccacuuuggccucucaaagugcugggauuacagguaugagccaccgugccuggcucuuuuuugcccgcuuuuaaauugguuuucuggucuucuuauuaaugaaaaaguucuuauauauucugguuacaagucccuuauugauauauaauuugcaaacauuuucuccuauucuguggcuuggguuuuguuuuucuugauggugucuugaaacacaauguuuacuuucaauaaugucuuacuuauuaguguuuuuguuuuccaugauucguugaccaucuguugcccaauaaugauuuuacccuccuuuggaugcugggacguuggaucuguuagcuuucugauauuuucuaacagaucaagcuuauuuucaauacuugaguacaggggcuacagaaugaauguucuucauuauucaucaaacuuauucuguuuugggaaauucaucucaaacauguuugucuuuuuuuagaguaaauuagcaucuacugcagauguugucauccugagcauugacauuucuuguaagguuuuauuacuucaugcuaauuuguuuaugaaaaauuaccauuugaauaugaaaauuauuuuuaucucguaauuguccuguuuaggcuuaugaauucuucuagaaaucuaccauucauagauuauuuucaaaguuucuaagguuaauugucaauaauuuuuaugguuaauaaucaaagaagacacuugagauagacuuuaucagagauagauuuuauuagauauaaauggaagauauuuuuaucugggguaggagguugugaugccugacuguaaugacuaguuucagcucuucaagaaagaauaaaaccaauuuugcauuccagaacuuuuauuuuguuucaugaauacagcuaaguaaauuccauaagguuucuuugcuguagaucaggguaucucagcuucggcacuguugaucuuuuggcccagacaauuccuugucuuguggggcugucuugugcguuguaggauggauguuuagcaguauuuuugaccucuacucacuagaugcuaguggcaucccccuauugugaugaccaaaaaugucuaaagguguugaccuuuguccccuuggcaggauuggggagaaucacauccccauagagaaccacugcuuuagggguauauuuagaacuagcaauggaauucagagaagugcccuaccccucuaaaauauagguaggaauuguccaucagaugugacacuaggauugacaaaguggucuuugcaugcagcccauaaaacuuagaggcugauguuuccugcuuaaucuuuauaaaacccuucuccauauucucucucccuuuccugauggcuucuuuauguucuugugugugugucugacugcauuguaaggucuucuaaaagcaagcagagacccccccacaaccccccugcccacugacuuuccccaauuauuuuaagaugaagcuguggugaccaauuccagaugacuauugggagaaaguaaacuugaggaaaaagaggaagacuggguuggauuuccucugcuucagcuuuaaaauguuuccacugugauauaaaaagcuuacgagcauguggaaaugcgaauuuagaguguaaccagagaaaaggggugugucaggaagagguaauuaaauguuguaagcaacccagaaucucuguacuauuguuaaagcaguauguugcuuuaagucaauccaguuacucuucccucagcaagucuaugcuacuccagugacucuuaccucagcaaguccauacuacuccagugaucgaccugucauauaaacugcaacaaauacugcauaaacuugcaccagaagacugggguaugauuacacagggaaucucagauaugaguuuccugacauuugucuguaaagucaacucuaauguugcacaguuuuaaccuuuaaauacuaccaugcuacaaagucccuuuccacuggagcaguauaaucuacuuucaguauuuagggacuaaccuuuucacaacuacugcaaaauauuugacagagcagcacccaccuuguaugacauucucaugaaguuguggguaagaaauuguaauugcuugcaacaguaugaauccgauaugauuuuuuuuuuuuuuuuuuuuuuuuuuuuuuuuuuuuugagacggagucucgcucugucgcccaggccggacugcggacugcaguggcgcaaucucggcucacugcaagcuccacuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccccgauaugauuuuuaaaagucugucuuuucgcuugcugguuaaugaaaacucuagguuuugaauuuuuccuaagucauauuuugcucaguucuuuucuuucauaauagcuacuuuuccuuucagcugacgucagacucugcugccuccuauaauuuuccuaauugccuucucuucugucucagcauaugccuuagcaguggaaaagaaaaauuucaacuuuauuuuaggggguggucugggguggaagggcaaggcuagagcagcuuaaaggagaugguuauuuccugauuguaauguaucuuacuaacuccucagugcaucuguaaccuaccucuagucaggagugcugucacaaaugugaaaaaaagugagaugggaagaaggaaaugaauauuuacugugcccagugccugcacuuucuuagacauaguuucauugaauucauuuaagccuuuugaggaguguucucauccccauuugcagguaaggaaaugagacaccgagagguuaaucugcccaaggcuuugcagagagccagcaugcaaaugcaggccuguccgaccccaggucugugcugucuauuuuccaugcucuucucccuucucguuaguacuggcuucacaaagggaagaaagaagaauguugggucuccagaagaguggaucccaugaaagacacucauaucuggggugagagguuaugaugcuuggcugucaaggcaguuucaguuuaugagaaagaauaaaaccaacuuugcauucugagaagagugcugguuuccggaaggaucaucuugauuugagguggcagcugucacuucccucagggcauagaaaauaugauuuaaccacuggacaacuuugcuucacaaagaaugucaugauugguuaagugcacuacuacugauauuaaaaguguacuuaauuacccuacuacugaaggagacacaaaaaauccauaacaguaucaacaugccuaguuuagaaugcauuugucuuuuuuggcugagguggauaggugaggacauaagguaaggguugugugugugcauguuuauauauagauaaaauguguguguguguguguguguguguguguguaggagaacagauauuugugguguuuggggaauucaccuugaacuucauguugccuucuaauucaugcuaaagagaguaucaccuguuauugauucugaaccauagaaagccagcugccucuuuucuuucauuugauugguuaccacauuuguacuuucucugagggaaggaucauuauuaggauaugcagggaacaguagaaagcugauuaaaaagaggaagauguuggauuacugaacugaaauguugccuuggcacauggcuuccuucaaagcucuugaaucuuauuuccuguaacuuaccauaugagauuauagggaaaagaaguugaccaaggaugugagaaaguaaaugggaguuacuggagaauugauggcuuuguaaaaaguuucucaaaucgggauagagguuuauacuugcacuuaauacugaaggaaagguuuauguuugcuacuagaacuggguuggcaucuaacuuccuuuguaaaagcacuacaaauuaacuauuguaagcugugaaauggaguuuguaguaacagaccuggcaaguaaacaccuaguguuugucucuuaaaaaaugauguauuacagcuccaccagguggcugccaacagugugaaugagacaggcuggcaucgaccaggaggaggggaaagcugcucuugauuuucuuugugcauaucggagucuacaacauaauaauuuagugaaggacaaagaagggagcccacugcagguuuuucuaggaagucuggcaaaaaacaaaaaaacaacaacaaaaaaaccucaagaucacugugacucaucuuugacauauaaauaccugaaugucauagacaguuuucugauggguuaauugugcugcagauccguauauaauugugccccuauucuggcuauuauuuuugguguuccuaaaagggcagaggauccuuuaggucuauagacuaguuuuggcuugugauuauuagagacucaagugugauccagcucaggugcuaaguauuguaacaucacgguguaguaggaaagaauguuggcgaauugaauccaguuuuaggcucugcuccuauuaggcaaguggcuucuuuuuuccugggccucaguuuccucaucuguaaaaugagugaauuauauuagcugcucuccagaaaccuuuagccaugugcacaguuugaauaauuucauuuuaauuuggaaaagaauaaacuuguuaagcauuugaaaaucaaauagaaaacaugagggaagaaagcuauauuuaguguagacauuuacauuuuuuaaauuaaacucuacauuaugauauugguaauaagaauuagaaugagacagucuuuacuauucucucccuagcucuaauauggcacagaugugauaauaaaguccauaugcagccuugaagaaaguguuugauuagacauaaaauguuaaaaaaaaaucugauaaguaaauugagcuaucaacuuguuuuaggcagcacagagaauaaaacaaaaaccaaagcccacuagcuacugaaacacugaaaugugaaauucauuuucccaacuuauugguuccauuccugucuagguuuggagaaaagagaaagaaacagcuucuuucuccauguuaaguaaaugucuuaaucauuugaaaaugaaaguauaaaauugaaauuguaagcacucugaguaacaaacauuguuuuguucuuuuguguucuaaacauuaauaaaauuagccaucauuaauggaucuaaauauuuuaaauugcaguuaguaauuuuaaauugcaguuaguaaugccauuuuaagugauuuuauauuucucaugucgaggagcaaagaaagcauaaccccaauuuuuugauaucaguuuuuaacaauacaaccaauuuaggaaauaucaagaacugauuauagcaaugacaggaauauuagucccccugccuuuguacuuugccccuuagcaacaagugaauucauuacuguauuuucuuauuugugcuucucuccuuuaaaaaauacucaguuugcuauuuuuaaaaauuacccaagaaugggugggcaugguggcucaugccuguaaucccagcacuuuggaaggccgaggcgggcggaucacgaggucaggagaucgagaccauccuggcuaacauggugaaacccugucuguacuaaaaauacagaacauuagcugggcaugguggcgggugccuguagucccagcuacuggggaggcugaggcaggagaauggugugaacccgggagguggagguugcagucagccgagaucacgccacugcacuccagccugcgcaacagagcgagacuccgucucaaaaaaaaaaaaaaauuaagacugauuuuaugugguggcuccuuucaccauuaaaaaguuaguuuauacauuuuuuugcuuugcuccuuguuuuaguuucuuucuuuuauauguguauuuaucagcauauugugguauguguguuagcugugccaguauucagcucuuagaaacacagccacguguuacuaugccaccuucuugaaguuuggaguguaacaguguagacuuugaucuaguuuuuguuuuucugugagacauuuacaugaaaacaacaucuuugauuuuaauaacuuaccuguuucuccuguuuauuuccccugaaauugucuuaaugcuccauaagggacauagcagcugguugcgauggaauugacugacacuaaguaaaagauuaugacuucggguagaaauuaaguagaaagaacugcugauuucuuaaagagaugggaugcacucagauugucaaauauugacauagaccuucuguuaauuuaagaguaacaauucugguuuuggugaaaaaauuuuaaaaguuaauuucaugauaugcuuuauaucaaaaauaaaaccuuaaauuuauuuuaaauuuaauuuuuuugcuaaaaaaagggccgaccuuuuauucuucagaagauucguuccucuuaacugcaugaugaaacuuuacuaauaaaaagaauucaugcauguauauauucauacacacacacuuuauacauaaugccuagcagucuuuuggacuaaauaauuuccccauaacuuuauguugagcaaaaaugauggcaacuuuucaaauauauaauguuagcucugggaguuaaaauuuaauuucuaguuuucagugucuugcuaauuaugaguuugaggcacauuucauuaauacguguucaucuuaguaugcauugacgaggaguuugugacuguuuuucauuauauucuucugauaagucaauuaauggcaugucauuuuacuucuauaagcugauuuuccacauuuguauaaaguggagguuauggguaugggugugagagacgggaguuuagguuggaacaacuucuaacuucucuuccaguuguaaauacuguauaacauaauggaagcaaaaugcuuccauggcuccauaaccaugucuauauucauuuguucaccauugacuugucucuuacuguggggauuuccuguuauauacaugcugcacauagauuuccaaaagauucaguuauaaucuaaaacauuuauaguaauuugcuuggcuauuacacauuuaaaauuuaucggaagugucuugaucaaacaagaauuuagguuggcuuucaaagaaugugaacaaggcugaauauaaauaggauuggggucauuuaucaguauccauucuuuuauuucauuagcugaauuaaugucuaagcauucaguccaagaaauauauguagcucuucuauuuuauuaaugguuuagccuuaauccuaucuuccuuuuaguuugcaauaaguacaaaauaguuacaaauucuagaagauuguuauugucuaccuccuaugaaguacuuaagcaauacaauaaauagagcugucauucuuugucuucuacuugcucuuuucuggauauuugguuauaugacuguuuuuuccuuuacuacugucuaaucuaguucacaaugauuuuuguguucuuaaagagaaaaugucaaugacuuaaauuauaucaccauaacuuuuauaaucagaugaucagagaauauaggauuaaagcuaauaaaugcaggguccuuugaaauccucacauaaaaggaaacagcaaaaguaccagcuuuaucugguaucugacugagaaaaucaaccaauguauauugguuuugcacuuuacaugguaauguugucauuuauuuuuagauauccuuggaacagaagaucuuauuguggaagugacuuccaaugaugcugugagauuuuaucccuggaccauugauaauaaauacuauucagcagacaucaaucuauguguggugccaaacaaauuucuuguuacugcagagauugcagaaucuguccaagcauuugugguuuacuuugacagcacacaaguaagacuuuguuuucuaugaaggcuugaauaagaaauuauugcaugccuucuuuuuuucccauuacauuuugucugacuaucucuuuucuguuuuuguuuguuuauauuuuuuguucccucuagaaaucgggccuugauagugucuccucauggcuuccacuggcaaaagcaugguuaccugaggugaugaucuuggucugcgauagagugucugaagaugguaaggccuguggaugggacaguaguugguacaugcauuugccauuccuugauaaacagaguacaucuguuucuuuaacuuaggacauacaucccaugugacuuuauggcuuuaugaaaauauuuucagcuauuuuucuuuggaaucuuguaauacuuacuuuuuuuuuaagaauggauacuucggggcugagaagucauuuucuuuuuauuauuuuagaugccuuuagaauaacauugacauuaagggaaacacauugagauuugugaagaauauugcaggaauagucauguuuuauuuucuuuuuacuuaugaagauucuuuugcauauuauuuuagguauaaaccgacaaaaagcucaagaauggugcaucaaacauggcuuugaauugguagaacuuaguccagaggaguugccugaggaggaugguaaguguuuauguguuaggagaaaauauggcacuuagauaugagagauuauuuuaauucagggaagaagaaucacagcaaaauucaagaaacuuuuuuccccagcuguuucaaggauuuaagcaaaauccauugauguaaucuuauaaucuuacacuuaguguaauaauucauuuuuuugguuuuaccaccuguuuuagaacuuuugaaaauguguguuuuucuuauggauaaagguauagggcugcuuucuaaaaucuuugucauuuccauaauccuuuuuccuuucccuacugcugaagaaggagaguuagaccuucguaguaguuaaaguugauguuucuuauuuugaauucauaguaaccuaaggcugaauucccaagaaucgcaggggacauuucaaauccauuugaaugucuuuuggacauuugaagccaaaagauagaccccaaauuuaaucccccaccuccaccccagguagcucugcaaucgcuguccuccgcuauugcuggaccuucuauuucuuccccucuucuacuccccuuccccauuucuuuucucaucuuuucuccuuugaaguacaccuguuuugguaucuaccaggauaagaggguuuuugguucaccaaaaccuuauaaucugguacaagagaugaaacuuacagauaauugaauuaccaaguggaaugucauaaguauuauagaagaaauaguagugcugugguauuuuagagaccggagagcuuauuuuuguuuaaaagugcagagaacguguuggcauugugaccucucacaugucagcugcuccauggggaagaaguuagaaaagguccugggcuuguagugagaggacugcuggagagguggcauugugaauaugccaguuguuccaaaagacauucugggcaggggcaaccaacgugaauuaaaguacauagauaagacauaagcagucauuucaagaaacuuguauuuuucuucaaggaauuaagaaauauuuuucuauauucugguuuuauuuauaauuuuuccaaaaugcuguuaccuuugagaauaaaaccugcuggagaagaagagaacaaaacugaaauaaaaacucugguuuuucuccuugcucauuuuaaagaguguugaaaauuagcauguacaucuuuuucuguguuuuucuaggucccugaaacuugugcccuguuuuguguaugugagccugugugauuucuggcacuagaauuuucucuuucucuuguccuugggagucaguauuugacuguuaucauuuuggaaucucugcuccuuuauacuacuuuauuucucguagcccuuugucugaauaauguucuuguauucauucagcuuaaucuuaaaauggguuuuuugauaugucaucuuuagguaagguaaugaaaaccuuccuagacuuuuaaaauacaaauuauuccuaagccauauuuccucaucuuuuacuugcauguauuauucaaacaugaauauaggacuuuaugcuaguuuguauuaauuuuccucuuacugguacuagcucuucauuucagaccacauuuuugguuccugguuauaucaucuaaaguauuaguuauucuuuugagaauuaagucauucacaauuaagauaaacaugacuuuuaggucuucauccagacauugguggugauaaacuuaucuugguagaguauuuucuuucuuuauuuuuauuuauuuauuuauuuauuugagacagagucucucucuguugcccaggcuggagugcaguggcacgaucucugcucacugcaagcuccaccuccuagauucacgccauucuccugccucagccucccaaguagcugggacugcaggcgcccgccaccacgccuggguaauuuuuuuuuuuuuuuuuguauuuuuaguagagacgguguuucaccauguuagccaggauggucucaaucuccugaccucgugauccaccugccucggccucccaaagugcugggauuacaggcaugagccaccgcgcccagcagaguauuuucaauuuaaucacuauauuucuguuagguuggcagguugguauucuuuaaaugauucauugauccauuaaacaguugcugagugccugcuguuuuucaggcacugugguaggcaaugggcauaugaacucaguaagacaagauuccugccgucaaggaguuuucaguguagggggaagguuacauuaguaaaucaucaauugcagugcaucuuuccucuaggagagaugugcauagagugguauuguuuccacuuucugugagaaugguguaagugauuugcccuugaucaaauagcuaguaaguggcagagccuggguucaaauucagauauucugacauguaacucugugcucuucuuguuaaaccacccagggcuaggcuggccacuagagacagggucuguguggauuauguucuguaaacucgggaaacuuuccuuuuuuaaccacaugaaaacuauuucugucauuauuuuccagacgcagccuuacaauccucaacaucugcaggauccccauuuccuuuguacacgaucauuccuguguuguaguuaagaauaccaccuuuuuugguacacuaugggauuacaaucccauuauuuugaguaguaucagucaaauuccagaagcaggauaguacuaauaauaaacuaaacuaaguugucguaaugacccuuugccugucucuuacacuucuagucauuucacuucucacucaaacuaucuuucucugaucaagaaguucuucuauagguaucgaucaaaaauaacacuuauuauucuaugguuuccagcacaggauagagcauuuacaugauuuuauaacauacuguuaauaagaggacuguuccugccuucaggaaacucauucuguguagauugguaucucuaguacugugccaggaauguguguaauaaguggaaucuaacauuuucagaauauaaauagauuccauuggugaggauaacuuuauuauauaacugccuuauauuguguguuuaauugcuuuaguuucuagaauauucuuuuuuuuccgcaugaaaguuuuuaguuuauuaaucuucucaugaaaaagccacaguggccacugauaacauccuugcagcaccuuugcuccuuuggcuuuuugccagcacuaacacuggccuuugcugucugccuaccuucuucaugccguucuuacauuccuuucauugcuuucucaaggucuuuuucuucucacacaggccaugucuuguaagucuauguuuguguucauuuuuguuugcauaauccaaggaaucguaaauuaugccaaagccaguagucuugccaccaccaaaaugaguucugaacucaaagaugacaucugguguggucuuguacauuuuggcuacuuuuucccgaauuucucucuuagguaguguugccuucccggggugaaggacaucaaugaccauuuguuuucacugaaguaguugguuggucaugaacuuuccaguuuggauaguuaccaugucauucaugaugguggucaauccucagacagccgaggaagaaaagaguuucucuagaauauucuuauugagagcuccaagcucuguauuugauuuuuuuccuuguaugaugugaacuaacaacuaaauaaacaagauaacaaaaccacagucauuugaaaauauggcuuggaggauauauacguaacuuuuuuuuuuuuuuuuugagauggaguuuugcuccuguugcccaggcuggaauggugccaucucggcucaccacaaccucuaccuccuggguucaagcaguucuccugccucagccucccgaguagcuggaauuacaugcaugcgccaccacgccuggcuaauuuuguauuuuuuaguagagaugggguuucucuauguuggucaggcuggucuugaacucccgaccucagguaaucugcccuccuuggccucccaaagugcugggauuacaggcaugagccaccgugccuggccacauuuuugugaauguauauguauaucugugugaguguugcauauaaauauauauauuuccccucccugauuagaugacuucccagaaucuacaggaguaaagcgaauuguccaagcccugaaugccaaugugugguccaauguagugaugaagaaugguaaguaacuugggacucaagucauuuuuuuccucuuguuccuuguaaguuuuaaauuauugagauauauguggaaccauuagugcuauaugaaaucuguagauuuguuccaauuucaguucgcugauugaaggaagcgccaaaaguagcauuucuaggaauuuuucauauacguuuaauaguuaauucaguaagaauuuagagguugcuuguaauacacccagcauugucuuuggcuuugagaaguaccuccaaaauuauaagacguagacccuauuauuaaggagcuccuaguccagcugugaaauucaagccuguacuuuucaaaugccagggaacuaugcaaggcaaucugugaugaguacagaugacugaugcaggcaguaaagugcauaaaaucagaaacauggcuguuguguuaggcuuaaguauagagagagagcuucaaggagaaaguguguccugacaguaguuuucacaggaagcucaagauuuggacuaaugaaaggggagaacggcaaguggagaaggaagcaugacauagagaauaacaguucuauguucugaccagccuggacaacaugguaagagcccaucuccauaaaaauuagcugggcauggugguaugugccuguggucccugcuacuugggaaacugaggagggagaauugcuugagcccaagaagucaaggcugcagugagcuguggucaugccacugcacaccagccugggcaacagagaaagacccugucucaaaaaaaaaaguuguguauucuagggucacuaagagaauaucaccuagcauuuggagcuagcuuagagagaggccugaaugccagucaggagaguuuuggcuuuuuccuguaaaaauuggugagucacuggagauuuuuaaauaagggguugaugcaaagaagguggugugcagggagguuuggcaauugaagaaagucaacauagagucugaaguuaagggagaccagagcuuuugcagcaguucaagagugaggugcuggggcccgggguaauguaguggcaguggccaugagacaaaaggcuggaucuggagugcaaucugaagaggguagugcacacuggccucuuacugucuguauugguucccuagggcuaugguaacaaaguaccacaaaccauaugacauagaacagcaugaaugcauugucucauaguucugaaagccagaaguccaaaaucaggguguuggcagggccauggucccucugaaggugccggggaaggaucuguuucaggccucucuucuagcuucugguaguuccuuagcuuguggcagcauaacuccauccuucacaugaaguuuucccugggugccugucuguguccacauuuuccccuuuuuauaagcacaacagucacauugaaguagggaucuaccuacugcaguaugaccucaucuuaauauaucugcagucaaccugucuccaaauagggucacauucuaagauacuggagguuaggacuucagcauacgaauuuggugggggauacaauucaguccauuaacacagucuuuuaggaauugcuuccuguauaggguuuuucugucuuacaucucuuggcugccucaacaaguaugcugagugagacacuacagaagggaaugagaaaaaucauauuuuacagccaggugagguggcucacaccuguaaucccagcacuuugggagccugaggugggcagaucacaaggucaggagaucaagaccauccuggccaacauugugcuaccccgucucugcuaaaaaaaaaaaauacaaaaauuagcugggugugauggcacgugccuguaaucccagcuacucaggaggcugaggcaggagaaucacuugaaccagggagucagagguugcagugagccgagaucgcgccacugcacuccagucuggcgacagagcaagacuccauuucaaacaaacaaacaaaaccacacaaaaugaaaaaucauguuuuacagugagcuuaccccaucuuccgugauaaaggucaaguagaagaccgguuuuauaaaaauagaauauuucacuucaauuuuugguagacccuugaguguuaagugagauuggcacccuuuagcuuuccugaggucugaucuaacccuugucgucauuagagaagcuccuucuggcauaauaagguacuccuuccucuccuuuucuuccccucucuccauccuccuuccuccuuuuuucuuucuaggaggaaucuuauugugucuguuaaauugaauugcaagggugcuagauucuauuuuauugauguagcaaucuagauagaucuagaaagaacaaggaguuuuuuuggguuuuuuuuuuccuucuccaacucuuuuuuuuuuuuuuuuaagacggacucucgcucuguugcccaggcuggagugcaguggcacgaucuuggcucacugcaaccucugccucccggguucaagcaauucuccugccucagccuccugaguagccaggauuacaggcgcgcaccaccacucccagcuaauuuuuguauuuuuaguagagacggggguuucaccauguuggccaggcuggucuugaacucuugaccucgugaucugcccaccuuggccucccaaagugcugggauuacaggcgugagccaccccgccuggcccuccaaccuuuauuuuagguucaaggagcacacgugcagguuuguuacauggguaaauuguguguugcugggguuuggugugcaaaugauuuugucacccagcucacagguagugagcauaguaccugauagguaguuuuucaacccucacccuccuccuacugucuccccucaaguaaggccccagugucuguugggccucuuuuuaucuccauguguauucaguguuuagcucccacuuauaagugggagcauguguuaauuuguuuuuuguuguugcugcuuuuaauucacuuaggauuauggccuccagcuguguccauguugcugcaaaggagaugacuuuguucguuuuuaugccuauguaguauuccgugguguauguguaccacauuuuuuuaauccaguccacuguugaugggcauguagguugauucugugucuuugcuauugugaauagugcugugaugaacauacacauucaugugucuuuuugguggaaugauuuacauuccuuuggguguauacugaguaaugggauugcuggguugaauaguaauucuauuuuaaguucuuugagaagucuccaaacugcuuuccacaguggcugaacuaauuuacagucccaccagcaguguauaaguacuucccuuuccucugcaaccucaccaacauccguuauuuucugacuuuuuaaucauagccacaauaaggagauuuucauuuaugugguuaucucucuguuaccagaacaaauucaaauuaaggcuugguccuucucauucaucuauuuagcaaauccuuguugagcauuuaccauaggaaggcuauaaaaauaagauuuggaacauaaacuggaucaauuuagaauaaaauuauauucaauggugcuuguuauauuuaugagaacuauuuucacaaaauuuucuuuggcuuuauucacuuuuugaaaaaucugugucccaaguucauauauuaaagaacuauugccuuguaauauacacuuaugguuguaaauugagaagcuggacuaaacaugcuuuauuacuuuggaaguguggucaaauguguuuccugaaaaaaugccauuuuacuuguuuuagacacuaaacaauauucuuaaaagaacugcaaagcaaggagguacauuguggauuuuuucaugguucuuugcccugagguuuccucgcuuucuuuuuuuuucuugacaguacuggugcauuaguuugcuguuaaccaaaaaacaaaauacugccauuaauuagcuuaauuucauguuuaagaggauccugguguaugugguaugaagauacaaugaaugacauuuugaugcaacccaggucuuaggaagugugaaggauauccuuuuagagcccugcaucuuauuuuagagacaaagcuuucuauggauauauggugggucauacuacucuuccaggguaaccuaccuccuaugcuguuuuuagagccugcuuugcuggugauccgucugugugcccagugaacugugccuuccucagccugcuuuucuugaauguccaaguguugucugccagcaggugcucagacugguuuauuuguuuuaggggucuguguuuuuccuacucuuuuuucuuuuuuauuuucuccccuuuucucuuuuuaaaauugugguuaaauauacauaagaugugguuaaauauacauaagauuuaccauuuaaaauaugcauuucaguggcaguaagugcauucacauuguuguacaacuguugccacuaauaaaaauuuuuaaaccaaaaaguuuuuuuaauuaaaaaguugguugacaaaguaaaaaaaaaaauagagguauugguuaccuuuuucaagacauuaauaaugaccaauuuuuguuguuguuuugguucgaaaaauuacuguaaucacaauugauucuuugggauuauuauauugggaaauuauauaaugccaguugauuauuugggauuauguauugucuaguuaguauuuauugagcaguaauagaacauuuacguuaugucaugccacuaauuuuguacaguugcagaaaaauauuuguuugaaacucuuuuaaaaauauuuaaauaugcucaauuugaaaaaacaauuccagcucuuguaaggauuaugaacaucuagcuguugcaacaaauggcccugaaaacacacaaaucuaacucagguuuuauuucuuugcaguuucuuggacauugauauucaaaggucaaauauuuaaucugaaaaucuagguaauuaaaaacguaagagaugaauugcauuccuuccugcccuccacccagauaaauuggauguguuaucuauaugggaauucaugauuuaauaugugauuauuauaagucugaacaacuuacuugguuauaggauaucuucauaacuuuuuuccuuuagugucuucuuaaaaguuaguaauacacaagcaaccaaaggaaaaaaauagauaaauuggacuucaucaaaauuaaaaauguucauacuucaaaggacacugucaggaaagugaaggauaaaagauaacccucaaaaugagggaaaauauuuguaaaacauguaucuuaugaggaucagcagaauauaucuagaauauauaaagaacucuuacaacuuaauaauaaaaagacaacuaauccaguauaaaaaugguaaagaauuuggauaggcaagaaaauacacaaauggccaguaagaacaugaauagaugcuuaacguuggccaggcauggugucucacgcccgaaaucccagcacuuugggagguugaggcaggaggauuguuugaggucaggcauucaaaaccaaccugggcaacauagugagaacucugucucuacaaaaaaauucuaaaaaucaaccggaccuguagucccagcuauuggggaggcugaagcaggaaggaucacuugagccuagaguucagugcugugaugaucuaagauugugccacuguacuccagccugggcaacagagugagaccccaauucguauuaaaaaaaaaaagaaaagaugcuugucaucauuagucaccaggaaaaugcaaaucacaacaaugaaauaccacuucacacuuacuaggauggcuagggucagaaagauaauaacaaauguuggugaggauauggagaaauuagaaaccuugugcacugauggugggaauauaaaauggugcugcagccacuuuagagaguuuaguaguugcucaaaaaguuaaacauagaauuaccauaugacccagcaguuccacuccuagcuauauaccgaagagaacuggaaacaugggcacacaaaauaguguguauaaguguucauagcaguauuauucauaaaugccaaaaagugagaaaaacugcugaaaacaaaaugugguauauccauacaauggacuguuauucaaucauaaaaaugaagcaugaauauaugcuacaauguggaucaacuucaaaaacauuaugcuaagugaaaaaagcccgacacgagaggcuacauauuauaggauuucauucauaugaaauauccagaauaguuaaauucauaaagauagaaaguagauuagugguucccaggguaugggaggagagguugcucauggguaugguauuucuuucugggguggugaaaauguucuggaauuaaauggugaugaugguugcacaacuuugugaauauacuaaaaaccacugaaucauacauuuuuaaaaggcuggauuuuaugauauguaaauuaaaucucaauaaaaagaaagaaaagaaggaaaugauaccaccaaugaugauaauaaugguaauaguagaaaaggugguggugaugauagaaaagggagaaguggcagugauacuaauagcagcugauaguauacgugcaaaaucuuauuuaauccucacaaaagccauaugaguuaggcucaguggagccaaguaauuugcccaaggucauauagcucaucaguucucaaacguguuugcacauuggaaucaccugggaacuuuagucaccugggaagcuuuuaaaaccuaugcuaccugagccucacccaagggagugucagcuacaguauuuuuuaagugccuccgggauucaaauauacagccaugguugacaaccacugacauaaaugauagucuucuaguucuaacuuguaagagucuguguuuaauccaugggaauaaauucagcauuuugaaagccacauuagccccuugccugaccuugcuuucucuaauuccuaaauuauguaguauugaaaagugacuuuuggccaggugcgguggcucaugccuguaaucccagcacuuucggaggccaaguugggcagaucaguagaggccaggaguuugagaccagucuggccaacauggugaaaccucaucucuacaaaaaauacaaaaguuagcuaggcgugguggugcaugacuguaaucccagcuacuugggaggcugaggcacaagaaucacuuuaauucagaaggcagaggcugcagugagcugagaucgcgccacugcacuccagccugggcaacagagugagacugcucaaaaaaaaaaaaaaaagaaaagaaaaagaaaagugacuuuucaagucagagaaagaagacaggaaggacuauguuuaauauggagucaucuauagggaaaggugaaaauaguggacguuccuucucauaacuccucuguacuuguuucuaguauggucuaguaucucgcaaaggucagcagugcugugacaguccuucuuaagaucugaaagaaauaauacagcuuuuauaaguaccugauuaucugggagcauaauuuaggugcugaguguaucugggccauuugaguuuucuucugcuggccucagaucucucuaguccauaauuuaggcuccgguuucaaguguugauucauucauacaaaaaauauuucuuaaguacuugcucugugcaaaguauuggucuguguguuugggauauaucagugaacaaauuaaacaaaaaugucuguccuuaggagcuuucauucuggugggagacuauagucaauaaacaauacaagcaauuaguauguuauauaguguauuaggagaugauaagugauuugggaaaauaauaaagcagaguuagggacauugagauugcuuuguagauugcaauguuaaauaaggugguucaagguaggucuucuugagauuugagcaaggagaugagguguuucaccauguggauaucugggagaagaacauaccagggacagggaacagcuauagcaaaggcccuaaggugagagcacgccuggugcauuugaaggauaucaggacgcuugcuggcugagcaggagaggucagagagguaacgaagggcuagauuauuuggggcuuugaaggccaucauaauaacuuugacauuuacucagaguaaacuaggggacuguugcagguuguugaaugggaaagugacaugaucugacaaagucuaaaaagaucacucuggcugcucuguggagaguagaugaugagggugaagagcaaccaagaucucuuaggggccuauuacaauauuccaaaugaaagagagugauggcucagauuggggcuggggcaaugaaagggguaagaaaaggucgaauucuagguauauugugagguagagccagcaugguuuccugauaguuuagauaugagauaugagaaaaagagaucagucaaggaagacaacaggauuugggccugaacacuugaaagauuaguugccaucaacugaaaugaggcagcuacaagaugaagcuaacagggucaccuaucaguaguucauuuuuggacauguugaguuugacauggcuacugagaccuccaaguggcuguuagucuuccaaguggagauagcagguagccaguuggagagauuuuggaguuuggggagaaaggcauuuaaaaccuugagccuugaugagaucaccaagggagugaaugcaguacuuaaagaagaccaaggacucagcccagggacauugcaacaucaagagacagagagaagagaaggaaccaguaaaggagacugaggaagaaaggucaaugagguaggaaaaccaagauaguggagucuuauucgggaagcaaaagugaagaguguuucaagguggaaggaguggucagcuaugccaaugcugcucauaggucaaguaggaugagaacagagaguugacccuuggauuuagcauuagugaccuugaagagcaguuucagugaaauagguugaaagagaaaaauugaagauagugauuauaaaacacucuugaaaauuuugcaggaaaggggagcaaagaaauaggugagagcuggagagaaaaaugugguggagauuuuuauuguuugagaugagaacaagagcagcgcguucauaagcuguuggaaaaguuccaauagagggugaaaaauggaugaaguaggagagagaagggaaacuugccagagugacuuccuugaguagguagaagggaugggcuccaguguacaaguggagggacuggcuuugcacaggaggaggaaaauaaaccuagaaagacaugggaaaggggguuuguggaugcaaauguggcucaguggggagaugugucaugagaaucuguggaaguuucuucugauugcauaaauuuucucagugaaguaggaggccaggaugucaguugagagggcagaagggaggagguagcguuaggauuugaggagagaggagaaaaugugaaacagucauuuaggggagagagaaagaguaaaugaaccuagagaugugaaguaugauuugccaggcagcauuaagggacccaacuugaaauuugguauuauaaaacuaaagucaggcagcauggguggagggugugugugugugugugugugugugugugugugugugugugcgcgcgcgcgcgugcgcgugcaugcauguaguaaucaguucugcuuuugcuaagcaaauguaucacagcaagagagaggcaagggauucaguaguauauauaagagauuaauuauaaugauugaccauggaauuuaagcuaaaaagaggagaguggaagucaauuggagugggucaguaaaaagaugguaguuuugaguccuggugcaguugaaggauaauuggguuaagguacuauaggaacugagagggacuuggaaaaauaggugaugcaugaaguugagaugauggagggguugugguuauugguaauaauaaggucuggguaugacccugggaguacauggcugcagcaauguagaggacaacauccauaaaauggaggaauucaauaaacugagacucagauugcuggaaugguugucuauauauugaacuugcuaaaaauuaagacacuugccuucaaauaguuugugugagaauaucaguaggcuccuauauucagagauuuuaggaaugauuuaaucuagugauucucaacugagacccagggggguauggaaauacauaucacaugcuauacaagcccucugaagacguugauugccuggcucccauugagaaucacuuaacuauuaagugcuauugcuaagugguugguagaugugcccucaacugcacuggguagaaacuguuaggaacuuuugagcuagucuauucauccaguacaggaauggcuucuauagcauccuugccaggaucauccacccuuuuuggcggaaugcuuuaaauaacagcaccuugugaagcaguccuagaagcaauuaauugcauagagaaauccaagaacuguuuuguucauucuuagcagauagaauauauuuuuaugcugguagcuuaagcacuuaaacaaggaaaggauauguauuuuacuuugugucauaaugcugagaacaguggugaaaauuuuaucugucaaugauguauuuucccuugcuucuaccuuguuacuagcuuucauuuugaugacucuuuuuccuagucucccuaggaggugaagaaaguuccaacagaauugggaaagguuuaccucagggagacugaaaugaccaaggggaugggaagaaugggaauugucuaauauaauaaauaaguguggacaaaccagagcugagaagagauuuagcuggaaucuguauuacaggguauguauaaggcagauauggaccugauuucccaaauuccagauugcuauaacucagagacauucccuaaaucuuaaaaugguuuuaccauuuacaaauaaaaugaaggccuuacugaacagagcaggcaguaaucuauggaguacuuuauauuaagagaugaucuaggcaaaaaguagauaugauucaaaaagccuacagugaauucucauuaaugacaguuguaccuaauucaaguugagaaguacuuggccuaaacuuuugagucuguuauuuugaaaagcaaucauguuuuucuucccaguauuuaucuauauaauauuuuuacuagguccucuacuaguuagguucacccagauuacauguucuuguguuuuaugaaacuuaauaaggagcauuauuuuguuuggcaugauaguguaugugauuagccugaugaaagcauuuagaacauagaaucuccaugcaugcaucugguuuggcuucuuccuuuuacagguggggaaaaacaggacccaaagaggaagaguaacaugcucauauucacacagugaguuuguagccaacgugagaccacaugauaggucuccugauuaagacuguuauauguuuuuccaugacaguguguugguuuauauuacugggcaguuggagaaaugagcacagaguguuaauuuaccuaaguugcaugggaaaucacuggccaagccagaugaguucauuggcuacagaacucccuuagccuaggugcucucugacgugaguaagauuuuaaugagacuguguggaaaugaugaugauagcugagauuuugggcuuucuggcuuauuucuuuuaaauagaucuuuuuaaauaauuuagaucaucuggaaugauggagaugcuuuaucccacggucuuugcacuuaacaaaguacagcuaaggauagauaguuaauuuaaaacucgugcauuccuuauaaaugaaagauaauuuauauuuauuuuuaauuauuuuccuuggagucacaacagguuauuauucucuucgguuugaauuuuaauucuuauuuguaagaauaguaggugcuguuaaugucuuuuuguuacuuaauaucagauuuaaggcaaacagguuaaauuacaguacuauaacuauaguauaggcaaauuauuauucuagaaagagauuuuuaaauuuuccugauagauauaacuucuauauuaacuuagaacuuaguuuuauauccuuggcuccaccagugucuuguuucauuaagccaaagugugcauuuaaaaaaauuuuuauuuuuauuuuagaauuggggguacauguacaggaagucuaauuauuccauugccccauagaucguuuuucaauccuugccccccucccucccacuuugaagucucagugucuacuguuccaaucuuuuuguccaugugcacucaguguuuagcucccacuugugagaacauaucguguuugguuuucuguuccugccuuaauucacuuaggauaauggccuccagcugcacccaugcugcuguaaaggacaugauuuuguucuuuuuuauggcuguguaguauuccaugguguacauguaccauguuuucuuugucuaauccaccguugauaggcaccuggguugauuccccaucuuugcuauugugaauggugcaaagcaugcagaagaaacagggacauuauugcuccaaaggggugaacauuaauucuugaggggcaaaaaaucuuuacucuuuuuaucuauaaggcacaaauaaaugugcaauacauaaacacauauacaguguaucuguaguauuaauauuucagugggauggugugucaaaauuagggggaaaaugucuuaaaagguuccugguggggcggcuguacugaaaaugguugagaaacacugagcugaaggaucugguugcaugugcuaagcucuacccuagaggaaauucccagauaccauuggauucauugugauggucaaacuucuagggaagucacaguuuccgcuaugcauuaaagguacgacuucucaugggccaggaaaugaagugguuaggacugccuuuacauuuggguggcgcuuuuuagauaucuccagucauagaaauuuuccuugucuauaccgucuuuucuuaaauuuccuuaaccucaaaguuuggcuguagcucaaggaaagggauguagauaaaaccucagcugcuuaguugaguuacccacaguccuaucagagucugguuuguggcuguggaaaucauccauuuggaugugucauuuauaauuugauaaugucccuuuauugucaucaugaaaggagaaacugggucaaugcuuuuugccaaaugugacaaauuuugaaaguugauugcuccugccacaccuccucuuuggucuccagugagauugucuucucuuucaauuugucugguacaucaaauaaccuaauugcaagccuagaugaucuaggcaucauacucaggacugugccuuaaauugagaggcacuggguaaguaagaguugguuuuaagggcaaggaaaagaagaugguaaguagaagccugaugaguuguuuuuuguuuguuuguuuguuuguuuguuucaggcuagguugucacuguuucacaugagaagguaguauuauguacagugaccuuguuuaaagugucaguuuaauguuaccacuaaggcccugccccagcuuuaucaccugagcacuaacaagugcuguguggaguucaguccaugcugguaacucuugaguauucagugggucuuuuaacaauuaccaccguggaggagagagcaaggaagagaaaugcugugaucuuuuacuguuuuuaauuagugaaagagggauuagauuaaacaaauguuacagaguugugacuuugaucccccagugguaagcaauaauuguagagacuggauuucaaaagcccugagaguuuauuuucaaucuaucuauuauaguucaauccccaguaaugcagauggaggaggauuaguggaaucuuaauaguagaaacaauaauucuuucuguuguaguuuucuguuuucccauuauaaauguaaagaauugaucauuuauuaacauguaucccccuuguuacuuguaacaggauuccauggcagaaaucucagauuccaauucaaggaaucauuugcaccugcuguacagagcaguggcuaagaaauguguaccugcugggugugguggcucacaccugugauuccagcauguugggaggccaaggcggguggaucacgaggucaggaguucgagaccagccuggccaacauggugaaaccccaucucuacuaaaaauacaaaaauuagcugggcgugguggugggcaccuguagucccagcuacucaggaggcugaggcaagagaauugcuugaacccgggaggcggagguugcagugagccaagaucacagcacugcacuccagccuggugauagagcgagacuccauuucaaaaaaauaaaaaaagaaauguguaccuaaacacaaggucuaucugugauacuugggcugcucuccugagaaagcagauggcuaaugccuuaaauaaaauuguuuuucuaaacuaaaugaugauuaaauacaaauuugacucuaauguuacagaaaauaaaacaauaucaaauuuguuagaggagaaucguuaaugaagacaguucuaaucaggucugucuuuacccguguucucuuggaaaauggcuucauguuucuggaccccaguuuccuaaccucuaggauggguagaacucuaggauaauguagaauuauauuaacauuacuuucuaugaaauugaguuccuugagucagacuuacuugcuucucuuuuuaacccaggaccuaauauuguagagccaaaaaaauggauacucugacaguugucuaaaugugaauguuguggucaaaaauuaaauaaauauguguugaucucuaucuguguguguggguguauguguguauagaaggcauaauuugauggaggagauugucuuguaagagaaaaaggggaagaggaaaaaaauaaggaauaagaguaugagaaaaaugaugagacuuuguuuuaaaaguucacccuuaaaauuaacuguaagcaaaugaaucaugggaaaucucuucaaauuaguuacccuggaggcacugcucuucugccaucuugccaucuugaaaaaacuuuuuuaguacuuucuuuggaauuauuuuuagaccuggguaugaaccacuuaagucaucuuuauuuuuuuuuuucaugguaaagucuuguacugguucugaacgauuuuugauuugauucugaacauuccuuuuaggauuuucaagagugugcuuaagguucuggagauaggacuuuacaauggaacuauuauuggaauuagaauaaagcuuuccuuuacaacauuggagaggauagcacucacucugauguuuaguucaguuuauuaagaauuuguguguaugugugcauagggaaaaaaaaaaacaacaacuaggaagacaaaauaccagaguauugauucguaucuuuggugauuuaauuuucuucuuguuuuuuuuuuuuuuuuuuuuuuuuuucaagagugagucuugcucugucacccaggcuggaguacaguggcaugaucuuggcucacugcaaccuccaccucccggguucaagcaguucuccugcgucagccuccccaguagcugggacuacaggcacacgccaccacgcccagcuaauuuuuguauuuuuaguagagacgggguuuuaccacguuggccacgcugguuucgagcucuuggccucgugauccuccugccucggccucccaaagugcugggauuacaggugugagccaccgugccuggccuaauuuucuucuuuauacuuuucucuuuuuuccaaauuuucuacaaugaauauauuauuuauaaucaagaaaaagagaaaaaauaguauuauuauuuucuggucauguucauuauauguucaaauauuaguagaaaccauucuugauaugugagcaggugucccaggugucaagggagagcagauucacuuuccugaaucuaaagccaggugguagaaccagguacggugcuuaggccuguuucuuuaauaaguacuauuuuuaauaauggauuucaaaguuugcccuuuucaagcaguuuagugaaaaagaauaaauugauucucguaauuauuuugugauuucaaaaaacauuuuauuucaguuugccaagaaguggauuguaauaucaaaguguaaguuuauuucucugaugcuagugaaaucauuucuuucuuaaaagaauuuuuuauucaaacagugugguuugauuuaagaauaucauucaaaaauagguacaacuucucuaugcaaauugaaguaucuuaguuuuaguaaguuuggucaugcuuauuacucagauggaaaagaacauguuuauaauacaggaaaaacauuuugugcagggaaggggauguaaagaaaacuuuaaauauggaaaaaacuucuuaagaugaugccaaauaauugcuacauuaaggaaauaaaaacugaaauaugaacacagaaaauaucuaggaggucuguuaggcguguugggggguguggucauggaaauucuuaauauuugagucguauauaaaaauguaaaauaaaaacuuauuuacauagcuaaugcuugcagccucugccugacaguucuauuagacauucagcggauauuucagcaucucuccuguauacuuagcacuaugcuggaggcugugcgguguagaagaaccauuagcgauuguccaugucugcaaggaguuuauaguauaguugaggauggcauuuugacucgagaugaguauuaauacuagcauguucucugaagggccacuugaauaguaaggacaacaaggacaaauggcacacaggcagagguaauuaggggcugaaaucaucuagagaaguuucucagaauaugagggaggauauuuucacugccgacaagagagaaugauugagucuuuuuaaugcuuuuuuuccuuuuuuuuuucauugaaaaucuuuguuauaguccuuacuuaaaaguaaggacugccgggugccguggcucacaccuguaaucccagcacuuugggaggccaaggcgggcagaucacgaggucaggagauugagaccauccuggcuaacacggugaaaccccaucuccacuaaaaauacacaaaauuagccaggcgcgguggcggacgccuggagucccagcuacucaggaggcugaggcaggagaacggccugaacccgggaggcggagcuugcagugagccgagaucgcgccacugcacuccagccugggugacagagcgagacuccgucucaaaaaaaaaaaaaguaaggacuuaaaaaccugaggauuuuagccagaauuuuccuguucuaauuagaccuaugucagugguucucaauuggaagugauuuugccccccaggggacauuuggcagucuuauaggcaucugguggauagaggcaggggaugcacaggacaccccucuuucccaccuacccacacaccaaagaauucuccagcuggaaaugucaauaauacugagauucaaaaccccuggucuacaugugcuugaggaacagugaagagauaauggagccuagccaccugucuaccauuuguuuuaugugaccaaugccucaaggaguuauagggcugggcugugaacaguuaguaaguggcauaugauuaauuauucaguccugaguuauucagcguacuucagugaaaaucacagucuaaaccagggacuuaauaaaggauuacugacaaaagagaacuauauaugaaugaaacaucaucuuuuuguacuugacccaaguuugugucauauccaguaagccaguaguugugcaucaaaacauuguccaugucucaacucuuuacauguuaucaagaccucuggccuuaauggaaagaguauagacuuuagaaucagagaguccuagauuucaaguucugguuccagcuaugugacuuuggauaaguuaccuaaucucucucaguuauaguuuguucuguaaaagagaauaauaaaauaaaucuucuguaaaagaggauaauacaauaaagaagauauauguuuauuucuauuguguguagaaggcauacuuugauuguugugaggauuaaagaaacauuguaaguaccuaaaauauuaccuugcacauauuuagcacuuaguaaauguuaucuauuacuaacccuuaggaaaauuuugcaagguaaauauuguuauaccuacugcguaaauguagaaacugagguacagagaaggcauagcuuguauaaaaccacacaguaaauaguagaaguaggauucauauccaugccuuauuuccaaauucauaugcuugucauauugccugguaaauaauggagaagggaaaaaaucagaaaaaaggaaaaaaauacuuuuuaaaaagcaacuuuuccccuucccccauacugaaauuucccucuuugccuagguuuugaauucucuaaauguuucauguaagucaaaauugcuaugagagaugcauuuuaugcuucuaaaguuaagugugcccucagauuuguaaagagguggcaaauaauuucauauauuucaaguuuuuuuaacuucuuauuguuaaaaaaaaucaucccaaggcuuaagaauuuccaauuuaaaaucuuuauucuagaggcuauaguuuuguuucugacacuuucuggaagaaucuaugcuaaugaccagcaccgccagauuuuuucaugauauuuucauuuuuauccaugcauccacuggugucaacuuacuagaguacuaaaacugaaucagauguuuuuaggaccacaguuuaacauacuaauugugccuuccagaauaauuuauuuuacaucacuuaacagcugccccuuucugcaucccugaaguuccauaagaaucagcugaggaggugaauuuuauuuauucuuuccuagucuagaguuuuguggcaucaauaaaaccauagaugcuagagccaguuucagcaacuaccugcuaaaggcauaaauccuucuuaauagggaugacauuuccaugcccugaauccuggggagaaaaaucuagcaagcacgaaaagauuuauguaauucuuuucuaugagaagaauaguuguacagugagugcauguggauggaauuuuaauaaacauugaaccaggcagaacagaauuuuuuuaaaagccauagguauauaaaauaucaucuaaguuuuuugagcaauguuaauaugcgagcagucuacuuuggguaaacaaaaaugaauuguuuuucucguugugucaauuuguauguuucuaaguuccuuaaaauauaagcagcggaacauaaugaacucucuuguuaguugacuaaauucuucauuguuuauaauaugagcaaaaguccuucuggcuuauuauaauuagccugaaaccugauuguaaacucuuagucaauugugaaccugauuaauuugucuaaggucauacagguaggcagagccaggaaugaaagacaaguuuucugaccacuaguucaguuuucuuccuacuauuuugacuuuuucauaauuuuauccauucuaauuggggcauuaauuuuuuuuucaaaguuuuaauugcgauacacagcauaaaauuauuaaauuucaaaaaaucucuucgaauagguaaauaauacaugaacauguaacaaaaauuaaagguuuacaguauacagugaugagucuagcuccuacuccuaacucccgucccucccaguucucuuugcaggcagccacuguaaagaauuaagcauuucggccgggugccguagcucacgccuauaaucccagcacuuuggaaggccaaggcgggcgcaucacgaggucaggagaucgagaccauccuggcuaacacggugaaaccccgucuccaauaaaaauacaaaaaaaauuagucgggcgugguggcgggcgccuguagucccggcuacucgggaggcugaggcaggagaauggugugaacccaggaggcggagcuugcagugagccgagaucgcaccacugcacuccagccugggcgaaagagugagacucugucucaaaaaaaaaaaagaauuaggcauuucaaauagacugcuuugguuucauaacaugcauaaacugacauuguauugcauuauucuuugaguugcacucuggccugccaaguuuaggggacgccuaacagaggaaaaauauaagcuguggaauuagaauauggagagauuuaugaacugaauuugaaaauuacccaagguccaaguuauuuccaguaauagaagugagggcucucuugcagaaguaguuuauuacucagauauugccuuuuguacaaauagcuuaaaguauauuauaagagcacucauguaucuuaaugacagguaaaauccgugucugaguauuacauaacuacauacagcuacuuuaaaaucaauaacacauuggccaaaagaaagaaccaugcugauguuugaauaaacauacuuagccucugaaacugucaucguaggacacugcauggaucugcuucucucgggccucugagccuccauguccuacccugcugaaacuuugguccccugucuuuggauugggcaccuaggccuuuggaugaggagauaaggggggcuccaggaguacacaugaaccucugaccaugcugccacuguugagguuguacagaaugaaaagcaguagggcagcagcagccucuuaguuuugcccagaccaagguagccuuuaaugcagagguacuggguugauagcuacauaugacugccuccguggcgagagucaggcuccagaaaucugcaggcuacagccuagcaggccacauuugaggcuucaucccaguuuaaaaggcagaucuucccaagugaaaggaagaaggaaggacacugcgaaguuucucucuuuugauaucucuguaugaccagguaucuggcaggggaaaggguauagggaauuuauagguaguuuagagaaagagagaugcgaguaggucagggaagagauagagaggaaaggcaaggugggagaaaguugucuuuuugagagagaaagucuuugacuucuguacuguuacucuuggguuacagucucauguucuacucuaaggcaguguuuuucgaacuacuguguucauaagacccuccuggagcacuugcuaaaaguugagauuccaugaucucuguccuaaagaugcugacucagugaaucucagauagcguccuugaauacuaggauaguuuuaauaaaguguuccaggucauucuggggaacacugcuggaucaaggcuggcccuuauacuuugaacagugcuagauguuuugcuccagauuuguccuccguuguaaauacaaacagcauacugggagucuuaacuguagaugcuucauucauaucugaauuagaguuuuuuucuuuucuuuuuuuuuuuuuugagacggagccucacacuguugccuagccuggagugcaguggugcgaucucagaucacugcaaccucugccuccuggguucaagcgauucuccugccucagccucccgaguagcugagauuacaggugcccaccaccaugccuggcuaauuuuuuguaauuuuaguagagacaaggcuucaccauguugaucaggcuggucuugaacuccugaccuugugauccgccggccucggccucccaaagugcugggauuacaggcgugagccaccgcucccagcccuagaacuuuuuucaaaaagcauucauauuccuuuucaccugagugccuucaccugauaugaaugccuugguguugauuuuuuaaauguuuuugauuauuuaaaacaauggaauauuaguucauaguggcuaugaaagcauuagugcuguuaaucuuugcaaauagaaccacuggccuuuuguuugucauaauggcccugcuauuauuuuccaccuggacuaauagucugugauuuuuuuaaaaaauguacuuaaaaaaaauguauucagggccagggguguggcucaggccuguaauccuggcaguuucgggggcugauucaggagauggcuugaggccaggaguucaagaccagccugggcaacauagugagacccugucucuacaaaaaacaagaaauaauuuuaaaaaaaaauagccaggcacaguggcaggcaccuguauucccaccuacucaggaggcugaggaaggaggaucacuugagcccaggacuucaagguugcacugagcugugauugugccacugcacucuagccugggcuacagagugagacccugucucaaaaauauauauauauguaguuagaacuuugguaacaaauaaguagccuuuguuucaucaucauagccauuugaacaguuuaaaauguaaaugacaaauuucacuaaguguauuuuuccuuuucagauaggaaccaaggcuuuagccuucucaacucauugacuggaacaaaccauagcauugggucagcagaucccugucacccagagguaaagguuuuucuuggaucuuuuuucccucuuuggcuuuaauuucuccuugucauuaugaaucuugacacauucaccauuguuuuccuuuccauuuaaaaggugacagagaauguuaaaaauagaugaaaggaaggucuaaaacagcccuugcuaaagcaguaagcccuuucaagauguuuacagcuuugguuuuauuuuuacuagggugcuuucuaaaauaugcuaggauuucccugaggcauuaauuugccuucagaucuuuaaauagaaaauaaaauucauggugcuuuuuuaguacuuccuguguaaaagaccuuggcaaaucugaggcaaggucccuguccucaaugagcuuguaguccaguuucaacccugcauccuuaagaacuuuguuccagguuuaccuuggucagcagcuggagccaagagcaaauuauacagugccacauugucuuuccagggaucuuuuucaacagccucugagcuauuuguguuacgauuguguuacauuuucacauuuugaauauaacauggaucuuaaaugagacaaacaaaaaacauguuuuaguagucuaaagcaaaaucaacgcuuucuaguucuuccuugggggaaaguacuucuggguuaguuaaguuuuagccuuuuauuuuuuuaaugugaucuugcucuucuuucuuugccuccaguuccuauuacucuuuucucaagccaaccaaggacugaaagugugagcuuuuuuggauuuaguucugaaauagacuacgauuaaauuguugcuuauguguauuuuccucaacagcaaccccauuugccagcagcagauaguacugaaucccucucugaucaucgggguggugcaucuaacacaacagaugcccagguugauagcauuguggguaaguuccuccuuuggcugccaagagagagcuuugugcaacuuggaauagguaucugggcagaaauuguugagggggaaauugacuuuaaacacagagaagggaaaaaaauugguaguauaccacacaugaaugugagccuugccaguggcuaucagaaaaaggaagaagaauaaauauauaacaaauauguggguaccauuuucucuuuaauucuccuagcaggaucuugauucagauaaucuuagccaaggcagaccgaaccagguggcgaaacagcuagcucuguaucacguaguuuuuucauaauauuuaacagaagucagaaucgauggugacaagaauaauacaacuuuauauuuauaagcccuuccauaugcuuuuaaaguuauuuuauauccccuuucucauuugguaaugaaguuuugcagagaaguuuaauaacuuguccaaggacaucuagcaagaagggccuggagcugaagcuggaauccaguaugcuguccaaaagccagaaaaccaaggagcuuacuugacaauaacuauaaaucuucuuucgcuggggaacuacugauauuccuacuuuaucuuuaugcuacagacggcucaugugcaguaauaaauuuuuaaaacucuuuuuucuuaugagauaauucauguagaaaacucaagugauugguuauagaaacauaugaagaagaagaaaaaauuauguauaauuuuuuuucuuuccaguuuauucauccuuagccucucaauugaauccuucccauuggcuuuuaaaccugccagagucucugccauuaaaacaaacuaguaaucacacugaaguggguggggacuugaagcacuaaccuaaguaacuuuagaaaacaguaauuggacuagauaccguaaggcuaaaaacaaaaauaacugaacacagauacugaacucuacuuaguaaauuuguuucuuauaggagcauggcucagcaauucugaaauuuuauauauagauauuuuauacaccacacauauacugacauauagaaaauaaaaaauauagauagugagaguuagguuucucacugccagaggaaaaagguuacaaauaaggaaaagggaaggccaagauguacccuuugguacuggauuggaaucuaauguaucaguaugaacucauggcuuuaaaaauauacuuacaguuaagaaaauaaauacagauguguguguauaugcguguauuaguauacacacauauauuuccuaguucuguccacugagaggccuagaagcaacaauaccaccauagcaguggacacacuuagcacucagaucuugcuuucuuuuuguguguguguguuguuguguuuuuguuuuuguuuuuguuugagauggaguuucgcucuuguugcccaggguggagugcaguggcacgaucucggcucaccgcaaucucgcuuccuggguucaagcgauucuccugccucagccuccugaguggcugggauuacaggcaugugccaccacgcccagcuaauuuuguuuuguguuguuuuuuaguagagacgggguuucugcguguuggucaggcuggucucaaacucccgaccucaggugauccaccugccucgaccucccaaagugcuuggauuacaggcgugagccacugcgccuggccagaucuugcuuucuaaauaccauucuccaauaaaaggaacuagggcuccuuggagaagugguugauuccaggacuugggcaagaaaaauacaggaugacccuggagcaucucuugguaccagaaauuaagaaaauucucaaaaaagaauggggacauguugaaagggcauagggaccaaccugaaagagcuuccaguggcuaaaucuggaacaauuugaccagcaaaguagauuaauauaguauuggguuauaacccauagaguaagcuaaguauccaugaguucauacuaauauaaauaaauaauugaauaaacaaaugagaaagaaaggacagcaucuccuuccagaagaaucccaaguaauaaauauagaaggaaugaggaaaauagaaagccaucauuaggcacaaaacacaguaauaguucuugguagcauaggugaaaguuugaggagaaguaguauaucugcauagucuaaaaguaucucucucaagauguuuauuuauuacaaaggggaaaauaguaacuuuacacuggagaaacucaucagaugccagccacuuuaauuauguaaugaagguuaacaucacugguaauaagacauauugacauaauagcccuccugauaggaugcagugagaagguaaucucaccaaaaaugcauaacugcaaucuaauaauaagaaaacaaucugacaaacccaauuaagggacauuauacaaaauaacugacauacaaguguuaaagucgugaaagacugaggaacugucacaaauuggagaagacuaaggagauuugacaacuaaauuccauguaggaucuuggaacagaaaaaggauauuaguggaaaaaccgaugaagucuauggcaugguuaauggcauuauaccaauauuaacuucuugauuuuuauaauuguaccauggucauaaacgauguuaacacuaggggaaagugggugaagagcauauagaaacucuguguacuauuuuugcaaguuuuuuuuuaagaguaaauuaagaaaaagauuuaaggcaaaaccaaaucaacaaaaaccaaacauuuccacaucuuccuccuuaucucuuuacuaaacuuguuuccauuccucaccucccauuugcuccucaccucacucaugucugucuuuugccccugguaugccacuacaacagcucugugcaaaggccagcaaugaccuccaugccgcuaaaucggguagauauuuuccaguccucaucuugaccucguggcagcauucaguguuacagaucaauuccucuuugaaacauuuucuucccaugccucacccaacacggugucgccugguuuucuuccuacuucucugauuauuccuucucuuucuuugguagauacccuucuuuacccagccuuuaaauauugucauucuucauugcugcauuuaaacucuuccaaaucuauauuuaggcauggagugauucugucuacauuaacagcucaauuacuauguauacacagauaaaucacaaacuuuuaucuucagcccuauauaccaacuuccuacaugacauguccauugaacgaaagcaaauauauuaaccaagaugcguuuuuaacaccaaauugucuauauggcauugugauagaugcaaauaauuauaagucaucauccuaucuucauggagcuuagucuaaaaauauagagauaggaccuauaauguaaugguuaaggucauagucauuggaguccuguacagcuggguucaaaucauggcuuuaucgcuaguaauggccuuaccuugaauaaauuaaccucuguuggcauuaguuuccucuucuguaaaauaacggugauaaaucuuuccucauagggcuguugcaaagaugcaguggaaccauguaaguuaaagcauucaguggugcagauccaaagcaaauucucucuuaugguaguaguacuuauuaaaguagugguggagaaauguuagaauacaagguaauauaugcaagugcuaagacaguucuggaaacaauaaguguagaaagaauucuaaggaaggagaccugugaaagugggaugggcagggaagacauucuaaacauagugggccuggaguggagaaggaguuaaaauucugauuaaaaacaaacuuuaauaaagaagcagugugccaagguagaaacaguaaaagauuuguaguaagaaaauaugaauuuaaaucagcucuaccucugaauagcuguaauuuuagaugaguucauuuuuagauacagguuuuuuuuucauaucauuucuguuauucucagauaauguuaucuguucuaaucaccuuuuauagugguugucgguaauagaugugaaaauauuuguuguacaguaaaauauggcauaaacuuuagucauuauuggugaaucaguguaccuuaguggagugaguaugcuuuccgaguuggaaacaccugcgucugaaucaacuuacuagcugucaccucggcaagucacuucaacucugagaugugguuuucucaucuuuaaaauggaaauaguacuccuuaccucaugacgauguugugaggauaaaauaguuacucuucauuugugagggcccacuagcagccaagcagggugagccaugagcuguaaagcugguauacacugggccuucgaucauuggugacuucaucaagguuagcauuugccuuaggauucucugaguguagcacauaugcaaauaacgugacagauaaugugacaaaucccuauuucagaucccauguuagaucuggauauucaagaauuagccagucuuaccacuggaggaggagauguggagaauuuugaaagacucuuuucaaaguuaaaggaaaugaaagguaaucagauccauugugucuaauauguucccauguugaugcuugucuguuuuacguaguagcauuuuauuuuguuaacugcuggauuggauuccuuguucuggucucagcugucuugagaaacuuagcuacuccugggacuugguaaaaaaaaaaaauucccuggggaaaauuuuuccaucuucguucucuuucuuuuuacuuuuccugcuuuugccuuguuucuuucaauguguuacauaagguggaaacuguaagaucccuaccaauuuacucacaucauucccaucuggaaaauuuggaagacuuaaaaacuuccuaauacauguaaugacuacaucauaaacaugucuuugaaacccgucucccaucuucuaguguuauucauauacuccagguuauccugugcuauuagacaaauuucuuaagauauauuuucccccuagacaaggcugcgacgcuuccucaugagcaaagaaaagugcaugcagaaaaggugagacaaucagccagguauuuauugaauaccuauaaaagguccagugcuauuauuauaauuauauaucacacuuguguauuucugaagggucuuagugugagcuuuucauugaauauuaacuucuaacuaauuaaauauuuauacaguaauaguauaguugcugcagucaaaccaagauuuuucaccuggauggugagugauguggaaccuuuauugagacucaggauguuugccuuucuaacuauugggccagaaaacucuuaguuguuuuguuuuauuauuaccaacacaacacaugcuauuggcaggaaacuuguaugguugaugguguucccugauaugugucauaauuuauccuguucccuuuuggacauuuaggucaugugcauuuuuugcuucuauaaauaacaaagcugugcaugucuuuacacaucaucuuuguauacaacucuaaauauauccuugguauaaauuucuagauguggcgaucaugggucaaaugguauucaaggguucugauauguguugccagaggacuggagggcaaagugcagaauuuuaggucucagucaguuuaagguaugacauaugaaacaagcugaaauguagcuguugccuaaaauuuguugcaugcuucucuccacagguggccaaagcauucuggauggcaaucgggggagacagagaugaaauugaaggccuuucaucugaugaagagcacugaauuauucauacuaggguuugaccaacaaagaugcuagcugucucugagauaccucucuacucagcccagucauauuuugccaaaauugcccuuaucauguuggcugccugacuuguuuauaggguccccuuaauuuuaguuuuuaguaggagguuaaggagaaaucuuuuuuuuccucaguauauuguaagagagugaggaauacagugauaguaaugagugaggauuucuuaaauauacuuuuuuuuuguucuaggaaugaggguaggauaaaucucagaggucugugugauuuacucaaguugaagacaaccuccaggccauuccuggucaaccuuuuaaguagcauuuccagcauucacacuugauacugcacaucaggaguugugucaccuuuccugggugauuuggguuuucuccauucaaggagcuuguagcucugagcuaugaugcuuuuauugggaggaaaggaggcagcugcagaauugaugugagcuauguggggccgaagucucagcccgcagcuaagucucuaccuaagaaaaugccucugggcauucuuuugaaguauagugucugagcucaugcuagaaagaaucaaaaagccaguguggauuuuuagacuguaauaaaugaggcaaaggauuucuauuccagugggaagaaaaccucucuacugaguugugggggauauguuguauguuagagagaaccuuaaggaguccuuguaugggccauggagacaguaugugauaacauaccgugauuuucaugaagaaauucuucugucuuagaguucuccccugcugcuugagaugccagagcuguguuguugcacaccugcaaaacaaggcacauuucccccuuucucuuuaaagccaaagagagaucacugccaaagugggagcacuaagggguggguggggaagugaaauguuaggcgaugaauuccugagcaccuuguuuuucuuccaagguucguagcuccucucugcccuuccaagccuguaaccucggaggacuaucuuuuguucuuuauccuuugucuuguuugagugggucagccccagaggaacugauaagcaaauggcaaguuuuuaaaggaagaguggaaaguacugcaaauaaaaauccuuauuuguuuuuguagacuuuguaaugcauaucauuagcccucacugugaucauuacugcuguggcucugaacuggcacauaguacaguggauggaaggugcccgcacaccagcugagaacugguucuggccuaggugggcucuagaaccauuuacacagcaugaaagaaacagguuggguuaggagcagaaagaaauaaggcucacaccccuccagacacuaccuuauaagcacugcagaaccugaaacagauggcagaaggaauggaaugcuacaggggccagcaggagugaccacagggaggggacagcucagugacuggagcauucaggaagaggcuuuccagggaacacuggacauugcuuagugaccuuuuguuccuuuuuuuuuuuuuuucuuuuacuguucugaaagacuuugagucugugguucaccaccagcccaucaguguuucuuugaggugauugcauuagggaaguuggcucugggauugcaaaaaaaaaaaaaagguggaacauguuuuccuuaaaagauggaagguuuuagaaaauauacuaggccaucugguuagaaaaaacagaccagacuagaaaaagcugugaauuugauuuuguagauuaaacaaagccagaugauuaaaaugugauuuauuuauaaacugugcuaaugucuauuauuaugauuuugugguuuuuuauuaggggguaugagugagggaagcccuauauccuucauuggauuagacauauauagugaauaguggaagagucugucaagcucacuauuuuagaauuuacccugcauauguaaugucauguuuuuaagaccucagcuaugcagggauauuggccucuucuagggacauaugggaugaaggucucuagugaaaucuacuaaaagcccauguuagaauagugaucaugagcuaacacuacaguaauagcugcagucuaucuaaagugaccuauguucaugcuaccacaaguuguuacagaauugccagcuggaauuuaaaauaagagacuugguuuuugguuguuuuuuccuuaaacauuucuugauuugcauaacauaguguuuggcacauaguguuuggcacauaguaggcccuuaguuuugguuguaaaguaugguuuguguuugaugaauaugaucacaaaguuugaagguccauacauaagugcuggaagguaagggaagaca

SEQ ID NO: 16045 - RNA, 32867 nt, Homo sapiens
cggagugcaggcgccggauucccuucugucgcgcggccuuauaguuccggcuguggcgcgcggacggaaaguuuaugccgacggaaaguuuaugccgacggacuguguccggcgaugggcacggggugaguggggaggccgagggcccgggacugccuuucgcugcuuguugggguuacaggugaagggguuaugggugaagaacaacccagggccagcgcuuggccuucccgccaccguggcggccgccccgcgcugucugugaggcgccaguuccggggcgcugcucccggccuccccucgcucugaggcucgggguccccagcuccgcguaaacugcacgauuucgcccucugcucagcuccccucugcccccucuuuccaagagagacuuccagaucccacauuuucuugacugauuuuuaagguaaaaauacaucucccagaugugauuuucagucuggacuuuuagagaugaaauuauaucugagaacuggggagggacucccggaggcugacgggaaagccaaagagcaggugaggcacuagaaauucagguagaauccugcuuugagagcgagacugcugagaaucaguucuuuaugaaugagcuaauuaucaccuucagggaagaauuacaaacgucuagcugauggacacuugguauucaaggccaaauagguggcuagggccuauuucucagacuguuccugagaaagaagagcccuaguuguuugaacaguacacgugggaagggggugggggugggagacuugggggcucagaauccacccaagugaggaauacauaguguugugcucacaaaauugguagacuguggugggcagggauucccccccacccaagacggagucucgcucugucgcccaggcugaagagcaguggcgcgaucucggcucacugcaaccucugccuccuggguucaagcaauucuccuauuucagccucccaaguacuagaaccacaggcgcacgccaccacaucuggcuaauuuuuguauuuuuaguagagaugggguuucaccauguuggucagacuggucucgaacuccugaccucgggugaucugcccgccucagccucccaaagugcugggauuaaaggcgugccuggccuuuuuuuuuuuuaaucaggccuauacugcuugagugaacuauccuucaggaacuuucaguucccuccuuuacuccaaccugaguacuaaauugaucucccacgacuuuguaacuguuaaugaggugcauuugggagucgacacaaaugcaucacuugggagaaagagccagcuccagaggugucuucagagaaggcaagacugccagcugucaucacugucaacagcagauuucacgggcugaaagugcuuuuuuguauuugaucuaagucuguguaaacuguuuccucccauucuccuaagaggugagggcaguacuccucaugauccucaacuuguaaaaaggccucccugcaugaaugggacuaccacaggagcugggcagacgugagggagucccccauaugucugcuugaaugaggagaagaggaaauguguuucugguguccagaguuaacauuuauaauguauuuugcuaaauaauauaugguauaucuggugauuuagggguaguucaucaguuguuaucaaauuguugggcaccuacuaugugccaguuacugugauaaguuuugaggagacaucaugggcaaaauguggcauggucccugcccuuagugagcguauguuauggucuaauauaguguaguugaaccaauauugugcaggaccucacuuuuuuuuuuucagucgggccuauacugcuugagugaaccauccuucaggaacuuucaguuucuucuuuuacgccuaugcuuacaaccugaguuguaaacauuguuuccaugaaccaguguauucugaguucgaaacagccuacuuacaaauggaauuuuggcugggcgcgguggcucacgccuguaaucccagcacuuugggaggcagaggcagguggaucacgaggucagaaguucgagaccagccuggccaaugucgaggucagaaguucgagaccagccuggccaauguggugaaaccccaucucuacuaaaaauacaaaaauuagccgaguguggugacacgcgccuguaguccuggcuacucgcgccuguagucccggcuacucgggaggcugaggcaggagaauggcgugaacccgggaggcggugcuugcagugagcggagaucgcgccacugcacuccagccugggcgacagaugucgcaagacuccgucucaaaaacaaaaaagaacaaauggaauuuuagaauaugacacauuugcagcugggcaccauccuuaaacaaguaaucuggcuacuguuaaauguuuugaaguuaaucccaaaaaagaaaguugugaacauuaaauuucuaaccuguuuauauccaccuaaucucucuaauuguauauuugcauuaugauuuuuaugaaguuguaagcaguguauaauacaguucuggggccugcuuuucucaguuacuaaugcuuucuauaaguauuucugauaucuguaguacauaugucauuuauuuauaguuuuaugauauuucaucaugucaguagccuacaguuugcuuaauaauagaguagcagcaggcuauauacccaugagcaggucuguguaucuguaaacuuuuuuauuuuugagcaccaaaauguuuucuuuaugcuaauucucaauccauaauuuugaauaacuccauuuguacauuuugacuuuucuacccaauuucaugagauaauuccagcuguauaaauuuuuuuuuuuuuuuuuuuuuuuuugagauggagccuucgucugucacccaggcuggaaggcuggagugcaguggcacgaucucggcucacuacaacuuccaccuccuguguucaagggaucuucgugccucagccucccaaguagccaccaugccuggcugauuuuuguauuuuuaguagagacaggguuucaccauauuggccaggcuggucucgaacuccugaccucaagagauccgcccaccugggccucucaaaguguugggauuacaggcaugagccacugugcccgaccuuacauauucuuuaauuuuguucuuuuccuucacaguugaagcaccauuggccaguuuauguacaaugaauacuacugaggcugacaguuuauuacuuuuguuauguguaaugauuuccaauuugucuaauuugguuuaugacuuuacuaguccuuucauuuuuauauuuggcauucauuuuacuaaaacaagagcaccaaccaacaaaauaauuaaacacaugcaguaauacugcaaaaagguugugacagugccaaaaaacaaugguuguuugucaaauagcaccaacauaugacaacuagaaauguucuucaguaaauuaaguguuaggagaugugggaguuuauuaaguugcauaaaagucgaaugugugaaaguuaagggcuaccugaauuuagcagggcuuuuuuuuuuccaguagauauauuuagaugguccuugauuuauggucacuuaaugggugauucuaagagugguccuuacaaugaacuaagcugcucacuucccucucacugaguucucuacagauuauuccucaccucaacuuaaaugguguuugccucugcuaauuucugagaaguuaguuaaaguuauggugaaaaauauuauuuucucuccaugacauguaagaacguauuuauuuucugcagcauuucuucguuuauagcugucuguuugcauucugauugggaacacugggaucauuuucaucaugccgacaguggugguaauggauguaucccuuuccaugacccgaccugugucuauugagggguccgaggaauaccagcguaagcaccuagcagcccaugguuuaacgaugcuguuugagcacauggccacaaauuacaagcuugaauuuacagcacuugugguuuuuucaucacuuugggaguugaugguccccuucacgagagauuauaauacccuacagguacaaaauguaguaaguuauuguauguacagggccuaaauuuauugggaggaaaacaguguuauaaugcguugaauauuuagaacuuuggcauuauuuaauaagucuaugaguacuuaauauguguaacuaaacagcaagaauucacaaccaguaggucuuaugccuacuguuucuucgguacagcuaugaguuacagcugugaguuguucccuuauuuuccucucuugguuuucuggaauucucuguggaaaagugagcaucucaggauguaguguuccauucccuaaaauuuaggaucuuuaggcucaacacuuaauuuuuuucuacucucccauaaaacuugaggaaaugaaaaaauagcccuuucuuauucuagaguaauucaaaaugauauuuccuuuccaacaaauagcuuugauuuugauaccaauaaauuauaauuuuuaaaucucaguugguagauauuaucuuucaaagguguuuucuguguuauguuagaauuuacuuucugacaacaucucuaaaucauaauauucauaauauuuccagcagugccuaacacagugucuuacccauagugagcagucaagaaguguuugugggccaggugugguggcucacgccuguaaucccagcacuuugggaagccaaggcgagaggaucacuugagcccaggaguuugagaccagccuggacaacauggcaagaucccgucucuauuuuuaauaaaaagaaggaaaaaaaaaaagaagaagcauuuguggaauuaaacugaacaguuuuaacaauuguuaggugguuuagaaauacaagaucaauagaguuugaauuuuuuaauguaaguaacaaaauuuuguuaaauaauuccuuuuauuaucucagauuuuuuuuuuuuuuuuuuuugagacggagucucgcugucgcccaggcuggagugcaguggcgcgaucucggcucacugcaggcuccgccccccggguucacgccauucuccugccucagccuuccgaauagcugggaguacaggcgcccgccaccucgcccggcuaauuuuuuguauuuuuaguagagacgggguuucaccguguuagccaggauggucucgaucuccugaccucaugauccgcccgccucggcgucccaaagugcugggauuacaggcgugagccaccgcgcccggccuuaucucagauuuuuuaagugacuuaaaagcuuuuuuuaaaaaaauuagugacuuaaaaaauuuuuuuuaaauuucuuuuccuguaaaaggauauuaaacuuuugguauauaugcugacuuucuuacaggugaauaaacuaaggauuucugauguucugcaguucugaaauuuagagaauugcuauauaaggagugagacguaauguuuuagaccaggagcccugaagucagacugcauacuuacaaauccagguucugccaccuuagucaugagaccugggaaaguuauuuaaucuuucuauaccuuaauuacuucauuuaaagauaggguuaauaaucuauaccuuauaguuuuauugugauagcuaaaugcauaaaagugccuaggaugguguuuagaacauaguuaauauucaauagauuuuguuauuauuuuugugauguguuuaaaaguuccuuuuaauuuuuuccuucaaaguccacuuaacaaaaauguaaacuugguggacuguucacucuuaccugauaagaggauagaauaaauggaauucuuuuaacuaucuuuaauaguugaagaagucuguucuagcauuuuucuuuaagaagcuaugcuuuggugcucucagauacaucaguguccccuguguaacauucauacuuugaacaauuuauguuguuuucuaauaccuaauuaaaacuaaagaguaacuagcaauuuuaucuuuuauucaauaaggaagcacuaaguaauauggaugauuaugacaaaaccugcuuggagucugcauuaguugguguuugcaauaucguucagcaagaaugggguggugcaauuccuugccagguaaugaucaauucuuuuucauugcccuaaguuaacaacauuaaccacugaggugcuucgauuuucuucaggcucugacacagcaugcauuguaauuucuacaaacuacauuuuacacuauugguaucuucuuaagugaagguacuaaaucaacacuaauguguucagaaagcagcaaaguuaugccuuaaggaaagcauccuccuaguaaauugacuuauugcaaacuaguacuguuauauaaaacacaaagggcucacaguggaauuuuugaacuacaaucccuggaaggggucauuauaauuuugagugauaaaauuguaaacaucaguauaauauagccugucuucauuaucucaaugcaauuauucagcagacuuuuuuuuuuuuuuuuuuuuggagacagggucucacuuuguugcccaggcuggagugcaguggagcuauuauggcucacuguagcuucaaccaccgaggcucaggugauucucccacuucguccuccugaguagcugagacuacaggcaaaugccaccauaccuggcuaauuuuuuacauuuuuuguagagaccagguuuugccauauugcccagguuggucucaaacuccuggcucaggcgauccgcccaccucgucucccaaaguguugggauuacaggggugagccacugugcccagcuuuauucagcaaacuuaaccaucucaacugaguugucuaaaaagugaggaguauaaaacauaaaaucuagccaggcgcgguggcucaugccuauaaucccagcaguuugggaggcugagguggacggaucaccaggucaagagaucgagaccauccuggccaacauggugaaacccccaucucuacuaaaaauacaaaaauuagcugggugugguggugugcaccuguagucccagcuacucuggaggcugaggcgggagaaucacuugaacgugggaggcagagguugcagucagccgagauugcgccacugcacuccagccuagcgacagagcgagacuguguggcaaaaacaaacaaacauaaagucuguugcucuuuacuuagacuccacaguaggccacauuaguaucaaaucagagcagaguaguagcagaaaaagauaacuggaaauuuguucuauacagauacuuuugaaaaguaguagcauauuuugaaggaaaaagcagaaacauugcuaaaagaaaaaucauaauagucuacaacaggaguccgcaaguuuuuuuguauuuuaggcuuuguaggugucuguggcaacuacucagcucugcuguuauagcaugaaagcagccauagauaauaaguaaaugaauggguagggcuguguuuaaauaaaacuuuauuuacaaaaacagacagugggccaaauuuagccugugggccaugguuggcuggacccuggugugugacuuuucauuauggggucaaacaaaggauuccucaguaaugucaguagcaucacuaguauuuauuuauuaauaaaaaaaaaaaaagauuguagcuaggcaugguggcucacaccuauaauccuagcacuuugugaggccaaggugggaggauaacuugagcccaggaguucaagaccagccuggaccacauagugaggcccugucuuaaaaaaaauaagauuguaguugccugggagucagggaaagguaugaauugacucaaaagaagcaggagggaaucugggacguguugggacuauucuuuaucuuguuugugggggugguuacacgacugaauacaacugucaaaacucauagaacuguauacuaaaaagggugauuuuacugcauguaaguuauaucucaauaaacucaccuuuagaaaacaacaaaaacauuuuuucuugugaaaaccucccuguuuuauagaauauaguggauacuugcugaagaaaucaauagaugccuuuugaucaauuucuuuucugaaauaaaaaagcuuuuuauggcaucucagcuuauaggcauuacuuauuuugguaaauccaugcauauaggaugucuuauuuccuaacauuauagugaauaaaugaaguuuuguugucaguaucuucugaacugaaagcuagcaaguagcacaguuucauuugcuauuucuucuuugguuuuagaggagaaauucagauuuuaagaaccagaccuugugcaucaugcagacuucugacuuuuaugauuuucuucuuuugaaaaaaaggaagaaucugaauuugagacaacgugagggcaaggggccaagccugaaucugucucuacuaaaaauaaaaaaauuagccagacgugguggcgcauaccuguaaucccagccacucaggaggcugcggcaggagaaucgcuugaaccggggaggcagagguugcacuggucagccaagauugugccaucgcacuccacccugggcaacaagagagaaacuccgucucaaaaaaaaaaaaaacauuguaguagaggugguguuuacugguuauuguuuuuauaaucaguuacuauaaaacaaacuugcuuaaauguggaauuuuuggccaggcgcgacggcucacgccuguaaucccaacacuuugggaggcugaggugggcagaucaccugaggucaggaguuaaacacaagccuggccaacauggugaaacccugucucuacuaaaaauacaaaaauuagcuaaguguggugucguucaucuguaauccuagcuaccugggaggcugagguaggggaaucacuugaccugggagguggauuuuguagugagccgagaacgugccacugcacuccagucugggcaacagagcgagacucugucuuaaaaaaaaaaaaaaaaaguggaauuuuuagccaagauuuuguuuuuuauuuauuauuauuuuuuugaaacagagucuugcucugucgcccaggcuugagugcaguggcaugaucucagcucacugcagccucugccuccgggcucaaaugauucucaugacucagccaccugaugaguagcugggacugcaggagugugccaucacgcccuacagaagugcacuaccacacccagcuaauuuuuguauuuuuaguagacaagguuuugccauguuugccaggcuggucuugaacuccuugccucaagugauccucuggccucaaccucccaaagugcugggauuacagcugucagccaccacacccagccuuaaccaagguuuuagacagcuguacugugucuuuauuauuuaguaaagucuguuucauuuugacauuacgugaaauauuucauuaucccauagcaucugaaaaagccgauggagguaaaucauuguauagcaauucuugguaccuagaaaaggaaauugccuuguagucaauugacugucaugccaaaagaugacauccuuccaggggaccucuauuaagcauucuugggcuuuaucaguaagugccaaucuugauauuucacacagugccaccacuuaauacugccuuaagggccgggcgcgguggcucacgccuguaaucccagcacuuugggaggccgaggcugacgguucacaaggucaggaguucgagaccauccuggccaauauggugaaaccccgucucuacuaaaaauacaaaaauuaggugggcuuuauggcacacaccuguaguuccagcugcucgggaggcugaggcaggagaaucacuuuaaccugggaggcggagguugcagugagcugagaucacgccaccgcacuccagccugggugacagagugagucuccuugucaaaaaaaaaauacugccuuaauggccuauuguuaucaaguuacuggacuaggcuagggagagcaaaaauaauccucuccugggaugcaugggaagucuguccaccacaggaucauucugaagcaaugaagaaaaggaaaaugauuuugcaauuacuauccauuguugguauauuuuguugguuuuuucaaauuacagguuaagaaugcguuuuaaagaucuuauauauuucugguuaaauagccuuuauaaauacauauucuaacuaggugucauuuuaguugaccaggcguagaguuugucaucuuugaaaauaaaguggcaaaguucagacuacugugcugguacuuccuaggagcacaugugaaaugaaucuucauuccauauuugacauuguuauguuagguaccaacuccuuaucuaagaguugggguucuaguuuuaauacaauuaaguaagaauugguugugaauguuuuuguccuuuuuuaaguguucagaggcaagcuuuuaaaaaauauuuuauuagaugaaauagaguaaaacacauugaucuuaaguauacaguucacugaguuuugacaaauguauacaccuauauaaccacuacuacaauuaagauauaguauucuuuauccuauaauguggagugggguucuagcaccucacaaaauuuucucgugccuuuuuuuguuguuuuuuuuuuuugcggggccagguugaggguuuauuuuguuuuuccaaacagggucucacuuuguuacccaggcuggacugcaguggcauacucacuguagccucgacuucccaggcucaagugauccucccaccucagccucccaaguagcugggccugcaggcacgcaccaccaugcccaguuaauucuuguauuuuuuguagaggcaggguuucaccauguugccuaggcuggucuugaaccccuggccucuagugaucugccugccuuggccucccaaagugcugggauuacaggugugagccaccaugucaggccuguuuuuuuuguuuuguuuuguuuuguuuuguuuuaaaaagacagagucucucuguugccuaggcuggaguacagugaugugaccauggcucacugcagccuugaccucccaggcucaagugauccucccaccucagccucccaacgugcugggaccacaggugcaugccaccacuccuggcuaauuuuuuuuuucuaaguuuuuuuagagauggggucuccuuauguugcccaggcuggucucaaacuccuaggcuuaagcaguccugccuuggccucccaaagcacugggauuacaggcuugagccaccauagccagcccuggugccccuuucuagcagugaaaacacugcuaaaugggacugcguuaaauauguaauuuaauguacaaccuccucucucucuuuuuacaaacagguuguccuggugacagacggcugucuuggcauugguagagggucacugcgacauucccuagccacucaaaaucaacgaagugagagcaacagguuuccacuaccuuuuccuuucccaucuaaguuauauaucaugugcauggcgaauuuggaggagguaauaccuuuugcuaaguuuuuaguuugauuaggcauauuuuacagcuuaguuuauuuuucaguauauaccacuagugcuauauuguauauacuguagcauugaacuccauugguuucagcugaggcugguauuuuauuugaaaagauucugggucucaaauguucuuugaaauuucagaguguugccucaucuggggaacauagcuggaguuguuauccauccugcugaugggugcauaaagggucaagguguucuuuuugguguuguucauuucccuuauauagaauucuuauguccauuccaccagaaauguugacaagagugugcuuugacuuugacagaagaguaaaguaacauuauucugauacacguuuuauuaaacacuuaaauucuugguuuucccauucauuugggaaggugauuuaaccuuuuuuccccucaguuuuucucucuguaaaauguagauaaugaugguucucaccaaaagacguuagaaacacuuuggagggaagaugcuguguaaauacuguggucaccucugagaaucuuugcaaaacuacuccugaaugaaauagcucuaccuguguuauuuuacguaacauuccucuuugguaaccuugagucaaaauuguuguuguuauuuucuucucacauuggcuauuaaaaaaaucaucuguuauuuauugccuauguuaucguaauggcuuugaccuuggugagcugagaauaaucuggcauuuugugccagccacuuuaagggucaucuguuuugcuuuauagcuccagagcaccgauuccuuggaaugccuugaacgucucauagauuuaaacaauggugaagggcagauuuuuacuauugauggcccccugugcuugaagaauguacagucuauguuugggugaguauaugcuuagagcucuuuugccuucuuuacaauccaguauuauaauuugacauccaggaagacuaucuguuuuacuguuccuaauugugucauuucauuuuccccaaguuguacauuuuucagauaaagugauggguaguaaugguuuuuuaaaguaaaucuauacugucuguagauacugacuuccuuauaaugacucagcaaaauuucaaauuaacuugcucuugggcuuuucagaauugaaauuuccucaccaaaaaugucagauuuuguucuguuuuacagauggucagaucuuaguuuuggaaccaacuugaaaggaaaacaacccuugcguccugaaaaauuaacuucauauguaucguauuacucuuccuauaacuauuaauuaucauauucuagaaaacugauagauuuggcauauacgccuuuccaugcuguucucaaguguggccaccuaacugcugauguacaagucuuccccaggccagaaccuuuuguuguagaugaagaaauugauccuaucccuaaagucauuaacacagguaacuuuuuaaaaaaacuuauuucuuaguuucucuguuauccuuacuuucuucugacuugugacuuuuacucucuucucugucuaggaagguugaaaagaaauauauauugugguacagguugaguauuccuuacccaaaaugcuugggaacagaggugcuuuagauuucagauuuuuugggguuugggauauuugcauuuuacuuagugauugagcauccuuaaucugaaaauccaaagugcuccagugagcauuuccuuugagcuucgugucagcuucgugcauguguaauaguuguggauuguugagcauuucggauuucagauuuucagauaggggauacucaaccuguacuagggugcuguugucaucagcacuuuggauuggaagauucauuaccuaagggguggcagaauauuggucuuuuaugguaaggucaucaguugaucuccaauccuagauaauuauaaccacgaauuauuagaguuggaaaucauagccguauucacuagcauugaaaucuuugagaugauucuuaauagacauacugaacuuaauuaguaucauaauuaaggucauauaagaagggcuagcuucuauacuuugcaguaugacucuugauaugugacccugggaagucuuccucuaguucuuauuggcuaggcagggagaaucaaccagauggucuuggaguucuuggaucugauauaguguacucuucuagcacugcugcuuauauuaugacugaaagaaagugauguaccacagcuuuuaccugguucguguugccaauacuaugcuuaacugagacuggcaaagugaagagucaaaaauagcaaggagcaguggagaggagacuugcuuccuauugguggguggacuccuugaaucuuaggugcauguuaaaucuuuuagggcuggauauuaucaguguuucagucaccauuacagccuugauguccagcauagugccugacacuuaguaggugcccaauagguaauuguucagucaauaaaugauuagaauuaaauguucagugaaugcucauuguuugugguauacagauuuuuaaggaguguuggagugaggggcugugaacagucuuuuuacuuuuugugccuuuagcuucuggaagcaaggcauccaucucuucuacugugacuagacaguaguacauuaaguuguaccaaaagucuuguugccuucauaacaguuagauuccacuuccuucccauccuuuuucgaugaguaaauuugaauaggucuuuucuuucccauauaaacucuuaguggaagaucuuucuugcagcuaaacugcuuuaaaauaaaguagaccuuuuucuacucaaaugaaaaauaucuagcugcuuauacuaaugcauuuauuacucagcuaagggagguauggacagcaaaucuccagagaagcacacuuccuaauauuuuagaaauagggucgggcacgguggcucacaccuguagucccagcaguuugggaggccaaggcgggcggaucaccugaggucgggagaccagccugaccaacauggagaaaccccguuucuacuaaaaauacaaaauuagccaggcgugguggcacaugucuauaaucccagcugcuugggaggcugaggcaggagaaucacuugaacucaggaggaggagguugcaguuagcugagauugcgccauugcacuccagccugggcaacaagagcgaaacuccaucucaaaaaaagaaaaaagaaauauaagguguucaccaugauucugauuuuuaaaaauucuuuugaaaauauggguauuaaucuagaagaaagacugaaaagcacaucaauaaaauauuaauagagauuuccuuugauuaugaauaaugagugacuuuuucuucuuuauaauuuuuauuguuuuuaaguuuuuauauuauauaaucgaaauguuuaaguucuuuugguuacaacauucauuuuuauuuauuuuagguuuucaacaaauacuuuuggucuuuacuacagcgucuauaaagcagagaagucauugucauauuuagacugcuuacccuaguuuuguagagaauacaguucuuucucagagagauguuuuuaauacaauagcuuuauucuucaaaggcugaguguaguugcugcggaaguguuugacuaugaugcccccuggugaccugaacaucccugacuacacagagggauuagaccuuucaguuuuugccuuggcugggguccuaaccuuauaaaaauaaaauuuagcugauuuugucauauaacuuagacucauuaaaucaaugacaguuaucauuauuuccugagcagcuuaaaaugcaaauuauuagacgacuccauauacaaaucuaauaacuuucccagucaucauauuugaaaccccaaccuaaacagugcauuugugaaauguaauacauggaaaauaauguacuuuuccauagaaugaauuaauucuguguugauuccuucauuucagauuuggaaauagugggauuuauugauauagcugauauuucaagucccccaguucuguccagacaucuggucuuaccuauagcacuuaacaaaggugaguuccuauuccacugauacgucugaagcgucuuauuaacuaaaguuguucuuaaaucuuagauaguaggauagcccauuuugcagaauuuaggggaaaggaauaguuacagaauuggauuuuagaaaauggaauauugccuaauauaucaaaaaaguaauucugcuuuacaugguagaaacauuuugacacauauuuacuguguguugguuugugaauugacaguggagguccucuuuagagaugagaaugcuuagucccucauccagggcucugccuuuccuaguacuaacaugcugagaaagcuuaaguaguuaucagaugguuacuugauaaaugugcaagucaaauacagcuuuauacacggaagaaucacaucuguucuuuguucuacuggugcccagcacauaguagauaacucaguaaauauuguugaaugaaugggugaauccaggcccuuguggguccuccuuacugcagcauauaucucuaggaacuauaaagucaucuccucaaauucagcaucucucuggagaaugcuagacucuaacucuuuaaaauuaucuuuuucagggguggcacugugcugugguggguauagagcaggagcuuuugucccugacuggcuacagguucaaauccuaguucuacccuuaaaauuaucuuuuccucuguuuuaagcugaccauccacuuuauauuuaucagcuuucucuaagaacuguauguagucagucagguuuucacauacugaguaaugaccacaucccauuuaugcccagguuaucucaguuggaguauuggauauucuauaaccaaucacauguucacagacagaaucuugaauauauacccacagacagcuuuauaaucacuguguugguaauuauuauucucagagaacagccagauuucccuuaguucuaaggcccuggggaauucugcaugccaguauacuuaccaagaaagaaauuaagcaaaauaaaccauuuauauaggggaauagugaaaagaaaaauacgggaagguggccgggcgcgguagcucacaccuguaaucccagcacuuugggaggccaaggcggguggaucacaaggucaggagauugagaccauccugacuaacaugguaaaaccccaucuccacuaaaaauacaaaaaaaaaaaaaaaaaaaccugggcguaguggcaggcgccuguagucccagcuacucgggaggcugaggcaggagaauggggugaaccugggaggcggaguuugcagugagccgagaucgcgccacugcacuccagccugagcaacagagcaagacuccaucucaaaaaaaaaaaaagaaagaaaaagaaaaauaugggaaagcagaguagggccauuuuguaagggcuguugaauuuucuagcuaaacugggcuaauucuuccuguugaauuagaaagucuuugaacaaagcagagcagacagauauuuuuagagggaaguuaauuguaggaagauucaucugucagcagagugugagagaaacuggagaauccagucaaaaagcuuauaaucauuguuuaccuuuggggacucacaugcaugugcugcccuaagccuguugguuaugaaugcacuugacaucucuguaucuaauucuguuuaaaugggugccugaagcuuccagauagcaucuaacuaaacauccuaguggaacuguggagaauggauuuuuguguguaagcuuuacugagauauaauucacauaccauauacuucacccauuuaaagugguuuuuaguauauuugcagaguugugcaaccaucaccacaaucaauuugagaacuuuuuuauaaccccaaaaagaaacccuguacccuuuaacuaucaacucccagaccccuccccccauuuccccuaccccaaauaaccacuaauauccuuucuguauauauagauuugccuauucuggauguuuuauauaaauggaauucauauaauguguggaaacugacuuuuauguagauauuggaaaacuggaaugaguuuuuccugcuuguuauaauauucccuuagaacucuacacuaucccuuaaaggcuagaaacauccaagaguauaaauugggguuugggguuuuuguagguaauuucagucugaccuguuuucucuuuuuuucacagaaggugaugagguggguacuggcaucacugaugacaaugaagaugaaaauucagccaaucagauugcaggcaaaauacccaacuuuuguguccugcuccaugguagccuaaaaguggaaggaaugguagcgauuguucaauuaggguaggaaacuuuguuuacauuugguugaaugaaagggaaaaucauuuuacaaagugaaguauuuugcagacuuuucugaaggaaauagaaagguccuugucaccuuuuuccuuuuccugccacacacuuuucccaccugcuacuacaguccuuuuuuuuuguuuuuuuugagacgaggucuugcucugucccccagggguacaguggcaugaucacggcucacugcagcuucagccucccaggcucaagcaauccucccaucucagccuuccaaguagccaugacccaggugugcaccaccaugccuggcuaauuuuuuuuuuuuuuuuuuaauuuauagaaguggggucucacuguguugcccacacuggucuugaacuccugggcucaaggauccucccaccuuggccucccaaaaugcugggauuacgggcauugagccacaguaccuagcugcuauuaccuucuaaacuacucuuuuaaucauccccuagaauaaguguggagugagccuuuuaauuacguugccuuuauuuuauauccuuucucaauuuuccucuuucuaauccuaucuagaauaccuggguucugguuauagcaaugcuacuaacuugcuuuaggaucuuaggcaggauucacagacuucucaucuauaaaaugaggggauagaacgaaacaaaaaaaaagaugcuaauaacauugagcauuuuauuaugugccaggcacuccucuagguauuuuacauauguuagcacauuuaaucccucauaacaacacuauaugggagguaucagcauuaucccuaucuauagaugaggagacaggcuuaagagagguuguggaacuugcccaaggucacacagcuaguaaugaaagaaccaugauucuuacccaugcauucugacuccagagccuacucauaaucauucugcuguguuccuucccugugaggaaaccccguuagcuuuuacauuuucugaagucucaaaaucugcaaaaccaucuauuucccuuucuauaauacauauuuuuagaaaaaaggaggucacugaucauuuucuggccacuaccugggguuggcugguauagaucaagaguuaggauuaauuaaaggaagcauggcuccauuucugcuacaguuaaaauuagcugguccaaaaagaggaaugcagaucuuacuagauauuagucugcuauauuucuuggcacccaagcuacuuguacuggucugaauaugagaaucaucugggacccuuugagaaacuggggacagagucucuuuuacauaacaggaugauggccuugagcccugugguagaagggcuucucuuggugcugcugugagugacucagugaggcaggugacaggaccuauaggucacagccuuuaccccuccucaucaccucuccagcuacuugcugcccuuugugauuuguuuuuucucuuucaagauugcuuuugauuuccauauccacauaauuuuaccugaauaauaauaaaugucucagaagaauggaaauauuaggggacagcaguaugcauuuucagguuuaggguuuggcuuugguaaaaguagugugccugauuucaaagcugaagccugugucucucaagagaaaaauacaggcuagacuuauuuaacuugacagucucaggcuugauguucuucugaucuuccgucuucucuccaucuaguccugaauggcauggaaugcucuacucccaagcugacagcaagaagaaaucaaaccucaugaugucucucuuugagccuggcccagaaccucucccauggcuagggaaaauggcacaguuggguccuauuucagguauaauccagaucagauuuuacuuauccugacuuuguuuucauucugcuguucucaaugucucugacugugcagucagagaacugauugaucucccuuacugguaugccauggucucggaugaugcuggauguguacggugaaaacuugaagagaguuugauguuugaacuccuaaauuuuacagcucaggagaaaucaacauuuagauugcuuuaaguaaaugcaaauucuucagcggcuuagagugaaaaacuaaucuccauaauuuuuuuucuugguguacuauaguucaaguaauuuccugucauuccuagauaauguaaucuuuccuccuucuugaaacuuuuuuucuguagcuuuccugacauugcuucugguaccgauuugacuuuuucuuuggcggacuuuucuuucucucuucguuuugucuuuucuucuccuugccucaugguuuccaacauguucuuugccuucuucucuuugguuauucuucucccuugguuauuuuaucagcuguaauaacuucacauuucccaaaucuauaacucuagucuuaccugaucucucccuggaauuugcauaucauauuuccaguuccuaguuggaucucuacaccuggauauucugucacagucucaagcucagcuguuuguuacagaccuauugucccgcaccccuuucuccucaaacuauuccuccuucugauuuuccuccuccuuuugauuaagucauuugugccacuagcuacucagguuccaacuguagucaucuuugacucauuugggcccauuucaauuucaggaacaucuaccaagcaaccuauucugugccaggccuaagggauaaagaguuagcuggaguuguucaaagucuaguggaaaguggaaugaucacagacuggcacaaaucagaguuagccuggaggagaugaugaugagcucugccuagaggacucaggagaaucuucacagaggagaaauacccuaguugaguuuugaagaaaaggaggaacuugcugagcuaaugaagggaagaaagggcauccugggcaaacagaacaccuacagaaagaaaaggaaguguggcacaaaaugugagagugggugugggaggggcagaugguagauuggagauugguaguagcuagaguggagcaggccuugucugaaaugugaagaaccaggaauuuaucuugcagauacugggaaaccacugaagaggaguaaugugaucagauccuucuggcuacagugagaacagggggauaccaguuaggaaacuauauuuuaggggcuggugcccccugcaguuguacaguauggccauaauccaagugagagauaagaaauuuguauuuagaaagauaucucuguggaguguggaucugaaaaggcaaggaccuguggcugaaaguuacuguguuaauccuggaaaugugaagaugagagccagaccguggcaauagcuggggguaaaagauauuuaggagguaggaucaauaauguuuggauaugaaaauuauggagagagaaguguuaaaauugaucccagguuucugaccugggcugcagggugaaagauaguacuauuaguugaaauagauaauacagagagaagaguaaauuugggaagaacauauuuuguuuauguugaguucgugccugugagauacagguggagguaccuagagacaauucuguagaagucugaaguuuaggagagagggcagaguuggagauaaaauuuuagguuguaagccuaucauaaauaguuaaaauggugagaaugagggagauugcucagggcagugguucacaaauuuugaguuuuuguguacaaaaauaaacuuggaauaaauaccacauguucucacccauauauggaagcugaaaaaaaaugagcucauagaaguacagaguagaaucuagaaucauggucauuagagguugggaaggguagugaggagaggagaauaggcagagguaacagauacaaaguuacagcuguuagggaggaaaaaguucagugcucuguagcaugguagccugaauauugcucacaauaauuuaguguauauuuucaaacagcuagaagagaggauuuugaauauucacaacacaaagaaaugauaaauauucagccaggugugguggcucaugccuguaaucccaguacuuugggaggccagggcagguggaucacuugaguccaggaguuugagaccagccuggccaacauagcgaaacccuaucucuaccaaaaauacaaaaauuugcugggcaugguggugugcaccuguggucccaguuacucagggggcggagguggaaggaucgcuugagcccaggaagcagaggcugcagugagcccugauugcaucgcugcacuccaaccugucuggcccucacagaaaaaguuugccaaccucugacuagacuauugugaugguuuucaccaaagaugccuaucuauaaucuaagauaguaguagcauucagacuccuuucugaucuggcuuccaacauagcaacacuuggcuuguuacaauuguucuucauuccaguugaacugcuguucacucugcccuguguucauguuguuuuuuccuccuggaucuguucugcuuuucaguguggauaauaauagcuaauauuauaaugaacuuaacuuugugccaggcacugugcuggacauaaugagcauaccaucucauuuaacucucacagcagucuuggaauuggaauuaugauaacaaauaacaauuaauaauaaaacuuaccucagaggguuguugagcaaaacaugcaaaauagcacuauuguuuguaccaaucccuccuacucccaauucuguuccuagagacaacuacuuuuuaaaacuuauuuguuucuuuugguauuuauuuauauuucuuuuuuuuuuuuuaauugagacagagucucacuccaucgcccaggcuggagugcaguggagcagucuugguucacugcaaccuucaccucccagguucaagcaauucuucugccucugccucccuaauagcugugacuacaggcacaagccaccaugcccggcuaauuguuguauuuuuaguagagauaggguuucaucauguuguuggucaggcuggucucaaacuccugaccucaaguaauccuccugccucggccucccaaagugcugggauuacaggcgugagccacucugcccagccuuauuuacauuucuaaauaauauagguaugucccuauuucugucagggguucccccauuuuauuauuauuauuauuauuuuauuuauuuauuuugagauggagucuugcucuguugcccaggcuggacuguaguggcgugaucucagcucacuacaaccucugccuccuguauucaagcaauucucgugccucagccuccccaguagcuggaacugcagguguccaccaccacgcuuggcugauuuuuguauuuuuaguagguacgggguuucaccauguuggccaggcuggucucaaaacuccugaccucaagugauccucccgccuugaccucccaaagugcuggaauuacaggcacgagccacugugcccggccucccgucuuauuauuuuuuauuuauuuuuugagacagggucucacucugucacccaggcugaagugcaguggcacagucuuggcucacugcagccuugaccucucgggugauccucccaccucaaccucucauguggcugggaccacgggugcaugccaccaugccuggcuaauuuuuuugauuuuuuuauagagacaagaucucacuauguugccaaggcuggucucaaacuccugggcuaaagcaauccuccaccuuagccucccaaauuguugggauuacaggcgugagccaccacacucagcccuuuucccccauuuuagaugccauuuuuugacuuuuuaaaggaugaauauuuagcucuauuaacaccaccaucucccacccaccuacacaagacgcacauuuccccuccuacuauccucccaauauaguuauaauguucuuuuugguuaaaucaguauucaguccuuguuacaugauguaaauguuauuuacaacuaagcuauaccaauuuguauuuccuuuguuuugcaacuuuuuguccccuagcucagucccaguuauuuuuuuucuuugcuuguuuucuauauaacuaauuccucccuaaguaaaauacauucuucagguauuuucucaguuuccuuuuuuuuucuuagcgucaucucccauccuccugcuucauaaaugguaugguuauuccccagaccuguugcauagguguuguccugagucuccccuuuacaucucuccuauggaucuccuguucauaacuccuccugaaaaaaaggguacaugggaaguaaauauuuugaaaucuuguauauuuugaaaauauauauauguuuauuucauucuuuauauuuaaugauaguuugguugggaauugaguucuaaguuggaagucauuuucccucagaguuuugaagcauuacucuguugucucuucuggaguccaguguugcuacggaaaguuagugccauggugacucaaagaccuuugacccugaacuguauuuucuccauauuccuuggugaucuucuuuguaucccugguauucugaauuucagaauguuggucucuucauugauuuugcuaggcacucaguggacccuuuccaucuggcaauucaugaucuucaguacugggaagaucaauuauuucuuugauuuccucuuucuguauucucuguucuccuuuucuggaacauauauuugugauuuguguuuguaauuuucuaucucuuucugcccauuuucccauuuuuaaaauuuuuguucugucuucuguaucuucaaauuuaucuuauaacuuuuauuuuuuguuuauacuaucuuuuuaaaauuucuucuuucauaaauguaauauuuccugucuccuaagccaguuaguuaccacauauaggcuccagacaacuaaugacaguacaaaauaggcucugauuagauguugaaauguuugguacugauacuaagugcuaggggauaaaagggucuacaaaaaccacuaucugccagaaaaacuugaaacaauuucauggaagggguaagauaggaucuggacuuggaauauagguagguaaguuuggauaaguaaggaacagcaguguugaaugguggaaaaaguguuggcuuuugaagcaggcccaacugagucacugugaaaccuuguauaaguccaaccucucugugccuuaguuuccucaucuuuaaugggacuaauaacaucuucgcucuagaguugcuauaaagagagaaguugaauauguaaaguaucuugcacauaguuggaacuuaauaaauauucuuuauucuguaaguuccuugaggcugaaaaguaucuucucuaggcacaauuccuggcacagugcuugcuacguaguggggucuuacuauagauaaugaaugaauaagugaaugaguaaaugagugaauaagaagggagagcauucuaggcagugaggaguaauagaaauagcaggaaaguuggaaaugaacuguugugugggaaaggacuugcaggaccuuagccugacucagaagguuuauauauugacaaauauuaauggaaauacgucuggagaguugggccaguauuuuauggaggagucagggcugaagaggguugacaaaggaaguguugguccaauaucaagguguuucaauuaaugaccaaaucagggauagagaaugucuggcucaauuagacagacuggucuaauuacauuuuucaacacaaacuuuugggcaagagauuuaaguucucugaacuuguaggaaaaugacuccugcucugucuacacgagaaggugguaauaauaauaaagaucaaauacaccauuagaaguaugugugcuuuauaaguuuguggcaguuucauagacucaggaagcagguacagagacaaacccuguuuguucauguagcuauaaaaccaauguggcuuuacauuuuuggaagcaauaaacuaauaagccauauugggguaugcuucaccaauaaaaguauuucuugucuugcccuuugccuuaauuuggcuauauauauaguuuuccuuuuuaauuauuuuaaugccuagaccuaugcugucuaauccaguagcuacuagccacauuaaauuuaauuaaaauuaaguacaauuugaaauucaguuucucagucacacuagccacagggcaagugcuuaguaguuaguagcuaccacauuagacagcacagauauagaacauuuccaucauacagaaaguucaguuggagagcacuggguuagacuauauagaauugcaguauauauaugugugucuauguguauguauauauauauauauuuuuuaaauauguauuuguuuuauccuuugaccuuaauuuauaaaucagauaagugaagcuuguuucuuuaaaaacauuaagcuguuuuucacuuaaaugggccuccuacaucaguggcuuucuauugagaacagguucuccaaccugacugaaguuaauggauuuucuuaauuaacaaagugauaggauaucaaagauugagugauucaaagagcuucuagucuaaauggaaauguaacugauuguguuuuaccagaugucauuucaagaaugucuuuucuuuuaagaugcuaaagaaaacccuuauggcgaggaugacaauaagaguccauucccccugcagcccaaaaacaaacgcaguuaugcccagaaugugacugucuggaucaaacccagcggccugcagguaacauuaccauuuauguugcuuuccacuggggacaggagacauuuggguaggcaggcaggcauuuuauuugauuuucuuuuccuuugauacuuaguaauucauuuacuucuaauguuugucauuauuuccaaaagggauuugagaugcccuacaguaaaacauguauauagcaaaaucauuuuuuacaaaauuuagagcaauaagaauccuagaggaaggaggaagaaggaagacaauugugccaggaacccaaggcaaaauaauaacuuuaugugaguguuuuggcucugagcuuccuguuaccaaggucaguuguucuugucuaaagaaaggaaauuugucaguuugucuagagagacauauuuuccuggcauugaauuuuagugugaaauuuuuuauauggugaggcauugacuaacauaauggguauuggcuuuaacaacaguuuuggaaaagauguaaaagucuucauaacuauauuucuuccaucccuucaguagaacucaagccauagcauuacauuucacaaaaacacuuccauaggaaguuaugauaauaugauuaucaaggaaugaugcuuucaggcaugguauucaggaacauaugauaauaugauuaucaaggaaugaugcuuucaggcaugguauucaggaacauuucuccuuucaucagcaaaaagucauuuauaccuguuuuuaaaaaucacuuauugaaacuuuuuucuccuuugagcaccuuuauuuacauuuguucuuccaguaaguucaaccuaaaccaaaugagaagagacaggccacuuggacaacaaaaguaguuucuguugacugcacagucucugagccccguuuccauggagacugaaccacauccugccaaggcuaaagugucaggggccucuuuguuggaaaaucagggucuucuauuuuccugauaucccugaccccagugcuuccuugucagagggauauuagaaccacuuucaccaccaguuauagcugagcuuuucuuaaauuauuuuuuuuaauuuuuuuuguuugaaucuucacuacuaucuuggguuuauuuuucuuauucugguaaaauauacauaaaauguaccuucaaccauuuuaaaguacacaauucagucccauuuaguacauucacaauguaccaucaccacucucuaguuccagaacauuuuaaucacuccaaaaggaaacccugugcccauuaggaaagucacuccacauuccuucuuccgggcccuggcaaccauugauuuucuuucugucucuauggacuuaccuauucuagauauuucauguaaacagaaucauacaauuuguggccuuuuguguuugacuucuuguacuuagcaugauguuuucaagguuuauucauguuguaguauguaucaguacuucauuccuuuuuauggcuaauauuccauaugucuauauguauaugucacauuuugauuaucccucaguugacggacauuaggguuaccuuuuggcuauuguggauaaugcuguuacaaacauucauguauaaguuuuggucugaacauuuguuuucaauacucuuggguauauauuuuaaugggaaugggauugcugggucagacagcaauucucuuuaacuuacugaggaauugccacacucucucacagcagccacaccauuuuacauuucugcuagcaguguauaaguguucuaguuucuccacguuccuaccaauacucauuguuuuccuuuuauuauuauuaucauauagcuaucauaguaggugugaagugguaugucuuuguuuuugcauuuccuugaugaccaauaaugugcaucuuuuccugugcuuauuggccauuuguguauauuauuuggagaaguauauacucaaguucuuuguccauuuuuuaauuggguuugucuuuuuguuguuggguuuuuuauauauucuggauauuaugauccuuagcagauacaugauuugcaaauaucuucucccauuuugugaguuaucuuuucacucucuuuauaguguccuuugauacacaaaguuuuugguuuugaagaagucaaauuuugucucuugcuuuuguuguuugugcuuugugcugucuuaacuaagagaucauugccaaauccaaagucauaaagauuuacccgcuguguuuucuuuuucuucuucucuuuuucucuugagaaacacaucucacuacguugcccaggcuggucucaaacuucuggccucaagcaauccuccugaguagcuaggauuacaggggcacaccacugcaccuggcccguuuuuuucuaagaguuuuauaguuuuagcuuuuacauguaggucucugauccauuuugaguuaguuuuuuguauaugguaugauguaaggguccaacuuuauucuuuugcuuguggauauccaguugucucagcaccaaauguugaagagacuauuuuuuccccauugaaucgucuuugcaaaaaagucccuggcaauagauguauggguuuacuggguacauuuuuaugaggcaaguucguuucugucaggggauuuauuuuacugucaagccuuuugaaggagggagugcuuuacuaauguugaacugacauuaacucagaagggauccucaucuugacauuguagcuguguucucauuuucaucucuuuaaacauuuagauccauucuuuuauauuauuucccuuuuuuaccacagaauucuaauguuggauuuuuuuuuuuacccuuaauagacagauguacagaagauuuuaagaaaugcaaggaaacuaccugaaaaaacacagacauucuauaaggugagacagacagaagaggaugugcccaaaauauaugguucacgacaguaaaacugugagauggcagugugaauaugggcagggguuagagauguaugacuugugccucaguuuuuucaaauaaacucaguaaaagugauaggucuguuccuucccuaaaauccaagaauuggaagaauuuaaauggccuaauucuguacaggcagaagguuuuucuguguuggggcugcugugaaugaaugacugauggaagcagcuuagaggaccugugggucauagcccugaacucuccucaucacuccuauauggguauccaggccaaccccaggcaaccaauguauguggcuuccuggauggggaauugcccagaacauucuuuuuuuuuuuuuuuuuuuuuuuuuuuuuugagauggagucacacucuguugcccaggcuggagugucguggugcaaucuugggucacugcaaccucugccucacagguucaagugauucuccugccucagccuccugaguagcuaguacuacaggcacgugccaccacgcccagcuaauuuuuguuuuuuuguuuuugagacagagucucacucugucggccaggcuggagugcaguagcacgaucucagcucacugcaaccuccgccucgcgggcucaaacaauucuccugccucagccucccaaguagcugggauuacaggugugugccaccaugcccggcuaauuuuuguauuuuuaguagagacgggguuucaccauguuggccaggcuggucuugaacuccugaccacagguaauccgcucgccucggccucccaaagugcugggauuacaggcgugagccaccguucccggccuaauuuuuguauuuucaguagagaugggguuucgcuguguuggccaggcuggucccgaacuccugaccucaggugauccacccaaagugcugggauuacaagcgugagccaccccaccuggccaccccagaacauuuuuauugcaccagagacucugcuucuaggaaugauaucuaacauuacacauuuaugaauugcagaggagauagcccugcagaaucauaugcagcuaauccagaacgauuggugaagagacuguuaaguuacagggggugggguagaguggggaacauuuagguuugcuccuugauucuccccuauuguucugguguuuggcuggaauuaaauuaagugcagcauaaaguaugucauuugugucuuagcuuucuaauucuaaaauguggcacacacagccagccuuaggcuagcaucuuaaccagagaagauacaugcuacuuugucuggguguuaucucauuaccuuuaugucacuguugucuucaaacuuaauuauguaguaagcuggugaaauaaaacagcuuuaaucaagaguucaacuggagagcuucuuagccagccaggccccucccuaaacugaagcccauaauccacacaguccauccucccugcagagcuuccuacagucaucagcuauuuacucaugaugacacacuuguuuggccuucuucuuaacuuuccacuuuuuuaacagaugauaguagaaagauggucagagagcccauuucucuuuucugguuuuauauaaugcuacauauuagagcucaaaagggccuagggaaagugcuucagccucugcaguggguaaggaagggguuauucuccucauuuuauaaaugaggccuuugagacccagagaggcuauauaacuugcccagaccacuccacuaagggguuguuggggcacuucauauuucucugcuucuaucaguaaccagccuuucuuuuuguuggucuuuccacucugacuccuccagggccuccucuugagccuguuuauugucuuagccugaggccccaccacaguggcaucagaggguuaagagcguuuucagauugagggcaagucuuuuccauaccuaaauaacaggggaaaaguacuccuccuuaaaguuaggaguaacgaaaugauggaugcaaagugcugacuaccacauguggcauaaaugcucauuaacugugaugaugacguuguuucauucagcugucuuccuuagccugcuucuggucaccugcagaggaaccacuucccaguaaaaccaucacauucuuguuacuggcaucccuaaauaaacauuuguucucauauaaaauugcucccuaaaguucagucaaggagaacuuaugcuaagcugagcacuuagaaaguauguguuaggaacacauuucaggagcauuggugauuuucugucuuguuucaggagcugaaccguuugcgaaaggccgcucuagccuuugguuuccuggaccugcugaaagggguggcugacaugcuggaaagggaaugcacacugcugccugagacagcccacccugaugcugcauuccagcugacccaugcugcccagcagcucaagcuggccaguaccggcaccucugaguaugccgcuuaugaccagaacaucacaccuuugcacacggacuucucugggagcagcacugaaagaauuugaaacugacuuuuggagcuuuccuucuuuuuucauuucaacugaaaaugcuuuagguaaaaaccuuuccaguauguucaccucuagaauagccacccaaagaccuuccugaggcugccucagaagcaccacuugcuguuuugaaugacucuacuaguaugagaaggaugugaaggugguuggcugguugggcuuuaacuuccugggauucauaauuuuuaagcuuggaagauagcugcuguucccaugaugggcacauuuccugagaagcuugaaugacugaugagcauagagcaccccugccuuccucaggaaaccugaccggcaggggcucucuggcuuccugaaagcuucaccucuucccucguuuauaucucaacuguaagggcauuuucaagcuucuguucauggaaugagcaacucagacugucuggagcuugcugaguacaaacacaccaccacuaaguuucagaacuuuccuuagaacuugggcaaaauguggugguaacucuuaagugcuuuugguaucucuugagauucuaacuuuuaaagagcaaccauuaauguguaaaaugauuccuauuauucaagguuuuuuuuuaaugaaaauaaaauauuugauuuucuagaaaaugguuucacuaugaaacuaaaggucguuugcuuuuggucugucuuaucacuuuaauauaauuucaacuuucuaaguggcauagauucauaaaucaugagguuuccuuauuucugacacugauuaggccucauugccuaagcaagguucuggcuagguaauccugacagaucaccgauccgauuccaaaguuaauuaugguuccaauuuaucagcuagcuuuaugacuuugggcaacuucucaaggcuuugucugcaucaucaguguuuuucauuugcaccaccuuccauguaacucucaggcuucaaccagagcaacuguuuuugguuuaacaugcugaacugcuacauaauauuuugccugaacaaaggucuuuaucacuaacagagaaccauuagacuaaauuaucuuuaagcacaguca

SEQ ID NO: 16046 - RNA, 3130 nt, Homo sapiens
cauggcacgggguccacagacccuggugcaggugugggugggcggccagcucuuccaagccgaccgcgcccugcugguggagcacuguggcuucuuccgaggccucuuccgcuccggcaugcgggagacccgcgcagcagaggugcgccugggcguucugagcgcgggagguuuccgcgccacgcugcaggugcugcgcggcgaccggccggcgcuggcggcggaggacgagcugcugcaggccguggagugcgccgccuuccuccaggcgccggcgcuggcucgcuuucuggagcacaaccucacgucggacaacugcgcauugcugugcgacgcggccgccgccuucggccugcgcgacguguuccacagugccgcgcucuucaucugcgacggcgagcgcgagcuggcggccgaacuggcgcugccugaggcccgcgccuacguggcggcccugcggcccagcagcuacgcggccgugagcacgcacacgcccgcgcccggcuuccuggaggacgccucgcgcacgcuguguuaccuggacgaggaagaggacgcguggcgcacgcuggcugcgcugccccuggaggccagcacguugcuggccgggguggccacgcugggcaacaagcuuuacaucguggggggcgugcgcggcgccagcaaggaggugguagagcugggcuucugcuacgaccccgacggcggcacguggcacgaguuccccagcccgcaccagccgcgcuaugacacagcgcuggccggcuucgacggccgccucuacgccaucggcggcgaauuccagaggacgcccaucagcuccguggagcgcuacgacccagccgcgggcugcuggaguuucguggccgaccugccgcagccggccgccggcgugcccugcgcccaggcuuguggccgucucuucgugugccuguggcggccggccgacaccaccgccgugguggaguacgcagugcggaccgacgcguggcugccaguggccgagcugcggcguccgcagagcuauggccacugcaugguggcccaccgcgacagccucuauguggugcgcaacggaccuuccgacgacuuccugcacugcgccaucgacugucucaaccuggccacgggccaguggacggcgcugcccggccaguucgucaacagcaagggagcgcucuucacggccguggugcgcggugacaccgucuauacggucaaccgcauguucacgcugcucuacgccaucgagggcggcaccuggcggcugcucagggagaaagccggcuucccgcggcccggcuccuugcagaccuuucuccuaaggcugccuccuggcgcuccugggccugugacuucgacaacggcagaacugugaccucugggcuggcuuuaggagggaggagacgccgcgacuccucccugagcuauggcugagugugugaggccggccuuagaaguagcuggcaacuucccucuuucuacugagacacccagguuuggugccuucuggugguguggacauguucaagaagcucagggagcagugaugaugcccucaaauuacuugggcucugcugagagcuggugggucacaaugucagugaacaggguagggggaguugggauuugaauaauccgggcuuauauguaaugggcuagugauugagcaucgcugggagcgacuuaaaugauguuaaucaaacugcaaguaguaggcaagaauuaggcaccuacuguaugcccaauacaguguuaugcguaaugagagccguaguugccacacagggauccaggaagcuuaaaggauaacccagaaaacaaucuuaacaguuacaggacaacaaaaagguuuacacacaacuugauccacagaguugaaggcaacaugcaaaaaaauuuaaaaccgcauacaauauaauaaaauaaagugcugaagaaaucagggcaaagggaaaauaggaagagaaaaaauauauaacuccagaaaagaagagagugugcaaacucuauggaggagaugagcaggauaccauuagcugcugaaaggggaggcuuagaccauggaggcugagagcucagaagagaagcaggguuggggaaggcuggagcagauggggagggucucugcaaguccagccauaccagcagagcagcaguaguuggggcaucuagagaggggaugagacugggccagcuugcagcagauaaugacugagcugagccuggagugagaccugugggggcgagaggauucuucacguuccuuuuuggaacccuuaggggagcacccagguguaagcccuugcccacccuguuuuugccaucaccacggggcaguggacuguuaacccacaugacuucaggucaguugagguaugagccaaauccugccucaucuuccucaguuguagccccuccuccacauucuacagguuuguucucuuccuguccuauucugcccuuugcaauucccugggcuggaaugccuagucuccuccucucucccugucagugcucuaccauccucugugcagcauuggcucacccagcucuucguuuuccugaccugggcugccugcauugcucauuggaccccuggcuguaacaucauugugugugcacaaccacguguguggauuguaagggcagagauccuguuaagugagcugggggacuucccugucccagauuaaaaugaugaugccuugaaagaacccaggcuacagaggccacuaguuaggaaccuagugcugaccucuguuguuggaugaggacucucguuccuucaucaaaauccccagcucuggcuucugggcagaugccugucccagcccuuuccagccucuccauggccuugggaagacuucucugggugguucucauuggucuccaucccccaggaccugaggcccauggggaaucuuggccucgucagaaguggagaaugcagugucagcaugacaccuccggggcauggaggcucgcgccagggcugcaccuagcugccucuucuccuggccuaugucccaacccuggagaaugcugcccucagaagccugggaccuuccagcccuggaguagccuagucugauaagucucaacaauaaacccugacuuuugcaucuug

SEQ ID NO: 16047 - RNA, 2320 nt, Homo sapiens
cuucuuugggcuucgguguccccauauauaaauacugaaggaaggggaaaaugaagcaaaauagagagugacagaaucagcccugggcuccaggccugcguacauucuagaacccugugaggcaucucuucuggaguacgcuccagguuagagcagggaaaggcaugggagccucagagaccucucacggcagcccuucuccuuccccuucccgcagaugguuaacucaucuacccacccacccacagaggaaccauggaaaaccaggugugcaggcagggcccagggucagagcuggaugguaauaacgacucuucaaagaagaacaauuauuuuccuggccaggacaugaauauugacucagccuaguuguguuuuggggaaaucaugguaaaccagcuguguuauuaagguaguggguggaauuuguuuagauuacacucucaggccagaauuagucacacagcuaauggccaaggguuuuccuuugaguuguaggaguugagaaagugggagccaaguuccagucacaucccugggcuggccccauucugugaagacagacugguuccagauggggccuuuggggauagaaccaaucucaauggacaacugcuggaggcagggcuaacugugggccugcacgggcccaacugcauguaaacuuaagcucugcuacuucucagcuugugugaugcugggauguuacuugaccucuauguggucuguuuccucaucuuuaaaacuugaccaaccaggagaugggagcugcaagauucuagcucagucugagggugaacucuguaaccaucugacuguccauaguuagaagggacugucuuugguggaacucaaccccucuccccugacacuggcagcaaccaagggagugaccacgucaaggaaguguuagagaagagacgccuucaugacucgaauguugcaguaagaugacccuuaauucucuuccaguucagagauuauuugagcugguggccaccugguuacuggggcccucaacugugacagcucauugcucaaagucugccccuucucugaggcuugggaggaaaacagugcccaccucauggcugcgaccuauccuuuucuccauccccaguuuccucacccaggggcugcuacugucagacccuggaauaaacuacuuugcccuucugggucucuguuccucaucuucaaaauagggacaaaccugggcaacauggugaaacccugucucuacagacgcauauaaaaaaauuagcuggguauguuggcaugcaacuauagucccagcuacaugggaggccaaggugggaagauagcuucagcccaggagauggaggcugcaauaagcuguauuugugccacugcacuccugccugggugacagagugagaccuugucucaaaauaaaauaaaacagggacaauaucaauaaguauauuagauaacauguguccuauccagagcuuggcccauggcccaaggaaguggagguuaguucugucuacuccucuggauauaaauagcacacauuucucauccaccuacaaagaagucauaaccguuuagugaccagaaguuuguacacuucagaucaagagagagguuauucugcuagggcagguaacccaacucuccuuacccucuacccccaacccucaucaagggucucauaggaggcccccaggcacucaaaaucuagaggauguggcaccaggcccagcagugggcaugcagcaggugcucaauagauaccucuggagugaacgacuggagcaaauauaggucuagacacguagggccugugagguuuuccugacggcaggaccuacccuugccacccaacccccaggagcccuuucauauaaagcuaagcuuuugguacccuuucgcgaugugguugccucuucuggaggcacaacaugacaaccacuucugugguugucgaaugauaaauucacaugucaaaggggaacagaaccuuagaaggcagauucaaauuccacuuuacagaugaagcacuguagccugaagaguuuggguagcuuuuguaagucagugguggcaccagcaucagagcccaggcaggaguccugacucccaguccagugcucuuccuccucuagguccaggcaguacaagccacucacuacccuaugugcagaaacaucuaugugcauaaguggcaagggccagggcguucccaucagacuucagagagugggggugucucccaggggcaaggguuauaucuucucuaucagacuggagacucccacagguuagcgccccagagagucuacuuaacagacgc

SEQ ID NO: 16048 - RNA, 5452 nt, Homo sapiens
ucaaaguaauccuucugugagcuguucaccacaucagccuggccugaugccccacuuggccucagucagcauggcuuggcucugaggccagaagauaggaaggacgcugcuuuuauguccuuguaguccacuccagccuagccuggcacagaggacagguuaagcccccucaguccuggccccgaaugucugcuugguuuggcgcaauccagcgccccugaccugcucugucuuuuuucccaggaaagagcaucuacggugagcgcuuccccgaugagaacuucaaacugaagcacuacgggccuggcugggugagcauggccaacgcaggcaaagacaccaacggcucccaguucuucaucacgacagucaagacagccuggcuagauggcaagcaugugguguuuggcaaaguucuagagggcauggugaguuguggaagcaagggcuacuacugggcaauccucaccggggauucaacacagaccccagggcaggagcuccauguguccaucccuuucccaaaaggacccaacccacagaugcagcccagugcuccuguccagaauaaacccuguaccuccaugccuccaagguucuaaauucuuccagcccccucagagcccagccaggaaggcugcacaacugccagagccucccuccccuccuucacucagugacgugcuggucccaccccugagguauacagagugcagcugaacgcaaugucccugagaagccacaugcccuggucacccucuuccuccuccucacccuuggcccaaccugggucuuacuucaaaggaacaaaauuccuguacccccucgucaaaucugcauucucccugcucuggccaggagucuguuagaauuuuggugccuccaguuuugugugcuguugaucacuugugggucuuagcccuccugagccauacgcuggggccuuucuccugagcgguggaccuccugauccaccaugcccuccugcuuccaccuuucuuuuccaggagguggugcggaagguggagagcaccaagacagacagccgggauaaaccccugaaggaugugaucaucgcagacugcggcaagaucgagguggagaagcccuuugccaucgccaaggaguagggcacagggacaucuuucuuugagugaccgucugugcaggcccuguaguccgccacagggcucugagcugcacuggccccggugcuggcaucugguggagcggacccacuccccucacauuccacaggcccauggacucacuuuuguaacaaacuccuaccaacacugaccaauaaaaaaaaauguggguuuuuuuuuuuuuaauauauaaugugugggccugguucuugagccugcagcaccuccccuaggccuacaucccaacaugccugcaacucuccuguggcaaugggugccugccccuucccugggauccugccugaaauuuugacccaggagcuacccaggaaaagucaggcaggagcuuuugcccccugcuucuaaacuuugccagcuacugggccuccacauuugcuccccuugccaccacccuccagucuauguuaagggauguaucuguacuuuuucauagccuaccucuaaauugauuuuuuuuuuuuuuuuuuuuuuuugguagagacaggucucacuauguugcgcuggcuggucucaaacuuccagacccaagcauccuccugccuuggccuccuaaaguauugggauuacaggcaugagccucugcacccagcugacuucuuccuuuauuauuuauuuauuuugagacggaguuucacucuuguugcccaggcuggagugcaguggcgcgaucucggcucaccacaacuuccgccuccuggcuucaagagauucuccugccuugggccgagcacgguggcucacgcccguaaucccagcacuuugggaagccgaggcggguggaucaccugacgucaggaguacaagaccagccuggccaacguggugaaacccaucucuauuaaaaauacaaaaauuagccgggcaugguggcggaugccuguaaucccagcuacucgagaggcugaggcaggagaauugcuugaacccgggaagcggggguugccgugagccgagaucgugccauugcauuccagccugggcaacaagagugaaacuccgucucaaaaaaaaaaaaaaaaaaaaaaaagagauucuccuaccucagcuucccgaguagcugggauuacaggcaugcaccaccacaaugcccggcuaauuuuguauuuuuaguagagacgggguuucuccaugguggucaggcuggucucgaacuccugacuucaggugauccacccaucuuggccucccaaagugcugggauuacaggcaugagccaccgcgccuggcugacuuccucuuuuauuacuuaucuucuugacccugccuuggcuguugggcucuaagagcauacaaauucuaccaccuccagcuaccaaugcgagccaaguucugagccuugagugggaauguggcacaacugggcacuggguaauuaaguccuggguccaggccaaaggaggacccagccuuauauggaguucauaggacagaggcacaugacuuucuuaggaggcagccaaaggccucuggacugaucagggcaucgguggcagaggagcagggugacaggccgccuuuggcugggcuuuaucugggcugaugcugaagcuguagaggcccuggagcacaccauucaccaccacguugggcagcgacucugugggauagaauuaaacaggucuggccucagaccugcagcuccuugagcuccugcucaugggcucagcccccacuugggaguaggagccccugccaaggcagcagacagcagcuguccaccccaaaugaagccuccgcauucccaggucacauucuuuucacaucagcuugguaaagaagucaggcugcugaagaaauggagaccagggaagccaaacuuguuuuccuugugucuacaaagcaggcuccaggggacaggagcaggagguaguggcuccagaggugggcagcaggaaggagaugcugucugagggucccaggagccgagaaaugcaaagcccacaacccagcccuguagccccauaucuaggcaccuccucaccuggggagggguugcaaacauagggauccacauggaagcucaggacaggccgcuggugcugcugggagcugggaggaaacagggucaugaaccaugggugcgggaggcagggcagaaucccacagagggguggagacgggguugccaucaccagggacccaugaaggaaaaggugagugggaaaugggcucaggaggcaccaaagggaaaacagacuucagggcccaggccagacaggcccaggcagcaggccugccuccuagcauauggccacuagggggcagcaggggccaagcgcgggcuagggcuuugacuugccugcugucgccaggcaggaacucccucagggugcugaagagaagagaaacacuguaagcugccuggggaugccgggggagcgugaggaagggguggagacaccagagcccagaacugcaccucccaggggaccacugcuucuauuuguaacaagccccaguuccggagguggcggggguaaccaagucuguccaaaaaaaagccccuccacccaggucaagagagcuggugagggcggucaugcuggauccuggcagaugugaaaagaaagggcuugcccuccaacaccuuuccucaccugcucacugcugacagccccuggcccccgccaucggccccccuuacccccaguugcuagccuuggggucuguggggaagugccgaagucucaggaauuccaguaacuccuugggcaccuccugguucagguacaggaugcccuggagaggacagaggagaccugcaaucagacccagcuacuaauuugcauagcgcagugccagugaaaaugcagggcucuuuguuccaaaaaaagaauuucacgacaaugacagcagagcguugaaccaggcucagggcccuucugggcgcugggcgcugugugcacagguuguaccccaugacgcggcauagcuuugcuguugggggaaggacccucacccuacaugccaucaggagggcagcacaggaccucaccauggaggggacaggaccuggguuucauggagcugggacuaccuguguccguuaccucuuucaguccuuucaacaagccagagggggguguuuggaccuauauuagacucagaaaauugaugcuugagguggugaauaacauccccaaguuguggguucccucccugccaugcccccacaccucucugucugggccacaccccuggcacagaaggccggggggcaaccaacugugcucucgcauaccuggauguaagccuccaagcccugccggcgcuguuccaacccucugguccuccaguugggcaggcguuucgaggggaagucgggcacuuuguacagcuucuugaucuacuggagguuuaccgcgugcgaucacagcaucccgacugagcccucaagcccucuucgccccagccagaagcccucccgcgcccccgccuucgggcucuacugggacagacccuggugagugguggaccggccgagggcgaggaaggccccaacccacccacagaggcccgggggcugaccggcugcgcagggacugaggcaguaauggggguggcggaggcuggggcucgcccgcccgccucacagggccugggcgggggcuggacagaggcugggccggggccggugggaggucggcgccgccucacccgcuugugcagcgcguggaacucgcuguagcgccuuggcaccgugugucugcgcccgcugcacagcaccuccacucggaacaccuggcggcgcgggcgggcagcgggucugcgcgugaggccccgcgggaggacgccgcagcaccugcgccuggcgacgugcccacccucccgcucucaaaggcacaaagcggccuugcggcgccgcggcugcccggggacucuccgcucccgcacaccugggagaaccggcuggcggaccugccccucggagcccuggggucccucaagagcucgaaccaugguccgcgaggcuggcaaauccaagcggcccccaaacccucgacaagguuucccccgacgguccagcccgcagcgcucguucacccaggcccgggccccggguccccacugagcgcagcgcggggaaauccugcgggucccggcgccccuccccauccaggggccgcgcucaccauguggcuuuucuccgggcucugccugggccccucggccucgggccccaccgacgggaugugaacuuccagcauccgcgccccggccccagcugcuccgcgcgcucggcucggagcccuaacucucccggagcggacugaggaccccgg

SEQ ID NO: 16049 - RNA, 3272 nt, Homo sapiens
caugaauuguggcucucaugcgcaaaagacuugugggacccuuggauaucuaagauuuucuucuuaaauccuuguaagagucacugcacaugugugugugcgugugugcacgcgcgcgugcaccucaggucaucaggcauuagguucucauaaggaguguacaacauagaucccucgcgugugcaguucacaguaggguucgcgcuucugugagaaucucaugccaccguugaucugagaggaggcagagcgcagauggucacgcucgcuuuagagugcuugggagcuccuguguaaggacaguacccucccccaacccaggcuaccuggagggagagcuucugggaauagaaaguuaggaauagggaacaacaacaauaacaacaacaggcaccauuuauugagugcuuacuuugggccaggcacugugcucaguuuuguacauguagcaacucauuucaucuuuaugacuucugcugguucuugauaagauguuucuaauuuaauuuuaggauacuagccuccacugaguguugauccuaacaagcuccucucauuuuaaaaauauacacuugaauucuuaagcuuuuugcaacgagugggcuuaguuguuaguucauuuggucugcaaagcuaucuucaacaugccaugcuccuacuauuuaaagggucuuugugugcuuuuucccuuugcuuguccacuagugguuaagaaacaaccagugcguguucguccuuuauuuugucaguuguaggaaauuuuauuuuuaaggacgugcugcuuuauuuuuaacuucuugcuauuaaaagcuuuugauuuauucuuggacagugcaguaaguguggcuuccugcagcucccguuugacuuauggcuuucacuuguagccacaguggaggugagcuggaaggauucuagaagagauauuucugcccuugggauugacaugaccagcaggguccugggaguugcaggucaagccuugcuacacuuccaucccccgcacucuaaaugguuggaaaggacauaaauaggaaagcaucuggcuucuuucaucucaagugcauuaaaauucuucuuucacuagaaguguauuaaucuuguguagugaggcauagaggggaguguuuuauuucugcagcuucccaaaggggucugugagcugguagagccaaguucccaguggagcagaaggcucaucucuggauagcaagcaaaaaauuugaucuuucagcugucacagaguauggucuuggaauacauuuggguguguacacacacacauagaagccugaaacuuuuuuuuuuuuuuuuuuuuuuuuuuuuugugacagggucuugcucugucacccaggcuugauugcaguggugugauucggcuuacugcaacuucugccauguggacucaaaugauucaucucagccucccaaacugcugggauuacagucauaagccaccacacccaaaaccuagaucuugguuuuagauuagauauauguagaacaaagcucccacauacccucuaggagggaagauauuaccagaauuaugaugaggucccaagaucucacaggcuuugcugugugcuggggacagcucaucauccuacuaauucuugacucucagccuuaggccaaggagaauuauguaucuuuuauaaaagauauguaaacuacuugagauaguuucaagugaaacaaucggcuguuugugaaauaaagaagaaaauuugugaaauaaggaagauuugugcugcagaguucuuuagggauacgggcugcagcugcccaggugaugagcuugaagaaccuaggcccggcuggcagaguggagaggagcugggagagacagcugcuuuuacgacucuuucauguucuagcagacgccagaugcgaggcuucuccuuacagggaaggguuauguuugauuuaucauacauuucuggaguuuuuguuuaguuuuuguuaaaugcaaagcucugugcuggacauugugagaaacaggaaguugaacgcccauaaggaguuuagaauagaaguggaagaagucaguaggugcccaaaugcuauuugagguuugaauagagaauggguagaggggagugucaaggguaggcuaaguuuggaguuaccuaaccucaaaguuccaaacugggagacugguguuauaauugggagcuacugcuuuuacaguccccuccuaagugccguguguucccgggacauugggaagcaggagaaaauggguggugaaagccagguggcuucuaagauccaugucaguucuaacacuuuugacaucuacgaaugauucagcaugguugucucugaagcaugcugcaaaucaccucucguagccugcaaguaccuguaggggcuaagcuuuguagaugccacaggugcucuuagaaagcaaggaaagaaagaagagagagaagaaaaaaaaaaaagcgaaaagaagaacauuauuucaguaggaggcuucagucaucagccaugauuuguaggaaguuuagcucgaggaagcaucgcuaaaagacacauugaguuggggugucugucuacauacaugggugcugaccagaccucugacaaauuuuuguguucauggugacaguggauccaacccuuaagaaauuacaugcagcagggaauucaagggggccaguucggggguguuaguuuccuaucacuuccauuaaacaccguccgaguuugguguggacaaggagauauuuucucaguauuagaugaaguguuuugcauaggaaaguuucaugaccucacuuccaacuguguugcggccucugguuccuucuggugacuuugaggagcugccgcuggaauggcugcccccacgucuuuuacaguauaucgggaggccacaagaucugcuugccaggaggcugucugcucaaacaucuccuucuuagcaggggccuugaucuccgaaagcguccugccuuccacggaguguuacugcuuucaagcauauugcaaagugccugcacucucacagcuuucuuaggaaucacauacgacuccaguuuccuuuuauugaccggggaagacggcaaaauuaacuuggauuuuaaggaauuucguugaagcaaagccugauguuuauguuucugagaugugggucuguugaagggaaugcaguugagggcguuugacccaagacuccggaguggucaaagacucacaaccugcuucacaaaaagaucccucuuacuuuuguuuuacucacuaguuuuaaaguaaaauaaaua

SEQ ID NO: 16050 - RNA, 3202 nt, Homo sapiens
auuugaauuuacauauuuuaaugagaaaauauuauuuggacuaggucauaauuuaauguagacacccuuuuuuuuuaaauccuuuguuuuaaaacaggcaugcugggaacaagaacaucaauauuuaaaaugccacgcuaauucuguacagggagggaaaaugaaagguaaaaauuuuacagcucugaugacacuacaacuuuuuuuuuuuuuaacuuaagcaggucacaccagaacaacaguucguuuuccagccaauuaucuaagauucuaaaggaauacagcaaacaaaagugcauuuuacacaguguauaaucauuccuauucacaaguauuuacaucucuuugcagcccuuuagcuucuuggaaaaguucugguagcaaacagaaagacuuguccgugggagagcuauccggugacaucccuucauguuaccagucagcuuaucuaaguucuucccggguugcccuugaugcuuucuugguuugggcuuauuucauuuucuuuccuucuuuuuuuuuuuuuuuuuucccaacaauaaaauaaauagcuaaaaaggucucuaagucaucggaaaguuaacaucccaauuaacuuucccauccccacuucccucccuuucuaaaccuggccagaaaugaagaguaaacauucacauuacaacagguacuuauaaugugggcuuugcccguucguccgccuagcaagacagauucaaguucacuguuuacauauuacugggcgcuuuguaaacaauacaagguuacuuuuaguuuuguuuugcugugugaggacgagcgucgcuuucucagcuuggcagccucuuuccuaacucccagcgccuggagccucuggaaggaaacaaaaccccaaacaacaacaaaaucuccgcagaagccuaggaggcagggccgcaaccccgggaagcuguggucggcccagccccugccggaugggcggaggcgagugggguaggaagauuaguggcuccuuuuugcugcagauuuccaagacguaaagagauccggcccuccccugcgcuguugcagcccucgcggggagggggugugggggggaucuguuccuggaaacaucugaggcaguuucucuagucuugaaacugcgcagaguucggggcuccgccgaucugggcggagggaagacgcgcuuuucucggcgaagagggggugacaggguuucccccgccggucaaauaggaggggguuucggggccucagggaggggaugguucggcucagguggccccggccuuccuugaugugggggcgaggacaacucccacgcgccucucggcccaucugcaaguuuguguuuggucuccuggguccaaaacaaaguucucuuggggcaaggcggguuggccgaaggugaaaugaacaaguuaggguggcggucccaggugggggccggcaggacugggagccagggaaggcgagugaggugguggggaggagaacgagagggggcgugggcuccugcgggucagugcaccgccaccgagugcaaggcggaggccgggcuggugagcguuucgcuggggguggcggggcugcuuuggcugguggcuguuugcgaggacguggggcugagcgagggcggcgaguucgagagcaagguggggaugggcgcuggcagcgcaggcagcgcgggcacggcggccggcgugggcuuaaugggcacggggauggcgggcagcguuuggcccgccgcguggcacagcggcuucaacggcacgccguaggcgcuguagucgccacucgccauggagauggggguggccgagucgaucaugccggcggagccauacacguguggccagccggugcccagcgagcugcccaugguagucaacugguuggggagcggguaggcagcgggcaccggcugcauggcggagaaggccagccccccaggcaucuuguauucccgcgcgaugauguucucgauggcgaaggggugcuugaagcccgagggcugcgccacgccgcccaaguuguaggcggcggcgggcaucuguggcaggugcgugcccgaggccgccagcgcgcugagccgcagcuuggccugcugcugcagguacugcgccgcgucggcuggcuugcugggcgccagguggucggacuuaagcaccuugaagcgcuugcggcgccgcaggaagcugccguucucgaacauguccccgcagcuugggugcagcgcccagaagcugcccuugccuggcugguccggccgccgcgggaucuugaugaagcagucguugaaggagagguuguggcgcagacuguucugccagcgcugcguguucucccuguaguaggggaagcgguccaugaugaacuuguagaucucgcucagcggcagcaucuucucgggagagcucuggauggccauagcggucagcgagauguacgaguagggcggcuucuggucgcuguacguguugcggccgggccgaggcaucuucuuccucgcccucuucuugcucuggguccgcgcgggccggcggacugcucggaucugggaaggggguggguaauagggaaagguagcauggaugcacagagacaccggcggggucagccagaccgaguaacagacuucgggggucggggguggggccugcggcgcucgaucagccagcgcccggacucuuucgccagcaacuuugcgggcuuagugggcgcgggaggggaagccggcgaacggcgcgaggauagccgggaaguaagucgguacuggggccagaauagggggcagggacggaacagagagcugcucaccuuaaaguugcuucaaguugcgcguccgcauccgggaggacgccgcugcgcgccgcuucucucucggcgcgcacucgacgcgcacuccgcgcgcagcguccggguccgguuggacucggcgcgaaccugggcucuugagcucagccccgcagcgucccgugccgcccgguccgcgacgcuccuggagcguccugcgggcggccgagcucggcugcggagucccggcgcggaugguggcagcgacguguuagggcuccggagggcgcugcugugggcuccgcgucuccgcugagcuagguggcugccuccauguccucccucgaaccaucugauaguuuuaagcggugacaggagcagaaaagaccccuguagcggcgcuucauuaaugugccacuucuua

SEQ ID NO: 16051 - RNA, 1604 nt, Homo sapiens
uaaccauucccucugaggccaagaaaugcacacgcucaccauggcuaaaggcuggggagccagcgccucccaggucuccgcgaucgcccuugggaggccgcgccggccggccgcaacccucgcagccuggcggggacgucccggggaggcggaggcacgcugggcugcgguggccggucccucgcaggcccggcccggcccggggcgcggggcgggggcaccgcggaaggguccccguccuccacgcucgcgggagccgccccuggccucccuaccaugccguuccgcaggucccagcggcugcgggcagccggaggcugcggcggaagcggggcgccgaggcgcggccuaaguuccccuucccgguccuuuccgguccucgccgggccucaccugcuugagucgggagaugagcacggucuugacuccggugaugucuaaguuccgccgcuucagcucggacuucagaucgaugacccgcagaucggugaucuuuuuaccuuccgccugacccgaggcggccgaggcugccaccgcaccgguagcggcagccaucuuagaagagcagcgcgcugccgaggcagcgagugggcugcagggcggcggcagcagcgccaacuuccacccaggccucggcggccgccggcgccgcgcagcgcugcgcacaaugagccgcuggccccucccccgguccgccacccuagcgcaaccugcagcagcagccgccagcacccggaugacggccgcgcgugcgcguuggcgcagggaccggcagcggcgcgcucggucgagcgggccgcggccacuugggcggugcgcucccuuguguggacugggaggucgggcacguccuaccgcagcaacguccgccgcgccgccguucucucgucgcuucguuagccauuuucuugcaacgucuugagucuugagcaacaacgaugugcgggcacugaaugacauagugcgcgcguuacucaacacaaaccgagggggcgcgugcgcgcgcugaaccucucaaggaaauacuuuaucaguucugcugaauaaucgaaaaauugucgccggugugcaccaacgaacuagguuccccgaguuccauucaaaagaccucaaagcaguucuagggcuguuaguccaaagaauaggaagggcuggccuuugacacauggcucauuggcugucucaggagaaaacaucaucgcccugcccauggcagcuuagguuauucuagggcugcccuuccucacuugaaaaacaggaaaacuucuuucuuguuggccucagguuugcuauccuccccgguagaccugauggcucaacacgaaauuguucaaugaaagagaaaacuagcuuauaaguacuuguugccguuaucauauacuguguucacuauuuugccccccaaaauuugggauuccaagaacagugagcaucuucuuauggaggaucggccuguacaagugaguaccuauuuguaauuuuaccuuguauuauucauuaucaaagugcaagcauugauaaaauaaaacgauucuauaaauuccauaaggugauuaugaugcacaauuaacuauacuguauuuccugguuuuacaacuuaaauu

SEQ ID NO: 16052 - RNA, 9752 nt, Homo sapiens
aaauaagucauuuucuauggaugugauuaagauguuaaucauaucacuauuuacagauuacauuauaauacauaaucaaauugcugaauaggaaauaaaucuuaaaguuaugguauacccaugaaauaaaauauccuacagcugucuaaaaagcaaaauauuuaauaugggaacauauugacaauauauagagcagacuacaaagcaauguacauuaugauuucauuuuugagaauauaaaugcauaacuaugcauagaaaaauaagcaaaaacacaacaucaaaauguuaacagaguuuaucucccuagauggcaggauuacagggaacuguguguccaggcacaugaacucuuccauaucauccagcuuccagaaauaacaucaaauuuuacgcugugaaaucauuuacuauucguuuuaagaacuaaaacuaaugagaaucuuaggucaguauacuuuucacauuugcuugagggggguaaggaaugaaagcaauaauuacaccuggaagcaaaugugaacagucuuuuucgaaaggaaaaaguuguauuuaauuaagucccgguaaaacaucaccuuagcauuugaaguuguucuaauuaauauuuuauucuucaacacuuuuaaagacuccaauauauuagacaaagaauuuuuugauaauguaaguuaauuucucuggagacaaccauauaauccucuaaaaugacaugaacguuuauauaugggacugaagcuucugcagucuauauauaccuauuuggggggaaaaaaguaaaguacugacaauucaauuuuaacaaaaaaaaaaugcuuuccuuaucaaacauuaauguuguguacaugaaccuaucaucugugacagcaaggaacucaagccaggugaugcacaagccuucacccagcucaguuagcuugggcuucuccuguaccagauuugccugaaguaacaugagguuauuuaaaaagaccuccaccuagauugcagugagccgagauccugccacugcacuccagccugggcgacagagcaagaccccaucucaaaaaaaaacacaaaaccaaacaaacaaaccaacaaaaaaaaccuccacuuuccagcaucuacucaaaagggaaguccuuccuaaucagaagagagauaacguucuuccuaagggaagacagaaaaaggagaagagcauuuguuaagcauucuccauacaugucuuccuagguauuucacauccaaugucucaauaaccccaugcaaacaugcauacaauucuuuagacugcucccuucauuacccaaaaaagaagggaacuaugucuuccuaauugauuuuaggugccuggaacaacuaaguauuucacugaaagacauguaauaaaugcuauuugauagguaagaaaaaggaaaaaagcaaaguuaccucuuuucauuuggcuuaaagaaaaaaaaaguauguucuacuauauacuaaaauaucagaccaauacacaauauauugcaaaauuuuaauaccaugugguuaaacacaauauucaaauauuaaacuuuucaagcacaugaaagucaccuucugaaagacaaacugggcuuuuuuuauaacuaccuuuguguaacuuuauaaaauuacuucccucaacaauaucugacacugaucuugauacuaguuagaaagucugauguaagaugaugacaucucaacgucagugauuuaggagauuaucuucagaauucaucagaggaccaaucgucaucuucaucccuuacuucucgguaucucccugaagacuccccuucuggauuauaacuccgcauuuuaauauucagucuuucagcuaauuuuugcgcugcgagcuuugcuugcaucuccuuuaaaacaaagagcaaagcacaaaguuacacguucacaucucuuccuuacaauuuuucaaugggaaguuaccuagaaucagcaauaagagggacacugacaccucacugagugcucccuugggcaauacaagccugauggcugugcccuaucagacacaacuggguaaugcuucugacagccaccagccugcuacaguugaaguuacugaccuccauuaauauacaacauugcacugaaauacacuccucuauauaagaaacugaguaaugagcuuagcacuacaauacuuauaaauacagaugcguuaaauaugggggcacaugcacauguauacacacucacauaacaauuugaccuaucaaaugucaaaaaugacuaaugcuggggcccggugcaguggcucacgccuguaaucccagcacuuugggaagcugaggcaggcggaucacgaggucaggagaucgagaccauccuggcuaacacgaugaauccccgucucuacuaaauauacaaaaaauuagccgggcgugguggcgggugccugugaacccggcguguucccggguucacaagaaugaacaagaauggcgugaacccgggaggcggagcuugcagugagcugagacugcgccacugaacuccagccugggugacagaacaagacuccgucucaaaaaaaaaaaaaaaaaaaaaaaaaaaaaaaaaaaaaaagaaggacuaaugcugucuagauuucuacaacugacaggaccuucuucccuaauuacaaucaugacuuccagacuugggaauuacauuucaauggcaaaaugaaaaucaagaaauuaauacuaaaaagcugacuauuccucuccaaauaaaguccuacagcaacuaguauccaauaaaaaguccaaguaaauuucagacacuggcaauguacuuaaaaacucccaaggacuuuaccaccaacugaugguagguggcaaugucauuccuaauucaguucuucccuuuucucaugcuuucuugaacuucuugauguccuccucuucaagccaugaauaugggucaguaaaagugggagcuauuaccacuacaacuucucugcuaaaaaaaaacaauuuaaagaugaaggguuuaauucaaccuaaaaauaucuuaggacaggcauuuaagagcucagagacaguaaacacuuccucaaugcuacagccauaacuagacagucauuuuaaugcacugaaagaaaaaugguuuuuuucaaaaagagcaccuugauaaugccaauccaugccaaggcuuuuaugaaaagccaaagcagauuaacagccuguuuuguuguuuuuuuuuuugagacagggucucacucugucacccaggcuauacagagugcaguggugugacugcggcucacugcagccucgaccuccugagcucaagcaauccuccuaccucagccccacagguagcuggaaccacaguugcaugccccaaugcccggcuaauuuuuugguaaagauggagucuagcuauguugcccacgcuggucucgaacuccugaacagucugguguuauacuaguuggugcacuaguaccugacuaaaaucuagcuaaucaauaccuaggaagugagacaggauacuguucuccuggaggcuaaaauuauuacuaaauacuucuaaacuuuucuguuccccuaugguccuucacacuuauuuucucccaucccauuauucuguauacaaacucucaacauacauguuugaaguucaaugcaaaacacauggaaacaaagugcuaugcaaaauugauuaagcugccaaaagcaggagauauuucucucuucacaugggccugcagauuaugcucuaaagcagugucucacugucugcuggcuacacaacauuauccucccacuccuucuaugcccuccccuguacugcagaagauggaagccugggaacuacauucuccucauucucuaacaaggggucuggguuugaguccgccacugagaagcugucacaugaguuuuacaaggugaaagggagagaugcgaugcuacuacuauccuaacaggaacaggcagguaaaugagcuuuaagacaugaaauucuacaagucuccccacaucuccaggcaaaucaccacuuuaauguugaagguagcugugaucaucucuagcuacuuccugcaguucuagcaacuuugugacucucugaaaacuaguggcauagaucugagcucauggaagcaccuaauccccucuauuccauuccuuccuccuugaaccuggaguaaauucuagcuuauguaagcagcacccaacaaacagacaagaaaaaaaauacucuaaauaccucauaauucuguuucugcuguuucugaagugccaaggauucuucuauggagagcagcugcgugggcauauggugaagugguagaagccgagcugcugugaugucaucaagaugcugcuuaucccugcgccgccgcucuucugaggaaauaggagacccacucuucuggcaaugacuagaugaaucauuuugucgaaaagguaaccugaugaaaggaaaacuuguguuauacaaucagauuauuuuauuuguagacacauuuaaaacauucacacaaauggccuuuaccuuagcaauuaauucuccuccaaagguaacaguaaguaauuuaccaguauucauugcucuaacaaauagggguguguuugugugcauacaggcucuuugccuuuuccuuccuuauucaaaccuuguauuucaucuggaguuuuuuuuuuuuuuuucauuuauucaaagaacauuugcaaaagggcuuauugcccaguagaaagaaauacacauguaaaguuucagugcaauacaauaccagagauacugugauagauaucucaacaagauacauuggaacauaaggaaauggccaguucuagugggagacagggaggcuaagaaaaguuucaaaaaagcuuugaacagucuuggaauaauaacugcuuacccauguaaauaaggagagaagugcaucccagcaaggggagugagagaaaguacagaagguagacagacucagcuuuucuggcuacacagaaaagacagcgagaaagagggcugggaaguagccuaggcccagacugcaaugaagaguucuccguaacaaguucggauuuccaucuuacaaauuucacucuggcagcaguggagauagacugguaguuaagacuagagguagaaggggccacaauuacagcccgagagagaugagagucuucacuucgacagaagaugaagaacaauuauagagaugaagaucaaagaaauaaguaggucuucauggcuagcagauauggagaugagaaaaaucgaagauaccuuaggggaagaaaaccgagaaggugguggcacuauuagggaauauggaaaucaccuuggaaagaaacugcaguuccacuuuguacaucauuaagcugagguaccugggaacacccaagugaucaaguuucaugguuaauuggcuaugcaaaccuaaaguucugggaagaucugggauagaggugcacaggggucagccuccagcauccaggugauacaugaagccagaagaguaugcagaaggaagagcagaaaggacccaaaggacacuaccugaccccaccuuccaaccuccaagccaccucucacacggaacccucucaaucccuaccugucuauggccuaaggacuccucaaagcccugccuuuccuguucuccucuaacuuauacaggaggcucccugucucuuaaacuuccugaauucuugguagcccucuucacuauucccuuaccucucucccacucccagcuaaaugaccauaauacagaacugggauuaauguauucuuuguuuuauuuauugacuagaugaugguucuaguuuucuaaaaugucauccuggaagugaagaaagauaccccacuguacacaagagaguacuugaucacguuaauguaguauaauccugauuuucuauacagcagaaauaaaauguuuugagguuaaaaugaaugcugggguagaauuaaagucuaacaaaaaagaagcauguuuuagauacuuuucacuagagguuuucuguuuuucaaagaaagguaguagugauuuaacuuugauguuacauacuuguaaauacaauauaggaagaagguaccaguuaccugaguugaauguuacauuugcugcaaguaaauagcaauuauuuucaaaaagauuuuacuuuuccugaaauuucagaaacaaauuuauggcaaggaacugauaagcagaguuuuugccuauccugccugaaucuauuuucacaguuuuucaaaccucuucucagcuuccuucccccugaaacuguuauuauuauguagcuuaacucuuuuccaaguguguaaaccuuggguccucauguagcucuuaaacuccuugaagaacaugguauuguauuacauuacacauguauacauuacagccauguuuuuaaacuugagauuuaacaucaaaaaaggcaaaggaguuuuaagaaucuugacuuaauuguguccccacaacaccugcugcuugcuuacauacagugagcaugcaaauaauuucugcuggaaagcccaucagcuccugcaauugcuuuacccuuaguucacagacuaaucaaagagaguacacuuugauaguacacuaaucaaagcuguacacuaaaaaaugguucugaaaaaaagaagucauaauaaauucucuccaacucuguguuuauuaugaaauacuggcuaagcauccuaaaauuuaacacucccccaugugcuuuaaaagaccuugucgauuauuugguuucaaaacuaaauauuuuucaacaugaaucuucuacuccggccaggcuggucucaguguugccacaacauguuauuuccuaacuacaaguaguucucauacaaagcccacggaacuuagagcauucuccugacuuauuuaagagaaaaggucuuauuauauugcccaagcuggucuacaacuccuggacucaaagcugucuucccaccucagccuccugaguagccugggacuacaggcaagcaccaccacacccaguuucucguaaauuuuugaguuuaacaaauaucacguuccuguuacaggccuguuuccgaggguacuuacacauugguuuuaaauuuacgcagcuggggcacuggguuuuuggcucgcauuucuagcacuuccauguaaugagguuucuucucagucccacuggaaaggccugucaaguucuuaguacuugcguuuucuucugacuguuguucaccuugguccgcaauggugauccucuguaaccugucaauaaacagguugucaaagcugcuggaaguaucuuccgcuugacuugaaacacgaugccgcgggugaugcucacuagcuucagaugaaggugguacccugucucuauugcuggaagcugggcccuuauucacuguguacucaaccucugaagucucuucaucaccuucaagaguaggacguccaagucccugguuuugugagguuugagaugacuugauguuaucuacagaggaacauccaggaacuagugaugaaguaucaaguaucgggucagaauucugggccuuaucuguacccacaucaacuucugcaauugcuuuuugccuuagcuuacagucuaaacuaacaggguuaaacaguucacuuuuucuucuaacuucuucacauucugcaauggcagcuuucaguuuggcaaaagagucaaagaucuuuuuaccuuugucgggcaauuugcaaaugaauuuucugucaaauggaaaagaauacuauuacauuacagccauuuuuuuaacuugagauauaacauuaaaaaggcaaggcauuaucuucaaagaaagaaaagcugauuuuuaagucaaauaucugauuucuaacugccccaaaacaagaauaaaacaauuaaaauggucauuauccaaauagcccaaaaaacaagggaaugcaggaagaauagggaauauaugccucauuugucucagcaaauuagaauuucagcaaaaguauuuuaagcauauaauaaucacauaagacauuccaagaaccagcagucauuaaagugcaaucuccaaaauuuggggaugggguggaguguggggaugggccuauuaggucaaaacuacuuucauaauaauacuaagauauuauuucccucucauuuucucgcauggguacaguggaguuuuccagaggcuacauggcaugugaugacaucauuguucuagaauagaaugugugcuuguguaugcuuauguuuuaaagacuucagacguauuucugauaaguaaauacauuucgcuagauacaacacauaaaauagcucuuugggaugucaauaauucuuaaaguauaacggaguccugagaccaaaaaguuaauucacugcuauacauucaaaaccuauucucacaaggucaaaacacaugucuugaucccaaccaauuauuuauuugucccuuuugcuggaugacagaguuccuuuucugauucccuuuucuuuaacuauacaauaaauggaaagaaaaaauuacaccuuaaguccucuguucuuuuugacacuacauucauccccacaauuucaacuauuaacaacacucuacagcugaaauuccuguuuucuguauuuuuccaggguucucucuuucuugagccucaugacuacuucuccagcuuuuaaguguuugguuuucgauuaaccaaaugucuguccugcucuccucucaacucugcacacccuaaguaaaaucaaccuuggaucuauuccucucccugaauuuuccuauuuuugcuaguggucuuccauauagauuggaaacuucagccaucucugucaacugcauuuaaauuaguccaugcuuaaaaguucucccaaucccuuccuagcucacuuucuuacaagugucucgugggaagucucucugaaaauauccuucuacugucuucugcuuuuuauuccuucaaaccaucuuuugcaacaagcugcugaacaaagcugccuaaaaaacaaaaucacuuuuauuacguggcucccuugcuaaaauccguucaaccagccagcugaaugagggucgaacuuucccggccuaauaaaccccucuucauaucccacucuucccauuuccuacgguuccuguaagcuuagaauccagagaugaagcugacaaucuguuauggguuaggggugcgggcgacaaaaggguuuagaaagcagacucauggaaccaccacaguccccggguaaauaaaaccgaccaggggcuacuaacucccugcaacgccagguagccguucaauccgagcuauccucgcaggcauacgugccuggccaggaagaggcacggcucugccgcagcaagcccuccguccacucgcccguaggacugaagcgaaugugacugagucaaagucaccuuccagggaagggaacagagugcgggaggggaggggagcgcccagggagcucgagcugaaggagccuggcggagacuccgcgggaccccagcuuacucguugcgcaaaagucucuccuggcgcuucaacauuucccgcagcuccaccaaacuccgcugcgccaaguccucgggagcuuggggcucgaagccgcggggcagcgagcacauucugcgcgggcugaggcuggcgcggcggcgggcacucggcuuccucggcaggccccgcuacuagcgccggauccgcggacggcggugacuccggggcacgagcgggagucgccauuuucccggaagaacggggucuucuucgagccgaaucgagcuuuauugaaauuccggaaacaaacacggacugggagaagggg

SEQ ID NO: 16053 - RNA, 103436 nt, Homo sapiens
ccccuuuccacggcucggcugccagcuccgcaaugggagccgccgccgucgccgcaguguaguuuuucgugcuccuccuuuuccuccuccucuuucuccuccuccucagggcuccagucaggccgauccgcuccgcucacgguaagcgcccccccgcccccgcccgcccugcgcugcagcaggcagaggcccucccgcgcggccugcgccgccucacuccgggggcgcuggacugggggucuugaggccggcgcgggucgucgggagcgcccagagcgcgggggaggagaccggcugcgcggcggcggccggaccgccaucuugcgucggcccaggcgggggaggagguaucccggcgcgacgcggcagccgccucggcugcugcaggccugggccgcgcaggccuucgccuucugcuccuccgccaccuccucucccaggcgugugcgccuguuuguccccagccugguuuuggcuuuucucucuggaggcaacucccuuugguacauuuugugccgauguuuggccaagacccaugguccucacaccacagcccacccccgugucucuucagucguaggaaaggagaccaaaggggauucgggauuugcaggcacagggccccucauuuugcccagaugaccggucguuccacguuugcacccucauuuuugucaaagagaccuccccuccucugccauagaauucccguuauugucuacagaagaagggcccugaggagaaacguggaguuggagacaaaauuuucugagcuuugcaagguucacuuacugagacggaaagaaugaucucacucugagguuuuagccugcuccagcgauggaaggaauuccucccaacuuaucgcaaguuuuaacgcuuuuaaggagaaaucugcuggagaggaaaaacgucaaggugaacccgcuucugcaagcacgggagaccuuuggccaaaggccuuuguuugcgaagauuuguuaaaaaaaaaaaaaucugucaucuuaaauauuuggcuuuauuuucagguuuggacagaauuugucuuuuuuagugccaugaaacauaaaauggaacgcuagaaggacaguuuuaaagcacaaaagcugccucuuagcaucuguaagguguccugcuuugggggacugcugugccaacuccagcugucuccacgcagaaacuuaaccagggaaggcacugguuugcuuauaccauuguuagggcugugugccucugauguuuuaacaucacuacaaauacuguuguaauugugucuugcuuuugugccuuucauugauaaccccugauuuguaucucuuagccccuuuugaaguggucuggguugcuggaaucauuuugcaggcgaggaaacagagccucagggagaggacuuuaaugaggucacugacuaggaagagccaaggccaauuauauuaauagaaccuuaggucuucugacuccuucuccggugcucaacucuaguauauaccauuuuugugggaaugagguagaugagaauaggcaaggaggcucacuuaaagauuuuaagaaacauuacucaguugcccuuucguugauauuuuuauacuuuacuuuugaaaugcgguuguuauguugcccaggcuggucucagacuccugggcucaagcugaccucucaccucagccuccguagcugggauuacaggugugcaccaucuagccuggcuuuuauauuuuuauucucgaguuaauuucuuaacuuugcaacuugcuauuuuuuucgaaaauauuggaaaguuaaauagcccauuugaacacuuaguuuuaacgcuaccuuuuugccauauuugcauuuuuccacuuaucucacauucuguuuucugaacguuucaaagugcauuacggauaugacaguucagcccuaaaugcuguaugugugucaguauguauuuuguaagagaucaaggccauuuuucuguguaacaauaccgcaaucacacuuaagaaagugaagaauauuccuuaaaaucuaacgugguguaguauauauucacauuuccccccauuucuucaaaauuccuuuucagucuuuuuuuuuuuuuuuuuuuuuugagauagguacuugcucugugucccaggauggagcgcuguggagcagucuuggcucgcugcauccuugaccuccuuccugggcucaagccauccucccaccucggccuccugaguagcugggaacccaggagcacgccaccacacucagcuaauuuuuguauuuuuuguagagaugggguuuugccguguuaccuaggcuggugucaaacuccuggguucaagugauccaccugccucggccucccaaagugcugggauuacagaugugagccacagcacugggcgaaauugaccuuuugaagagaccuggucuguagucuuucagaauaacccauauuccauguuuuagugauaguuccuccugauaguguuuaaauuuguucccccuauccucucuguuuucucuaaacuuggauuugggucuaaaggcuugaauauauuuagguuuaauauuuuuuugacaggaauacuucauaagccaugcaguaugcuucauugcauacaacauccaaaggcacauaaaguaggcuugucuuauuaauaauccuaaauuugaucucuuagauaagguggugacaagcuaucuuuccauuguaagcauuuccuucugcaauuagcaagucauuuguggugugauauuuuggcauuaguaguugguaggaauuuaccugcaguaaucugauaaacacaguugggagcagucguuuagguauggcuuuggaaguuaggaagaagaagaaguggagacaauucuggaggaaauacuaacccaucuacuuuagggaacuuggaaugcuucuauguguuggcaucagagccuagggagacuaggagagaggaggcagaaaguagaugucagaaagcuuugccuucuuugaaaguuugcuuaggaccauuuuagccauaguaagcuaugguaaauagaaaaguucugaaguaguuugauguuggaggauugcaagugcuucaacuggaacaucuguccaguuaggcuacuaauccaguccuuuuucauuccaguguucuauuaaucagcauuggcucacugaaauagcaguuuucacaaaugaaaagucaacuguaguuuuaggugacaggaaauuggauauuucuauugacaacauacuuuguuauuccaaaagcaaguuuuggaagaugaggaauacuuacgacauauucacuaauuaaauauauaaauccugaauaguuuuuuucuugcuuuagaaaggaauuaaaaacuuugaauuuucagauugcuuuaaauagugauuuaaauaaugacuugauuuaaucagugccuuauaucaaaaauuguauguuuagaauuuugauuuauuucuccagagcaauuuuaaggauucucuuaacccucaguauacgaggaaaaguguacaauuaucacuaucaucugggucaaaagggacugguuuuuuuugcauuuuacguuauuauguauaauuuauaggaguaaaaauaaagcauaauguaaaacaacuuauuggagcuuuuaauaagaauuucaauacagcagauaucuuuguauguacuuagaaaaauaaaaaauaaaaaaucuauuucaugcauuuaauuacauaacacuccuacaacaaauauacaucacauuugaacgcuuugcauaaacauucucauuguaacacacauuuuuuucuuuuugaguuucuguaucuguacaaagaacaucuuucuuucuucccauuuucagaucugugcagaaaucauugugguuagaggguaagacaacauucccuuccuauuuucugcaaguuauuuuccuaguugcaugaggaauuucuucuugguaacuuccaguuuuguaacugaagcuuuucccguacaaugaaaguauacucugaacuaauaucagucauaagccaucuucaaaucauucucuuccaaguauuguuucugacccacuuuuugaaugugucacuucuguagucuuuuuguaauacagaucacuucagauuaauuuaugcaaggauuuuaaaauucauugaugguugagaaugcacugagcugagaagaguagguauaguuuuccuuaggacaauaagaaucaugaauuauauucgaaauccagauuuugugcaguugacuucuuuugcuuuuccauuugugaaaauucacagaaguucaaugcuguucuuccuaacagugccaacuaaggagaguuugaugcugugugauauucagccaagucuaaauuuguaaaaaauuugucacaaguuauaugucugacagaauuuugaaauuuuucugucauuucguauauaucaaucuugauucuacuuucaugccuuuucccaaucucuguguagaucugcauuguccaagcuuaucauauuucauugucaccuguugcucagauuuucauuucauguuuuucaccuuuugaagguauuucuaccugaaaugggcaacaucaucugaauggaauuaacuauagaugcuccuugaauuacgauagguuacauccuugauaaacccgucauuaguugaaaguaucaugaguugaaaaugcauuuaauacaccuaacauacugaacaucguagcuuggcuuagccuaccucaaauaugcacagaacauuuauauuagucuacaguugggcaacaucaucuaacucaaagcuuauuuuuuaauaauaaaguguugaguaucucauguaauuuauugaguacuguacugaaagugaaaaacagaaugguuguaugaguacuggaaguaaugaaugcacuuucacaccauuauaaaguugaaaauuguuguaaguugaaccaucuuaaguuggagacugucuguacuuagcaacuuucauacaagacccuggaacuauuugucuuauaaauacugauucuaaauuucaaaugcuucccugauagguucuugcuugucauuccuucuggguugucuuuuugcauguacaucaucaaaaugcaauacuggaagaauuuuugaaaccuuugaugguucauaauuuuguugaagacaggacggccaucuucuuugcuccacaauugcaagauuuuucaauuucagauuuaugagcaacuaacuagaaugaucaauccaaugaauuuuuuaaaaugucuauauuuucuauuuccuuccagucaccuuugcauaccccugcauucaauacuugggcacuuaagcguuguaucaaggccgggugugguggcuuaugccuguaaucccagcacuuugggaggccaaggcaggauugcuugagccuaggaguuugagacuagccugggcaacauaagaagaccuugucucuacaaaaaauaaaaaauuagccggguguaguggcaugugccuguggucccagguacuugggaggcugaggugggaggaucgcuucaggucuggguugcagugagcugcaauugugucacugcacuccagccugggugacagagugagacccugucucuuaaaaaaaaaaaaauguauuaaguaaaauuuuagcacacacuuguaaaggaugaaagacugucacauuuucuuugagcagaacagcaugguccauauucuuaauguaaaaauauugugugaugaaguucuucccacuggaugagaaugccguauuuccuuuuuguuuuuagaaauacguuauucucucauugauuaaguuugagggaauuuaucuaaaguaacucauccaaggacucagucugagauuucccuuauaaagucauuuucacuaccaucauuaagagucuaaagugcugcugucuaucuuuguguuaaucuucugguucgucuaauaguugugaaaugccuuccucuguuaauuuucuucucuuccauuuugggcagaaaaugaagucugaguucuuaauuguauucagugaaaacuagaaacagaugaaggggaucagaaucugccacuuacgcaugaggauuauuuugaguugaaggcaauugagagucaguagaugcuggaagaguucugugcccuccccuuauuugccuaguaguagcagggcauuaauuucuaucuuuuuucuuuuuuuucuuuuugagaccgugucuugcucuuguuguccaggcuggaaugcaauggcgugaucucagcucacugcagccuccacuucccggguucaagugauucuccugccucagccucccgaguagcuggaacuacaggcgugcgccaccaugccugacuaauuuuguauuuuuaguagagacgggguuuugccauguuggccaggcuggucucgaacuccugaccucaggugacccaccucccaaagugcugggauuacaggcaugagccaccacgcccagccaguuuccuucuuauaacagggagggaagagcaacucuuuucccuugagauugagagucaaggcagagaugaguuuguauaaacaaauuuuacuaaaauaaccguuauuuuccauuaguucucccauuuuuucuagucacuuucccaugguuuauugucccugaaauuccaaguucccuuuuuuggggggguuaaaauaguauaaaagccucuacgucuaaccacuuguuugaguuucacuucuuuucugugaacuccugugcaugucaauauuaauaaaaauuguaugcuucuucucuugugaaucugucuuuucauaguuuaauucacaggccaugagauacugaaccaaaggugauagaggaauuguuuucccucucugacauagacuacaaaaaugucuucaguuuuccauaugucuuugaaaauugaugcaauauuuuugcaaaacuauaagaaaacuggaaaauaaaugagaacaauuaaggcuaaugcauuagucaugauuuauuucacuguuguauuauucuuuuaggcaguccuauuauuuuuuuagcauaguugggauuaauugaugaacaauggugaaauaauaccuagaaugauggaguuagcaaaauauuucaagauguaggaaaaauaaagccacuaacaucccauaauguauuuuagauugauaaaaggauucuguuauagacccacauaauaauuauaagauauaaugaguuuuaaucuauuuuaaaguaguaaguaaauuuucccuucuuuguuuaaagaucucuaggaaacaaugugaauaaugucagucuuucuaaaaagaacugcucaagaaagaaaguaaaaaacuaguuuccuuuggacucugauaguauacuggacuuuaaugguuaauuuggacaguuagaguuccaccccucuccaauacacacauuaaaccuaccugccucuucuacuuccauaauagguuuuuuuuuuuagccuguuguacuuuaauacaucucuaaugaauacaggcaguaccuagaaaguuguuccuugagguuucuguucuaaaguuuuuuuguuguuaccaguuuuuuuuucuuaaaccuuucuuccaagcuuuaccuucagagacccuucauaauaaaaaauuauuaauuggaacccuggcacaucaggccaacguuguauuuaggcuuuuugcuuaaauggauuacaccaaaaaauauuucagucauuuucauugcaaacauuccuguuuuucugguuuuauauaacaggaugaagacaaaguaauuuuugggaugauguaugccuuguuucuuuguguuuguaaacacaaugccuuacacauaauuaauguucgauaaauacuuaguuuuuuuuuuuaaucaccugaauauuccccaacaguuuaaaauuauugcuuuacuuuuuggauugguauguaacuuacaaauuuuugaccagcuagcauaguaauuuagcuuucuuuuuuaaaaagggcuuugacuuguguuuaucuaguacaguaguucucuaaauguggucuugggcuugagacucuuugaaggauucuacuagguccucccuuuaccacauacuuuuccugugaagcuguauuuucuucaacagaagaguguagugcaacagguugaaugcagaaggucguaagagaauccagcugucuuuauuaagacaaugagguaugcaaaaauguagcaaaaauguaaaacaauaccacucuuuaaauuuuuuguuuugagaaauacacuuuuuuuguaaaaauauauuaauaugugcugcuuucauuauuaucaucuuuaaguaaaugaauacauauugaaaaaaauuucucagguuugggguuucuggacucccaggcaaagauuccauccuuaaaguuuagucaaccacacaucuuuuuuugaucagguuugggauuuuuuuuuuuaacauuauuaacugaaugccuuugaguugauacgcauuuugacuagggcuaguaaccaaagcaaagaugaucagucuaugaacuaauuugcccuuugcuucuaggcuucacuccugugcguuccuuauuuuguggguuaccuuuggcaaaucuaagaagcuaagccuggaggggcuugagagaggccuggggguuuuagguauaauccuaaucucugucguaucucuugcuuuuuuuacuugcucugcuuuuccuauucaagguuuaagauuaucugacucucagcuauacaggauugcugacugcugcuagaaaggccuucauaaccaaaaugcaacauggaaauagcuuucuuacauuccaugagaaaaaaaauagaucugacaacguuauugaauagaaaaagguaaauaagaaaauuggcacuacuucagugacacuacauuguagugucuguucauuugagaaguuauacacaacagaugucuuucuauucuuugauuucuuuuauuguaguguuuuagagauuauaaaguauguucacaguuaccguauuccaucaucagaacaaauacuucuuugcaaaaggcgguguuaucauccuuuacagaugaggaaaucaagucuuagaaaaaguucauuuuauucauuggaauaacacugggugccagauauuguguauucauuuuauaagauacgaugccuugguuuucccucacuucaccgucagccuuuuuaucucagaauuacauguucucuucuauuugggcuauacaaugcaggugagccuuacaggcaggcagugacaacaacuguuagaaguguugccuccuuagagcauuugaccuguucugcaccucacugcaccuggaagcuuuuaacacuaggauaaccuaaccgagcucugcuuagguuggaaaguuauuaaacaauuuggaauugguaaaugacagaaugaaagcauuauuuuaguaaauuguuaauuugggggcucuuuauugaagagaugaaagcaaaaaucuggaugcugagagaccaaguacagacaguccccagcuuaagaugguuuaacuuaaguuuuuuugacuuuaugauggugugacagcaauauacauuuaguagaaacuguacuucaaguuuugaauuuugaucuuuuuccgggcuagugauaugugguaugauaccauauugugauacuaggcagcaacagcaaguugcagcuaccagucagccacaugaucaugaggguaaacaacugauaacauacaguauacuguguugucagaugauuuugcccaaccacaggcuaauguaaaggguucugagcacguuuaagguaaguuagacuaagcugugauguucgguagguuagguguauugaaugcauuuucaacuuacgauauuuucagcuaaugauggguuuaaucauuaccccaucacaagcugaagagcaacuauauaaagugaaucuuauaaaguaaaucuauuucacuuuaggugugagguucuaugggcguggucaaguauugaguggauggagaggcaaggauggugugggaaauauuuugaaggaagucuauaggguuggggaauugacuagauauaauuaaaagagggagacauugaaaaaaaccuccagggauucaagaucagaaggauggcaguuuaguagaaaaagggaaaugcaaaaguaaaacuaacuuuuauaauuuaagguaagauucauauaauuucaccauuuaaaaauauacgguucacuggcauuuaguacauucauaguguuguacaacugucaacacuaauuccauaauauuuucagcuccucaaaaggaaaccuguuacccauuauucugaauauuagauauaaauagaaucaaacugugugacugacuucuuucacuuucaaaguuucauguuguagcauguaucaguacuucauuuuaaaaaauugcuaaauaaugcuacauuguauugauacaccacauuuuuuucacuuugauuauuuauuuauuuauuuuuuuauuauuauacuuuaaguuuuaggguacaugugcacauugugcagguuaguuacauacguauacaugugccaugcuggugugcugcacccacuaacucgucaucuagcaguagguguaucucccagugcuaucccuccccccuccccccaccccacaauaguccccagagugugauguuccccuuccuguguccaugugaucucauuguucauuucccaccuaugagugagaauaugcgguguuugguuuucuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacagacgugugcaugugucuuuauagcagcaugauuuauaguccuuuggguauauacccaguaaugggauggcugggucaaaugguaugucuaguucuagauccuugaggaaucgccacacugacuuccacaaugguugaacuaguuuacagccccaccaacaguguaaaaguguuccuauuucuccacauccucuccagcaccuguuguuuccugacuuuuuaaugauugccauucuugauacaccacauuuuauuuauuaguugaacauuuggguuguuccugcuuuuuuggcuauuaugaauaaugcuguagacauaauuuuucaggggaagauauggucaguuuuggaaauauagucauaccuugcuuuauucuacuucacuuguugugguuugcagauauugcauuuuuacaaguugaagguuuguggcaacuuuguugagcaagucuaucucagccauuuuuccaacagcgugagcacuucuugucucugucacauuuuuguaauuuuugcaauauuucagacuuuaaauuauuauauuuguuauggugauuucugaucagugaucuuuaauguuacuauuguaauuguuuuggggcacugcaaacugcacucauguaaaaugguaaacuuauauaauaauguguguguuuugacugcuccaccagccagcucuucccuaguuuccucuccaugggcuuccuuauucccugagacauagcaauauugaaauuaggccaauuaauaacuuuauaauggccuguaaguguucaaguauaaggaagauuugcacaucucucacuuuaaauaaaaagaacuagaaauuauuaagcuuagugaggaaggcguguugaaagcagagguaggccaaauacuaggccucuugucccaaacagucaaguugugauugcgaaggaaacauucuugaagaaaguugaaagugcuacuccacugaacacaugaaugauaagaaaguggaacagcauuaucgcuaagauggaggaaguuguaauggucuggcuagaagaucaaacccgccacaacauucccuuaagccaaaggcucgaggucaagacccuacucucuucagaucuaugaaggcugugagagugaagauggugcagaagaaaagcuugaagcuaacagagaugaguucaugagguuuaaggagagacacugucuccauaacauaaaaguauaagaugaagcagcagguacugaugcagaaguuucagcaaguuauccaugagaucuaccuaagauaauuuaugagggcggcuacacuaaacaauagauuuucuauauagauuaaauagacuucuauuuauuggaagaagauaccaucuaggacuuucauagcuagaaaggagaagucaugccuggcuuucaaauuuugaaggacaggcugacucucugguuaagggcuaaugaagcuggugacuuuuaaguugaagccaguacucauuuaccauugugaaaauccuagggcccuuaagaauugugcuaaaucugccagaugugguggcucaugccuguaaucgcaacacuuugggagguggagauggguggaucacuugaugucaggagccaggaguucgagaccagccuggcuaacauggugaaacccccgucucuacuaaaaauauaaaaauuagccaggcgugguggugcaugccuguagucccaguuauucgggaggcugaggcacaagaaucacuugaaccuggguggcagaaguugcagugaguuuagauggugccacugcacucaaggcuggucaauggagcgagacucugucccccccccccccaaaaaaaaugcuaaaucuacucugccuaugcuuuaaaaauggaaccacaaauccuggaugacagcacaucugguuuacugaaccagauguaaacgugguuuacaacaugaauuacagaaaauuuaagccuguuauugaaaccuacugcucagaaaaaaauuuuccuuucaaaauauuacugcucauugauagugcaucuagucacccaagagcucugauggaaguguacaagaagauuaauguuguuuucauguuugcuaacacaacauccauucugcugcccaugggucaaggagucauuucaacuuucaguucaagucuuaauauuuaagaaauaacauuuuguaaggguguaacugcuguagauuaugauuucucugauggaucuggguaaagugaauugaaaaccuucuggaaaggagucaccauucuagauccaauuaagaucauuugugauugauggaggaggucaaaauaucaacauuaacagaaguuuggaagaaguugguuccagcccucauggaugacuuugagaguuucaagguuucaguggaggaaguaacugcagaugugaugggaguagcaagagagccggauuuagaaguggagccugaagaugugacuaagugcuguaaucucauuauaaaacuugaaugaaugaggaguuguuucuuauggaugaguaguuuuuuugagauggaaccuauuccuggugaagaugcuguaaacauuguugaaaugacagcaaaggauuuagaguauuacaccagcuuaguugauaaagcaccagcaaggauugagaggauugacuccaacuuggaaaggaguucuacuguggaucaaaugcuaucaaacagcaucguaugcuaccaagaaaccuuuuguaaaaggaaaagucgauggaugugccaagcuucauugucuuauuuuaagaaauugccacagccaccccaaccuucagccagccacuacccugauuagucagcagccaucaacauggaggcaggaccuuccuccagcaaaaagauuaugacucacugaaggcccaaaugagcuuuaucuuuuuuuuuuuuuuuuuuuuuuuagcaauaaaguaguuuuuauuaagguauauauguuguuuuuuagagacaaugcuauuguacauuuagacuacacuauaguuguaaaccuaacuuuuauauucacugagaaaccaaacaaugcgugugacuugcuuuauugcaauauucacuuuauugugguggucuggaacagagcccucaauaucuccgaggugugcauguacugaauuugaggugcguuuaaauaucuagauaguaguuuucaguaguaaaagaggaaggacugggacuuagaugagaugucagggugucuuucucugucuguguucuuauaaauaaauaccugaguuugggcauuuuauaaagaaaaaagguuuauuuggcucaugcuucugcaaguaucgugguaccagcaucugcuuggcuucuggugagggccucaggcugcauccacucauggcagaaaacaaaagggagucuguguggguagcgauuuauaaggugaaagagaggaagcgaaagaggagggaggugccaggcuuuuuuuuugguuuuuuguuuuuuguuuuuuuuuuuaaacaaccauuucuugugggaacuaauagacugaaaacucacucauuaccgugaggacagcaccaagccauuggugagggauuugucucuuccacccaaacaccucucauuacccuaccugcaacauuggggaucaaauuucaaccugagguuugagagacaaacauucagacuguagcagaggugaauauuuucugaucuuauaggcugcuguugagaauugauagcugagacuaugggaucuauuagaucugcuguuagggaacaguuucugugggacugaggucuaaacuuuguggaaaaccuguuuuuacauuauuuaaggaggaagugaucuggagaaucucuaaagaguuaaaaaggaguaggugaguacacaggacuauugguguauagaaaauuacugagcaugauauuucaagaaaugguguuaaaauagcugcaagauaaacaaggaaaaugcaaaugaagaaaagguaauuugauuuggcuauugggaggguuuuuggggucuugagguggauacuugcuuuuagcaaagcacuguggaguagauaaugcuguagcugcccugcugugcucagcucaguuuugacugacaaaguggguagcaguaacuagagcaagugguuugcaaccuagaucagauuugcaggagauuuuaguuggaugaagaggaaguuuugaagaggaagauauucccuguacccugugugaaaauuuuucuuucguauuaaagcuuuuaauaacuguacugauuuagauucauuguagauuuaagcagucuguugaagcauagccuuucuauguauuaauauuauauuaaaagaauuuugcauuuacaaaaauguuaaaauucuaaaaaguugauuuaucaugaugcuauaauauuugagguguuugaucugaaucugugucugugaagcaguugauuucauugggaguuuugauuuaagcccucaaacaucuuuauuaaaaugaaauuaauuuaagauuguuggcuguuacuuuuuuuuaaagaauauacuuguuuugaauuaacucaagacuuuuguucucaguguugagcuucaaccuaacugcuucauucauuauauuguacuugaagggucuuagaaauauuuggauauaacagguugauuaucagauauuuuauugcuaauucaaaaaugaaguuucauaauucaacauuucuaauuagaauuuuuuuuuuuacugaaauaaugaaaaaucuuccguaucuuucagucuaggcagaaauuuacauaccuccacuagaaggaaauauuuuaggguuggaaggguucuugaagggaucuugaaagugaacauuuucagucacauaauguuuaaauuuuucauauuuuucuuugaugaucuuucucaccuagaguucaucuucguuuuugauauuuuaacugcuaauuguuuuguucuuauauugagaugaagucugccucccuguaauuugguauuccaaauauuccaguauuccugguggaggcaaauagaguugugucugaaauauucagccuuagaagugccuggauuugaauccuugcuccucuacuaaguuuuguuacuuugggcgagauacuuacccuguauaacuaaauuuccacagcuguaaacaggggaugaugauagugucuaccucauaggaguuuuugaggauuaggugaaauaauauaugcauuuaauguuagcuaauguuaauguauacuaauuacaauuauuuuauaauuauauauuuaucauauuguauaauuuauaauggcgauaacauaguagaauguaaggaaugaagugauguuaaagcucaauacuagcaauucucuaguuugcucaaaacaaguaaauauuacuguuguuguuauuauuacuugagccacacaaaguucaagucaccuucuuuccuucuuucucaugacaaacuuuaaaaucuccauaaauagcuuuuacuucucccacccuauagucucagguuuuuuagguuaaauaacuuuaguccuuucaacuugaccuagacaaagcucuaguucugaauuccuuguaguggacaucuguuauuuuugccacccagcaucuauuuacccuuacuugguuuuccuuuggaaaaccauucuuccuccaaucuuuauucuugugcuuuuugauuaagacucucccucugguaccagggagagcaugugauguaagcccaaaccuaucacaaugccuuagcauucccuuagugauuggguuagggaagggcauguaauuuuagccaagccaaccaacuccaaucauagcugggccucuugucauuguccuggguuucaauauugaagaugguuagacuggagcuguuauagucauccucaauggagauccuuuaugaggauagaaucaauacagaggaagugaagcccaggaauggagaaagaaaccagauucacaugauauugugugaauuaugccuguaguuauuucuacaaaugagccaauaaauauccuuuugcauaagccaguuugaguuggguuuuuguuacuuauaguugaaagaaucauggccaauauguaguauuucaaguggggguguugauuaguauagaauaggguaaaauagucuucucucugauuuaauacucaaauucuguuauuuugacacugugucacaaaucugacaucaguccccacuuaaaaucccucagugguuuuucauuguucuuaggauaaggacagaauuucuuaacacaguccauaggugcuucauuguuuaacucuugucuaucucuaugucuuaucucuucccauguaacuccuugcuuuuuuuuuuuuuuuucagucacaaugguuucuuugcagcuuuucauauuugcuggcuuaucuucugccauaggucuuuugcacauucaguuccuucuucauggaauccucccuuccuucuccuguuugccuaguuaacuccaacccuuucuucaaauaacaacuuaauuaucacuuuucuuuuuuuagcaaagccaauuuugauuaugcugacuauaauuccagguucauaaccuucauagcacuuaccauugucauuuuacaucucuuuguauggguguuugucccuaucucuagaccacaaguuucaugagugcaguaaguauguauuaauuuuuguucauuauuguauuccuacccgacacacaguaaauguucaaucaguacagcugucccuuaguauucaugagggauugguuccaagaccccaguggauagcagaauuugagggugcucaagucccuuauauaacaugguguaguacuuggauauaaccuauacacaugcucucauauacuuuaaaucaucucuagauuacuuaugauaccuaauacaaaguaaaugcuauguaaauaguuguuauauauuuuuuaaaggugcauuuuuuaucauucuuuuguuacuguuuauugguuuuguuucugaauauuucaguccaugguugguugaaucugugguuguggaaccacggauagggagggccaaaugugcacuucuggaauaaaugaccuucugucauguagaucuucugguacaucuucagcaguacaucuucaauuuauauuuuuguuaauuuuuuuuuugggcaaauacaaaacuguuacuaccauucauucucuuauugagaucuuuuaaagcuucauuccauuuauuuauuuaauuaacauauuccuucauuuguuuuuagauccagggacagacuggguaaagccucauucugcuaguuuacauguauuauacucucuacucaugcauaaauugaaucugcacacaguauagcuuuuauucaaaucauugcuauaaauauugcccuuaguuaagucauucaaggcacuggaauacccuucuuaucccuuaaccacaacucuaucuucaaucacuaucaucuguugcaucacacacaccaaacucuagugagugggauugggaauagggcaggagagggaauaggauucuuacuuuguacuuuauauacacuguauguuugaaccauuuucaguaaacauguuuuauuuuuuaaaaaaagugcuaaugaaaacauuuuuacuuuaaggauuaaugcauauguuucuuccaugauaggguauuuccuaaccccuggcuaaugugauugcuuuuauucaaacuccuaaccuagaaacucuuaacuuuuugguucauaggcuguuaugagaauuugaugcacugucuuaucuuuccagaaauugaguauucacaaaauuuugcuaacuuuuuuauuucuauggugcccccaacacguuaucaagaaccucugcuguaccacuuuuaguuuuuauaauuauagcaaccauauccucuuuuauaagauauuuauguauucaucauaaucccccuaauagguaacuuuuugagauaggauccuuuucauauccuaugaaaaaaguguugagauuugcaucuugcauuagaaagaaaauaaguauauuauuuuucaaauucuuaaucauuaauauuaucaaguauuuuauuguccuuucaaagucuugacugagcucacuaacuuggagaauuguuuuggcuucaaggaauccaucuggauuuaucuuaauuucagagaauuaacgugcuaauucuuugauaaguuaccuucagagaaugaaguuuuuuguauaaguuaggagaugggcagggaaagcuggccucauugcucuaucuuuuuauucuuggaaagagcagccucuuccaggaccuggauuuucccuauucuaguccugaucgccuuugaaggccacuucuuucaagacugaauuccaaccuuuucccuucucuuugccuguucacuguuaagauucucaaauauauagucuuuuaaaaaugacauuagauauuuuugguuuauuuuaaaaauaaaaacuaugguguauccauauauucccuuuuuaaagaucuuuucuuccuuagagugcuuauuaucgggagacaauauucuucauaaaaauuagaaucuuucagaaauugggugagauuuaucuucuacagucucuuaagauucuauaaucaucccguauuuugucuacaguguuuuagcugcugaucagguguuuuuaguaauaaaguuuguguggugggaaugugcccuuuucaagaguaagacugguuuuuaacaguaacaacuggacugauucugaaaaagauacuuaguuuucuaacacuaaaacauuuguaagaaauacuugaggcacaaaaggaaguauugauuugaaauuucaucugcuuaaagguuguaaauaaaaaauauaguaagcuaauuuccuuauaaaauuucauagcuaaauaccuaaauuuuauuaaaucauuuuaaucauaggucucuccuuuaauuauauuauuguuuaucgcuuaugauuuacauuuucuaucacacagauuugucuuauagugccaaaguagguaucaucauucacugcuuuucuaauccuguuacaguaauuuccaauuuuccauaauggaaucaacaggcaauggauaguaaggggauguacaacaggaguuuuaaaaauugcucuuuuuacucaaaauauuucuuaggauuguaagguggugaacauuaaauaaaauuaauuuuugaauacuuuauugagauaguuggaagugcuugagggaucacaaaaucaggguuugaaauauuagauuguuauucauaguugagaauucacuuuguauccuuuaagcucuauucaucugagauuggaauucuaaaaugauaguccuccauuucaguaugccauuagugacauaaagacuaaagaauugcuuauaaaaugaaauagaauauaaacaaagcugauuuaaguagaaugacuuaaaugccugauuucuuggaaaauuucugagaguaaaaaaaugaaagaucaaacuuuacugaaccaauaagccagugucaucuaaaugauuccacugaaaaacucguuuuaaguauauaaguaaauuguuaguuuuuuuauagauagaacauuaucuugagcuaacuuuaugaguuaguugaacuucauuuuuaugugcaauacuuauuuugaguauaaauuuucacuauuugaaauaguuuuuuguaucuauuaaguugaucauaucuuguuuugguguugccaacuucuugguuaguaaugcaauccccaauuaaaacauuuguaugguggggagacaaaaagaaagauuaacuuuauaaugugauuuuuuggauuauuucauugauuuuauaucuugaauuuaugggauugggggagauguagaaguuaaccauuugaccgggcaugguggcucacaccuguaaugccagcacuuugggaggccaaggcgggcagaucacuugaguucaggaguucaagaccagccuggccaacauggugaaaccccaucucuaccaaaaauacaaaauuaguugggcaugauggugcgcaccuauaaucccagcuacucgggaggcugaggcaggagaaucacuugaaccuggaagguggagguugcagugagcugagauggugccacugcucuccagccugagcaacagagcaagacuccaccucagaaaaaaaaaaaaaaaagccauucaccauguuccucauaaucacuuuuguguuuuaauuaccagcuauuuauuuauuuauuuuuuagaaaauaaaauacuaagauacauguagaaugaguguuuuuucuuuucuuucuuuccuuuuuuuuuuuuuuuuuuuuugguaugagggucucacacugucacccaggcuggagugcaguggcccagucucggcucacugcagccucaaccucuuauagcugggaccaggggcaugugccaccacucccaguaauuuucuuguauuuuuuguggagaugggguuuugccauauugcccaggcugagcucaagucauccuccaaccuuggccucccaaagugcuggaauuagaggcaugagccacuaugcccagccugaacguuuuuuucuuaauagaaaugguguaaagauaccuuaucuaaauguuaauuuuuauauguugguacuuuugaauuggauacuuauucuauuagauuaguaguauguaauuuaacaguguguuauguuuauaugaggguuaaaauuuuuuuugguguauauuuuaauuaguuuagaaaugcuuuuuuaaaaagaugaaaaugugguaggauagauuugacagccacagucuggaagauauaaagcuaaaauuucaucaugagaaauuucacuguaaugaaggucauguaccacauaaugauguuuaggucaaggacagacugcauuauauaauacggugguccuguaagauuauaauggacugaaaaauuccuauuaccuagugauuuguguuauaauugccugcgguauucaguacaguaacaugcuauacagguuuauagccuaggagcaauaggcuauaccauauagcuuggauguguaguaggcaauaccaucuagguuuguguaaguacuguagacucuacgauguucucacaacuacaaaaucaucuaaugauacauuugucagaacuuaucccuguuguuaagugaugcaugaccauaaaacaaaaugauuucuaaaugcuuagcugauagcacguaaauuccaguauaacagaauugggaucaguucuuuuuuuuguuuuuuugagacugagucuugcugugucacccagacuggagugcaguggcacgaucucagcucacuacugcaaccucugccuccugguuaaagccauucuucuucagccucccgaguagcuuggauuacaggcaugcuccaccaugcccggcuaauuuuuuuauuuuuaguagagucccgguuucaccauguuggccaggcuguucuugaacuccugaccucaagugauccaccugccucggccucccaaagugcuggaauuauaggugugagccaccaugccuggccucgaguucuuuaaaaugggauuuaucucagaguuaaaaauaguuaaacaucguugagugguuuccaugugccaggcacugagauguguuuuacauauauuaucucauuuaaucuucacuauaauccaaugacauaagucuauuuuuauuuuuuauguauauguaaaugguaaauguauguauaaaaagcaguaaagcaaggcacuagguuaacuaacuuguccaacaucauauugguaauaagugauugagucagaauuugaauuuggcauucauucuucaccauguuuuacucuucaugguuacuaaauguuuaaaguauacaauagauuuugagcugaauuaagccagaaucuuucaguugaacuauaagccugagagcuagaauugaagaugacuuggcagaagguuguggccaugcugguacuaugacuugguucuccugguuucuagugcgauauucuuuuuuuaaaugugcagauacuacaguuguaguuugugaaauugcuuaauuuuuuucuuaucagaaaguaaagaggacuauaucuaguauauagcacaccuguguccauaguaugugcucuguacuugaucacaugcaguauuaauauuauuuaacacggcagcaguacaucgggugauaucuaucaauggaugaaagugaaaauuucagauaguuaaaacacuuagacccacauuuccauugauuucuaauuuuuuuuauagaaaaaauaagauacaguuuaauuuuagauaaaaacugaaaccaaaaauuuauaaaauaggaauuauaauuauuuaugugggcaguauccauaaaugaauggaauuuauuuuaagucaguuacuuggaauucauuuuucccccaugcaaacaguauauuaaauaugggcauguaaucuguaccugaguuaguaguugaaguugagaguccucuuuuuuuuuuuuccuggcuauuuuauuuuauuuuuucgagagacagagucuugcucucuugcccaggcuggaguacaguggugcagucucagcucacugcaaccucccucugccucuuggguucaagcgauucuccugccucagcuucccaaguagcugggacuacaggcgugugccaccacgcccagcuaauuuuuguacuuuuuaguagagacaguuugacucuguguuggccaggcuggucucgaacuccugaccucaggugauccacccgccucggccucccaaaguguugggauuacaggcgugagccgccgcgcccguccuuuucgggcugucuuaaagagccaacucugagcugaggccuuugaugucuccauugaacaucuuuguuggauguauucucuggcagcagauuuaguauuuauuuauuuauuuuauuauacuuuaaguucuaggguacaugugcacaacaugcagguuuguuacauauguauacaugugccauguuggugugcugcacccauuaacucaucauuuacauuagguauaucuccuaaugcuaucccuccccucuacccccacccaacgacaggccccggugugugauguuccccuuccuguguccaaguguucucauuguucaauucccaucuaugagugagaacauguaguguuuguuuuuuuguccuugugauaguuugcugagaaugauggauuccagcuucauccaugugccuacaaagacaugaacucauccuuuuuuauggcugcauaguauuccaugguguauaugugccacauuuucuuaauccaaucuaucguugauggacauuuggguugguuccaagucuuugcuauugugaauagugccgcaauaaacauacgugugcaugugucuuuauagcaacaugauuuauaauccuuugaguauauacccaguaguggaagggcugggucaaaugguauuucuaguacuagauccuugaggaaucgccacacugucuuccacaaugguugaacuaguuuacagucccaccaacaguguaaaaguguuccuauuucuccacauccucucuagcaucuguuguuuccugacuuuuuaaugauugccauucuaacuggugugagaugguaucucauugugguuuucgcuugcauuucucugauagccagugaugaugagcauuuuuucaugugucuguuggcugcauaaaugucuucuuuugagaagugucuguucauauccuuugcccacuuuuugaugagguucuuuguuuuuuucuuguaaauuuguuugaguucuuuguagauucuggauauuagcccuuugucagaugaguagauugcaaaaauuuucucccaaucuguagguugccuguucacucugaugguaguuucuuuugcugugcagaagcucuuuaguuuaauuagaucccauuugucaauuuuggcuuuuguugccguugcuuuugguguuuuagacaugaaguccuugcccaugccuagguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggacugcuuuccccauuucuuguuuuugucagguuugucaaagaucagaugguuauagauaugugguauuauuucugagggcucuguucuguuccauuggccuauaucucuguuuugguaccaguaccaugcuguuuugguuacuguagccuuguaguauaguuugaagucagguaucuuucauagaauucugugcuuuaccaagaaaauucugaagccaguagauacuuaccugauaacuuaaaaacauuauguaugaguccauaggauauguaauugugaaucuuaaaaauauuccguguuccugguauugauaaguccuuaaugugaagcaaggauuaucacguauuuaucugaaauaagcauuauacuguugcuagugggacaagcuacagcuauucaaaaauugaguuaaaagauuuuuaauaguacaacuuuagaacuaggggauauuuaguuaagcacaagauucgcuagagucucaugugauaguaacucugaauaacugaauuaauaacaauaacuucugaaauuaaaguaauaauuuuuccuuuguaguaauucaguuuacauacuuuagaaauugaaaaguaggaaagcuugcuuuugucagccuaaggauaaagaggaaagugaagguugaauuaguuauauauuccaguguuuuagauuuccauuguuuaauuguugacguuuuuugcuuuauaacucaguuuuauaaaagcuuguuuauuuuguaaaauucaugcuauugcgugugcauggaaauucaaaaaacagauucccaguuugaauaaagcaauucaaauaguuuuuaaaaaaauguuuauucuaacagcauuuuuaaagccaaauaaauuauugacauacuagauuguaaacuucugaagucuuaagaaugugacuuacucauuuuuguuuuccccugagcuuagcacauuaccuuccauacagaaggccaugaguaguuauuuuuugaaugaauuaaucuaugaugaaauauuuccaaugaauuuucuguucccuuucgguugauaaaaagccagaaagauauaaacuaaaauuuguuuaaaauuguguuuucuugcagaaauaauuacauguauuucugaaauacaaagaaaagauaacguuaaagauuaaugucacucagcguuugaaaaguuagauuuccaaaaccaguacauuguaagguguuuacucguuuuuacuaaauacuuuaaaaaauuauuuguaauuuacaaaucaucacauuucuucgaguauuaagugccaaguauaaucaccauuuauuuauuaaauuuggguuuauucaggaaugaaccaauuauguaaaaugaacuauauguguauaucagauauaucaaacauaauugaccucuguauaggagaaaagauuaaauauguauacaucuaauuuaaugaaguccacccuaauaguugguaucuuuauuuuauaggaaggaaaacagaaauaacuugcuggcuugucuggagucacauggugaguuuagagguuaaccuuacauccaauaauuugugaaucccaaguuucauguuucaauauuugguguuacuuaaagugacucauuaaauugacugauaucaugugucaguacuuaggugacaauuuacagaaagucaucucugcagcuugaugggcgacaacccuuuucaaccaaaaaguaaguguugcugccacaacuaauacuaauauauguggcuuuuguaucacuuuaccucaggagaaaggaugaaaguugggagacauuuuuuaaaaaacaaaaaugcuuaaaauuguuaaaguaacaaauguucacauaaaaacaaguaauauaaauaaaaaagugaguaaaauagaaguguuuucccccauuaucagaagaaacuacuuuuaccaauuugguacauauaaucauacauguuucuucuguacauagacaaaaauuaaauuauuucuaaaaaaauuauaaagcuauuaugucuuaaauuuuuuuuuucucaaaaauauguccuggguauauuaacaaugacagugcccuguuaaaaagaacaaggaagaccuuuguauacuauaugaguuugcuagggcugccauaacaaaguaccacagauuggguggcuuacacaauggacauuuuucucauaauucuugaggcuagaaguccaagaugaaggugucguuaggauugauuucuucugggggccauaugggaaggguuugaggccucucuucuugacuuguagauggccaucuucucguuuuuuguuuguuuguuaguuuguuuugagacagauucucacucugucacccaggcuggagugcaguggcaugaccucggcucauugcaaccuccucuuccugggcucaagugauucucccgccucagccuccugaguagcugggacuacaguuacucgccaccacgccuggcuaauuuuuuuucuauuuuuaguagagacuggguuucaccauguuggccaggcugguaucgaacuacugaccucaggugauccgccugccucagccucccaaaguguugugauuauaggugugagccacugugccuguccuccaucuucuccuuacaucuuccugugaucuccuuuucugcuugugucuguguccuaaucuccucuucuauuaaggacaccagucauacuagauuagggcccacccuacuaaccuuauuuuaauuuaguuacuucugaggacccaaucucuaaauauagucacauucuaugguggugaggguuaggucuuaaacauaugaauuuugagaaaacacaguucagccuauaccuauaccaacuggauauaaauaauacuuuuguuauuacuauacaacgagucucccugauuguuuaaaauuaugcauuuucugacuucgccuaguccauagauuauuauaugccaugugccuacugccccucuaauguauagggggaaauguauuccuauaugacguuagacauauaaaauuaagacacaugaaaaaauagcaguuugagaucguauauguuaaaucuugaauugcaugauauugauuaucaguguaguucagauuuugaaggaaaguaaaaucuaaugguuuacaagaggaauuauaauugaaccaagaguuaggagggccagggaauuaauauuuuguugaguauccacuugauuuuaggugcuuuauguggcauuuucuugaaucuauguaauacuuguauuagguagauaucauacuuguguuauagaugaggaaaauagguucaaguaacuucucuagagucauaugauuagaaacaguggaggaaagauuugaauuauucaacuugaugucagcucucugcucucuuugcuccagacuggagugacauagauuguaaaacugagaaggaaagauauucuagguagaagacgugguauaaauaaucgcucugagacacacaauaaggcugguauuucaaguauuuaaaaaacacaaaugcuaaguuaugacuugucaaugaaaauuaguauuuuuaauuauuagauuugaagaacucuguauaauuaguaaaauaguacaguuuagagaaaaaaguuucaugauauugauggcauuuaggaaaaugggaaggccuuuuuuuugguagauggacuauacuauaacauuagagugggaaaugauuugugacauucuuccugugagaaauaucuacuuugccuuuaauugaauaagccuaauuaguuuuccauauucuauucuagcaucucuucccugcuguguucugugccuggcauuuuuuuuuuuaaagacauacucucaaucugucaccccuggcuggaaugcaguggcaugaucucagcucacugcaaccuccaccuccuagauucaagcgauucuccugacucagccucccaaggagcugggauuacagaugugggccaccaugcccggcuaauuuuuuucuauuuuuaauagagaugggguuucaccauguuggccaggcuggucucaaacuccugaccucaagcaaucugucugucucggcuucccaaagugcugggauuacaagugugagccacugcucccauccugccuggcauucuugaaucugguuuaguuuauccaguuuaucucccaccuguugccuauuauucuuaguuuaucugccuuuugugaauacauuuuuaaaaagacaguggguauaauccuuuuuguagagauaaucauauucuauguauacgacuaaaacucacuuucacugaauuugacuuccaaauuuucugucuacgguaaauaacuacugucauugauuaucuguuuaucuaaauuuuacuauuuaauauuuuagauaguaagcucuguauuucucacuguuguuaccacauacugacuacaaauaucaauucagaaauugcuauuaagauuauuaaaguacaccuuaaaauuaaugcuauguauuacaaaaauguuuuuauuuuuauuuucaaaaaugagguuuacuucucuccuuuugaaaauuagguaauucaaaaauggcagaacuguuuauggaaugugaagaagaggagcuggaaccauggcagaagaaaguaaaagaaguugaggaugacgaugaugaugagccaaucuuuguuggcgagauaucaaguucaaaaccagcaauuucaaguaagcauuuacuuuuagugaaaccaagcuuuauaagguauuauuucuaguagaaaaacuugugaacuguuuaauagguaguugauguucauguuccacuguaaagaggaacaugauuggggacuugaggaaggagguaagagauuaaauaucagaugucagaaaagagaaauggacugagauuagcuggugacccuggaggucuucugagauuagaaaucauaauuuuuaauggaguuaaguaauuauuuauuuauuuauuuauuuugagacagggucucacucugucgcuagucuggagugcagugaugcagucacagcucacuguagccucaaccuccuuggcucaagcgauccucccaccucagcuucccaaguagcuggcacuacaggcauguguuaccaugccuggcuaauuuuuguauuuuuuguagagacagggucucaccaugcugcccaggcugcucucgaacuccugagcucaaaugauccaccugccuuggacuccccaagugcuaaaauuacaggugugagucacugcaccuagccuuaaguaacauauuuaucuguuuauucuuuuucauuuuucuccaacccagaagagaaaauaaaacauuuggaaugcuuugcuuaaaauuucagaauauacuaagugaguuuuuguuagucucaaacgggacuucucacauccaguccucacugcaaugucaucuauacguggcuacaaaauguauagguggugaaugauugcacagacucuggccuguguaccaauagaagcugcagcuucugaccauauccgucuuccagcaacuccuuuuuauauucaugaaagagaauggcgcugucuacagccacuguacuuggaugauguagcauuuaguacauuuaaauccuuaaggcuuuugggcagaacaacuugguaccuuuguggcuuauuagcuuugaauuagagaauugggcuugacauuguuauaauauuaacgugcagauacugaugacauuuguuaaaauguccacucaaaaauguaugacagugcagagaaacaauguacaaauuucagggagaaagagaaaauagauccuuuuccauuucauuuacuuguuuguuugaagccaggagaauuuaccaaagaauuuuauguacccaguuuaccagcguguguguguguguguguguguguguguguguguguguguguguguguguuuacuuaccaugguagugcuuaaaagugugauuaagagaccaaaauuuuuugaaagccuaguucuugcuucacuuaccucuaaacuuggauuggcaccuuuauucaguuuuaucagagagagaguaauuucaccaaucgaauuuucaauacuguuuccuggggcacauuggucaucucucauggaaugcuaaguggagugccacuuggauuauaaaaugaauuaggcaugauggcaucgucggugauagugggacauaauauucuauugguuauuguuuuauacugaaauauuauauugcaaaauucaaacucuuauugaaaacaugacaguuaagauucaaggugaauuuauacugauuguagaugacucuucaugguauucggguagaacacuguacauuaguuuuaaaauaauuccaucaagaaggggauuaaccccaacagaauuucuuuucuacaguguuaaggugaauaauuuaaaugguuuuauuguuguuuuauuuguaagccauaaaauauguuaacauauggaacaugaguuaaauguuuauauaaaacugcaagaaaggagggcaaaaacuugugauccauagacuacacccacuaaauaguacuacagcaauagcucuuucaugguuugaguaaauauuuaauccugaauuucugaaugaaaacaguuucaaguucuuugaguagaucuuucucuaauaagacuucuguaguguuuaauuacagagcacugcauugaccuuaucagaaaacaaccauauuucugugugaaccauuauuuuauagaauuacuuaaugggaucugguuucuuucuacugugaggaagauaaaagaaauuuuuaugagauuuggugggugguuuuuuuuuuuuuuuuugggugcuuuuuaccuuuuucuaaccagcaauuuuaggcaaauccucaugcuuccaaacuauaauuugauaagcuagaaguuacagaguuuacaugcaugcaagaaugaggaacuuuaaauugauccucaaagucauggcaggcucagauugacuucugguguagugguaaauuugaaaccucuuaacuaauaaaaugcuaugaugaacuauugguucacuuuagucugcaaucucugauaguuuuucuuuuuuaacucaaaacuaauaguagauaauccgaugagauuuucuguaaugcaacuucaaggcuuuuagacgagugaaugcaguguagagguugggcaaggauuugauuuugaaucauaggaaccugacuguauguaacagcccugucaucaugcaaagaaagauauacauuuaaauuauagguuauauauaaauauguuuuuggaaaauuuuuaucaaguaugugauguuucuuugcaagcacaauguuuugacucaccuguagucagauuugucauuuccuucugaauuuuggauuuugaguuacaaugagaaagauuguucuuagucuguaaaacaaaaccuaguuaucuuguuucuuuuguuucuuuaguagguaaagauguauguguuuaaaaugaacuauauucuuaaaucagugauuaguuauauacuccuuccauaaaucuguuuaaauguuuucaauucaugauuucuauuaucuuaauauguauuucauucaaacaauguauuuuaaaauaaauauaaucuuuuauagauauuuugaacagaguuaaccccagcucauauucaaggggacuaaagaauggugcacucagucgagguacaguauuauuauacuauuuuaauuuuaaagugaaguauuuugacaaaauugauuauguacaaauaauuuccauauauuguguuacuuuaaaauacagguauuacugcugcauucaagccuacaagucaacacuacacgaauccaacaucaaauccagugccugccucaccaauaaauuuucauccugagucuagaucuucagauaguucuguuauuguucagccuuuuucuaaaccuguaaguguuucuaaaacuauacggccagcucagggauccauuggauguuguuuaucaauaucaacaguacccaguuacaauucuggacugucauaaguagucauccaguagaagcauaguuagcaucagaaaaugucaccauauuuucgcuagcucaagcaguaccccaaguaauaacugaaggagcuaacuacccaaccuguuaauaacaggcaguaugccuaaauagguacaguaaugaaaacuauacuaucaaaaugugaauaaaauuauagucagccauaaauauugcauaaugacaaauauuuaagauugcagacgggaccagguauucuuaauugggaaaacagucaagugaccaucauagcuuuuuauucugaaaacauuccuucauaguucaguuaguuaaaaaaaaacaaacauuuuuuccuauuacaaaaaacucccacuuuuuuuguuacaaaaaguaauagaaaaugguaauaguuaacauucauugagcuguuaauauguauaaguguuugugcuaaaugcuauagguaaauucauuucauuuaguucuuaaacauccccaugaaguaaacacuauuauuauccucauuuuuuaguugaggaaacugaggcucauagagguugaaagauuuauucaagaucccaaagcuggcaguugauggaucugggauuucaauccagccuaacccauaguuuauauguauaugcacacauacauacauauauguuguguauaaauguacacuuuuuuagacaugaaagaauugccuuaguugaacaguucucagauuguaguuugcaauccccugggguuccccaagacccuuucagagguuugagggucaacaguguugucauuauaaucaaagacuguuuuccuuuuccacuguguuggcauuugcacuggugaugcuaaaguaaugguggauaagcugcuggugccuuagugugaaucaagguagugccaccaaaguguacuuguaguuucuguauuagucaccugccgugcacucacaguaaacuacauuacucaacugaguauuacccaguuauacccaaucccugaugaaguauuaaaauguuauuaguuuuauuaacucucuacacuugaauguguguuuuuuaaaauauucugugugaugacauggguagugugcauaaaguaccucugugucugaaguaugauaguugucuugaggaaaagcacuugugugauugaauugugagguaaacuaccugauuuuuuuuuguuguuacaugaaagaaugagugacaaaucuuuaaaguauuuacaauaucacuccagaaaagaaaacaaaucaaauaaauauugacucaaaacucuccaaguacauaucaaaaucucaggaagggaaaaaagagucuaaagaacaaaauauaacacuauuuuauuucagucauguuaguucaguuuccacaguuugaacuggguauagauuaauaucuaaaaccaaaaaaugaacauguguauagugaugcugaaaaaugugcauuauuuuuuauuuauauuuuaggaauaauaaaguuaguuauuaaagaauuuagugauuuugauugagugagaggugugagcuauauuugcuucuuuccuguaugauauacauacauuguuuccaaucucauuucuauuaaauaacuauaggagagcccacagccuuguuauuuuacauaucacuauuuagauauuuguuauuuauuuauuuguguuggccugaaguaaauguuacuuuuguacgauauuugaaggauagauuuauuuuauaaauuaauaguuuaaauaagauuuugccagcauuugaaaugauauuuauuucuguguaucaauauuaccacaaacuuacacagcuuaaaacaacauacacucuuuaucucaugaucucacaauuucugugggucaggaaucaggucauggcuuagguggguuuucugcuuaaggaucucacaaggcugcauucaagauguggugccugaaguugcaguuucaucugaaauucuguuggggaaguauuugcuuccaaguucacaugguuguugguagcauucaguuccuuaagggauguuggacugagaaucucuguaucuuguuggcuuuuggcuggcuccuugccacguaggucuucccaauaaggcugcuugcuuccucaaagcuagcaggugagagugaguccuuagcaagaugcccuuacagucuuagguaacauaaucacguacacaaaaaucauauauauccugucaccuuuguuguguucuauugguuaaaagcaagucagagguccugcccacacucaaugggagggaauuacacaggaccugaauaccaggaccuggggauuauggguaaugacauuuacauggaggccacuuuagagucugucugccacacacgcuuagucaaucuugauuguuuggcaaacauuuccucaaaucugucacuucagcaaaaauaauugauaguaauauuucuuaccaaugguaaaauuugaacuuuuaagcaaaaauuagaauuuuggaaaacucauuugccaccgugaucuuggcagcuuuugaauaagaguuuucugauggguggugguguucauaaauaaugauuuuuaaaauauuguguaaugaacuaugucaccauuuggaagaccuguguaauucagugaaacuaguauuuuccacauaacuaguauauauacuacaaaaguaugcauggguaaaacauacauuuaaaagcuaagauagaccaaugauuuuaauggaacggguguucugggauacgguuucagauuucacacugcaacaaaccuuuaagaaaguaccaacuguucaguuuugguauaguaucaaaguaguauauccacaguuaauuaaaacccuauuaaaacacucccuuuuccaguuauauauuccugugaggcagaauuuaauaauacuccucaaccaaaacaacaugucauaguagacugaaggcagaagcagauaagagacuaaaacaauuuuugauuaagcuagauauuuaagagcuuugcaaagaugugaaacaaugccacuuuucacuaguuuuuuuugcguuugcaagucauuuuucauuaaaauguuauuuauguuaauuuguaaugaguuuguuauuuuaaaaugaauaaauaaauauuauaaaauauucucuguuuuaauuucuaauauggaaaauauugauagauauaaccaaugugaacaaaaagucuuuuuggguucaacaauuuuuaagugcauaagaugauucugaagccaaagaguuagggcaccacugucucagaaaaauaguaguacauuuuccuaaaaauguauauuguuuaaauaauaagaacaauaagggagacugcugagucucuaucuucaaucaucuaagguucuacaggcuauuucuaauguuuuaaaaaauguaacagguggcugggcgugguggcucacgccuguagucccagcacuuugggaggccgaggcgaguggaucaccugaggucaggaguuugagaccagccuggccaacagggcaaaacccugucucuacuaaaaauaaaaaaguuagcugggcaugguggugggcgccuguaaucccagcuacuugggaggcugaggcaggagaaucacuugaaccugggaggcggagguugcagugagcuaagauccugccacugcacuccagccugggugacagagugagacuccaucucaaaaaaaaaaaaguaauagguguuccugaagguauagcgggaaagguacccagaauguaaaaauucuuugcuauuaguuggaaucaaauuaacuuagugguuucuuuuaugcuuauuauaagcuguuuggcauuugagggaaaaaaauagaaaaacaaaacauuauuuaauaguucguuagguaaaaaucuuuccaacguuugaccgaggauggggaaaaaaaauaaaagcaagaguuuguacguuugguguuauaagaguuaggaauuagauuccuuucugacucagaauguuuugggcauaguuuuuaaaucaaagcaccucagcugaugguucccaguacuuggguucuuuuaaaaaaugagagguuuugccaguuggucuggguggaacccagaaaugauagcugcuuaaaaacucuucaagugugauucuacugugcagucaaaguuaagaaugacagaggaguauucuggaaugaauugagaauccuguuuaagugacuuuucucugaauuuuggaagucauuuuaauaaacuauaguaguuuuuuauuuuaugucauauuuuguguguguguuuuuacuuuuucauggaaugugguaucucaacaucgcuuucagguuggcagggaugggauauauuauuaugacccagaaagucaaugugauauagcuuaagugcaugggcuuuguaaucagucagaccuggauucuauuuccagcuccaucagcaacaaguggggcuguacugggagccuuacucgaccccaccuaaccuuaguuuaccuauuuauaaaaugaggaauaauauuagguccuuauuaguauuguugugauagcugcaugauaugauacguguaccaugaagagcaaguacguuuaaaacaaacaauugugauuauuauuucaguuugaaaggugaguaacuugaaacucagaaguaacuuuuccauuuuuucacaaauauuuggagaaaauguuuacuuugaaguaagauuauguuuuauuacuguuaaaucauagggcaugauaaaaagaaaauacuacauguugaggcccaaauaccuacaucugccuacuaggccucaaauucuaggauuaguuugaguuacaucaauagcuuguuuccguaacuucuuaacaaacccaugucaauagaaaaguuaguaauaaagcaaaauucuuaaaacuugaauauuccuuaauuuauaauaauaaaacuuuuauguuucucuuaugaaguaauauguauuuggggacagaguuuagaaaagugagaagaguguaucaggacccuauaguauuugcaaauacauauuucucuuuuuucacugaacauucuacuuggaacauuuccuaaaaaaauguuaauuuggccgggugcagugccucacaccuguaaucccagcacuuugggaggcuaaagugggcagaucacaaggucaagagauguagaccauccuggccaacaugguaaaacccugucucuauuaaaaauacgaaaauuagcugggcaugguggugugcaccuguagucccggcuacucgggaggcugaggcaggagaauugcuugaacccaggagguggagguugcagugagccaagaucacaccacugcacuccagccuggugacagagugagacuccgucucaaaaaaaaaaaaaaaguuaauuuuugcacaauaguuuuaucaguuuaaucauuucuccauuguuagacauacagguuauaauuguuuuucuguuauaacuaauuuucccuuaaacauuuuuauuucauuaccauaaauucuuaaaaauggaauaauuagauaaaagggggugaaccggcugggcauaguggcuuaccccuguaaucccagcacuuugggaggccaaggcagguggaucaccugaggucagaaguucaagaccagccugaccaaucugaugaaacccugucucuacuaaaaauaugaaaauuaccugggugugguggcaugagccuguagucccagcuacucaggaggcugagacaggagagucaguugaacccaggaggcagagguugcagugagcggagaucaggccaucacacuccagccugggcaacaaaagugaaacuccauuucacacacacacacacacacacacaaaggaagugaaccuuuuaaagccuucaguagcuacugccaaagcuuuuaugcagaaaaauuauacuaaaauauaagcucuacuuugccaauaaugaauguuaucauugcuuuuuaacucaaacuaauauuagacacagaaaaaauaguacaaacaguucccauauaccccuuacccaguuucccuuuauuuuaacaucuuaucacaacuggguaauuaacauuaacccaacuauagacuuuacuggaauuucaucaguuuucccauuaauguucuuuuuccugcccaguauccuauucaggauacuugcaguuacuucuuuuuaauuuccucguauuuucuaguuauucauucuuucuuugucuuccaugaacuugacacuuuuaagaguaguggcuaauuaauuuauuuuguaguagauauuaugguaacaugccaauucauuaguuaaauguugcuguuguuuuuauuugcauuucuuuggcugguaauuuggaaaaaagguauuucguauauguuguucauuaguauuugacuucugaauucucucaguuuauguccuuugcccauauuuuuccuaaagugauagccuuuuuuccuuuaauuuuuaaucauuguuaauccgcuuguuauguauuaugacauguagaaugguccaaaagucacucugagagcuuaccguccacaaugaguaucuuuuagaaguauuaaugguauuggaguauacuuguguguguguguguguguguguguguguguguguguguguguguaugugucauuauauuuaauguauaauaauaucggaguguaugucccuaaauuauauugaccauauuuuucauaauuauguacaccauguauguaugcucauauauaacuuuauacugcuuuauacuugagcccauuaucauucaucucauacuuuucacuccucucuucuuaagaucuuccuuuuaguuuggaccacccuuucuccugauggaagggcuaaaacuuccuuugagucccgaggccuccaggagcaggacagcuggccccaauuauucccauaaacaacuucuguucuaaacccugucugccuggcauucuuauuuguucacucuacugaccgguuugcuuucauauuugccugauaagacagaagauuccuggccuagcguggcuuucuaugggaugauggaaaguguguggggcccauuuuuucucuuucugacacauagcuuauacauuucuccaauaaagaugauuucaaaauucacauuaugugauauauucauccuuaacacugaugcacaauacugcagauugauuccguuuguuugcccugauaucucagaugugagguuuuuagaagcauagaagcuuuuaauuuuuuuggucauguaaauaugguuuuuuuuuucuccuugcuuuugcccaaagauuuugcuaaguucuauuuuuuguccuuuaauggggauacugaaucuuuagaagucaucuaaaguguaucaaucuuacugauauauaaguugauuuauguuucuuuuaccuugaagaaguugaacuaagaauaugccccccauuuuaguuuucuagucagcaguaaaccagcucuaaguaauagcuugcuuucaguuucaguagaugauaauuuuggcaaaguagcaauuaucuuuguguuuuuaacuuauuaauaauugaguuaucaaaggguuuccuuagaauauugggcauacaauuuacuuuuauaaaugucuaugaaauaaaauucuuauauaauuauauaaaauuacauaauauauaauuauauugaaauaauuauaacuguugaauaaauguauuauuuuuccuuugaacuauuuaacaggguuauauaacaaacucaucacgaguugugucuaauaagucaucagaguuacuguuugacuugacccaggauacaggauuaucacauuaccaagggggaccaacacuuucuauggcagguugguuuuaguauuuuuuucauaaagguuauagaaagaaacuugaugaauaugcauaugagauugacuuucuguuuugaagucccuacccuugugugaaguuuuucauauauuguaagguggaacgucacuaguacuugaauaccuuauguggguaauuuucuguaaaauccuauuuaaugacagaauauuuuauuucuuccuauuaaguaagcuaaccaacuuugaacuaauucucacuuggagcuaaccauagcugagaaauauuaaaauaauuucugugaguuagagaacuucucagguagccugaauacucuguuuaaaaaaguauuaauuaguuucuauggacacuagugugaaaaauauauggcuauaguugauuucuuaauuaguuuaaugucuuucuauucuaauuguuucagcgugauaguucaauaugauuauaaagugcuauuauaaacucccaacaauaaauaaauagugauuuguacauaguaaguacucaugaaauguacauugaaggauuagugaacuuucccuguugaggaacauuuaaaguucuuugauuguauacuguaacaaaguucuucauuaaucuaaaauaaauuaguguacuauaaaauaauuuuaucuaauugaaaauucccuguaaucaaggcaguuacucuuuguaucuuagcaauuuguaucuauucaaauauuugacuaaacagacguauacaugauuuuuuggaauuuuuagauuuacuagcaaaucagugcggagaauuuaccaaacccucucccaguuuuuuuuuaauaguaauacuuuuauuauaaacuuaaacuguuuuuccaauuuuuuaauacuugauuugauauucaccucucugggugucacuuacguauuuaguaacaaucugguuugugaaauagguaagaaccaaaagaaacagggagaaaaaaauaguugucuuaagucugguuucauaaagcauguagauuuauucauagaaaaagucuaaauucuugaaacuucuugggaauaaagagaaauaaugacuccuauucuuucuguauaaguguucuacuucagugagugggacuuuagccugagcaguaagugggaugauuugauccucuauucuuaagauuuuuguagucucuauuaaguuaccuaaccacuuugguuuucucauauuguuaaaagggagauuuuaauuuuuuuuguagaaugcauucauucuucacaucuggaaccauucauuuggacauguaacuuuaauucuugcucuacuuagggauuuuuuauguccaaauccaagugaaaugugagaauacauuauaagcuuuaaaagacuugacaauacaguuauucugaaugauaauuaugaaugauaugugccacauguucaguaacaugauuaacacacuaccaucuagggagauuauggggguuuggagaaaacuggauuugagcuaaaucuugaaugagaauaggauuuuuaccagcagagagagagcuguugaggguagggagcaacacaagccaaacacagcagagaaauaaguuaaagcaucaaaauuuaaaacaaauacagagugauuuuauuuaaucuugagauuucuuguuuuaaaaauucuuaaagcagucuguuucuacuguccagccuccuauauaaucagaugcuuaauucagaauuccagcauucauugguuuuucagguaacuuaaacaucucacaagaaugugaaugugauuauacagaauuuuuccaauguaccuacaguauaucuaucaguaaucgaguauuuugaagauggaaaaaaaucauuuuuauguuaucugaaaaggaugaaagagagaagccaaguaguauaauacucuuauuuugcuguaauguuugcccuuauuaaaaagcugacagguuaaucuauuauuauauuuuuccccucugagguaaguuaaauauaaaauauuuuguuaguaaugauaauaucuguaauuuauuacugagugcuuucuguguaccaaauguuuuguugggugccuuaaguacauuaucuuauuugguccuuaaagcagcucuguaaacuuguaacuuauuuuauaaaaaagcaaacugaggcuuagagaaauuaagcuaacauaacuagacuagagagugacaaguuaacauaacuagagagugacaaguuaacuaguuaacauaacuagagaguaacauuaacauaacuagagagugacaagguguggauuugaacuuaucugacuuuaaaaccuggaauacuucuaauauaguuaccguaccauuucuacuuuuaauguacaauugugaggauuaaaauaugauguacagauuuagaaucucuuuuacaaaguacaguuguauguuauuuucaaaaaaaaacuuuuccgagccuuuuuauagccuggauauccucauuucucuugagaaugcauuaaauaaaacuaaaauccuucagccuuaacaaaaugguuuucaaaugggaaaguauuuuuaggaaugaaauccuuauauaaaaauuuuaugcaaaauuuaaauaaaagaaaaaagaguuccucuguuaaacaugcucaauauauucucuaaaacaaacccauuaauuucuggggaacauagugugaaaaucauuauacuuacuacuuccauuaugugugaaaaucauuauacucacuacuuccauuauguguccuuuguuuuuuuauuuuuuuugagacagagucuugcucuguugcccaggcuggagugcaguggcgcgaucucggcucacugcaagcaccgccucccagguucaugccauucuccugccucagccucccgaguagcugggacuacaggugcccgucaccacgccaggcuaauuuuuuguauuuuuaguagagaugggguuucaccauguuugccaggcuggucucuaucuccugaccucgugaucugucugccucagccucccaaagugcugggauuacaggcgugagccaccgugccuggccuauguguccuuucauauaaaugaaugaaguguuaucauucaagauuaguuauuuccacuuucugcguagcgaugaauggguaauaccacucaaagccaugaguagaccgcucuuaccuacucuucaguuuguuagguaggaaagaacuaaauuuccauuagacauuuuaaguuguuaaauugaaaaaagcaucuuaagaguaucucuaaauuuuugaaacagguaauuguuguuuuuuuacaaacucuaguguacucaaugcacuuaagcaucuaaagauaauucauuugucagaacuuauucauaguauacuuuuuuuuuuggcuuggaauauuggucuggcucccuuugugauagcuauuuauauauuucuuuauuugaagccauauuuagaauuuucuuucauagagggauuauuuuuuuaauuauuuaaauguauguaguccaugauaaauauaugugcaauuucuuuacacccuugaguuuggaucauaucaaguuuuaucauuauugucaugauaugauaauucaauuauauuaccuuuaauuuagcuccaaaauauuuuuacucagauguaaauaauauucuaauuuuaaaaaauauuuuucucacuauuuaaauuauuguagguaugagugaaaguucauuuuuaucaaaacguccuucuacuucugaaguaaauaauguuaauccaaagaagccuaaacccagcgaaaguguuucuggagcaaauuccucagcuguauuaccuucaguuaaaucuccuucagugacuucuucccaggcuaugcuagcaaaagguaaauaugaaaugugguacauaaaaagaaguuauaguauuuauacauacauuuuugaaguggcuauaaauuuuaaaaguauuauuagugguuauuuaagguuaaaaagugaugaauuuugagucauaaauguucugaauuuauuuuagguacaaauaccucaucaaaucagucuaaaaauggaacaccuuuuccaagagcuuguccaaagugcaacauucauuucaaucuuuuggauccuuugaaaaaucacaugaagguaaaacucuuucaaaauuuaauuuguaaaaaguuugcacauuucuaaaaauacugaugauuacaguaauuaaugguuuguccagaaauaaucucauugguauuuccauuuaauuuaaauaaaaauuuacauucauaaugauuauauagauucucaaauuccuucuaaauccucaaauuuuaaaacuuaaauuuguauauauuauaauguaugcuuauuguauuuuaauuuuaaauaaaaauaauguauuaauccgauuauuuuauuuauuaggucauacucuucaaaugucuuauaaaacaggcauuuuauuacguauuuacuuuugcauauaaguuaaaaauuccguuaccuuauuuuuguguccauguuaacauguacaugucacauuacacaaugaaaaucugaguuuuacauuuuaguuuuuaacacucagguauaaacuccaaauguugaagcauuucauaugaaauaauuguuuuaacucaguccagaauauaguucauauaauuguguaaauuaauuugagcuuuuuuuuuuuuuuuuuuuuugagacggagucucgcucugucacccaugcuggagugcaguggcagaucucuggggacugcaagcuccaccucccagguucacgccauucuccugccucagccucccaaguagcugggacuacaggcgcccgccaccacgcccggcuaauuuuuguauuuuuaguagagaugggguuucaucguguuagccaggauggucucgaucuccugaccucgugauccgcccgccucaaccuccuaaagugcugggauuacagaauuugagcuuuuuauugguacaagaagccccugaauuuagguuuuaagaaauguucaaaguacuagugaaguaugagauuuagguaacauuuaaaguauuuuaguagauauuauaguauccugcuguguuuguguagagauggucuguacuccccuugcaugcccaguauaaaugacaggaagggagaaaagagaucagaaaaaaggcaguguagauuauauaaggaaaagaaggaaggagaggggugcaauggcaaagaaguaacuuaggaaaaguuuuugcuguuucagagauugacauauuuuuauugaaauucagcauuuuacaaaaaagguagaaaaaauaagggaacuuaaaaaaguuauaaauacagucuucuuauauacguacagagccauauuuggucuguccuuacucucagaguauagcccuggauaacugcacguuguguuuuggucuuauaggagaauuauccuguagaaguacuuucaauuuuccucuucuguguaauguuuugaugagauuucugauguuuuuuguguuuugcauuauagaugaagaaaacaaagacuacauucuuuaucuguuuaauuuuuuaaguagguagcaauacagucacaugauucaaaauuaaaaagccugcaaagauauacaugugaagaaucuuaucucugugucuuuuuuuaccugguuccuaguaugacucaaagaaaauaauuuuuuauuaguuuguuuugaaugcucccuggguuucuuucuggauguacaaguaaacaugaguguucuuauuuucuauuuuguacagaaauuguggcauguuauauauaucucugcaucuggagagaauggcaacauucuccaaaauguggcuuuuauguguuacuucaugguuuguaauuacuuacaguagaaacaaccagaacuucauagaauuuucauauuaauauaauagaacauuaugacauuuuaaauaaggaaaguaucucugucauuguaagaaauuguauuucuuacaacugaacuaaguugaagauaauaugaacaguguauguguuuauaucauaaggaaaucuugaaagaauagucuccaaaucuaggaagggaaaguuuaaaucuguggggacuuuuuauuuucuaguuuauauauuuuuauguaucagcuaaaguuuuaguguuauaauaacuuucauuuugaaaagaaugugauuuuuacauuauuugugaaugauuuuuuugccaacuagcauauaauguuuucuuucaauggaaaaauauuuaaaauaucaaauauucuacaauaauuagaaaaauauacuuaucugagacuaugugucagacacaguacuaagcuuuaaauacauuauuucauuaauccuuagaaaauucuuuaagauuauuuuuucucauuguuguauaaccaauuaacuggcguaacuagcuuucaaaacucaguuucuuuaaugguaaagcccaaguuuucacaaauccuuuuuguuuuguaaaguauaggggguauucaauauuauguggaagauugaaaauagguauauuacuucuccuuugggguauggaauucgauauuuaucaaccaaauauagcuuauuaauuauauuuauauuucugugucuucacuuccauuuaguccacuugaucuguccuggauugggaaacaccacauuucaguccacagcuuucauuaccaguauuuucuuucauauauugcaauuuuguuucaaaguuguugcuguuguuuaugauauagaagaaucuagcuuuuauaacuauauuaugaggccgggagucauggcucacaccuguaaucccagcacuuugggaggccgaggccagcagaucaccugaggucaggaguucgagaccagccuggccaacauagugaaaccccaucucuacuaaaaauacaagaacuuagccaggcauggugacacacgccuguagucccacugcuugggaggcugaggcgagagaaucgcuugaaccugggaggcggagguugcagugagccgagauggcaccacugcccuccagccuggguaacagagugagacugucucaaaaauaaaauaaauaacuguauugugaauguauccuuuagcauuuuaauaaaauauccuuuucuugguuuuaaugguuagugccuuuuagcccaaauucuacuuugauguuagacucacaaccccuguuaugguuuccauuuaccugguguauucuuuguuuagucuuuuauuuucaacucuucugaauuacuuuguuuuaggugugccuuuugcuuuuagcaaaguugauuuuucuuuugugauccuauaugaaaaucucuucuuuuaauaguggguuuagauuuaccaauaugauagauuuauuuggucuuaguucuguuaaaauuuuucuuucucucuuuuuuaaaagccuuucacaaugugguugcuuuauguguguguagcuuagguuucuaagagaguuguaguuuuguucuccugauuauguuucuaauuuuaauguauaacuccacuagucuucuauuccuuuagcaauucucuacuguucuuuucuaugaggaaggauuaaaguagcaugaaacuuccuguuuuuaacccacccaucuuucccuucuuuuuugcuacuugauuuuagucaauauugucugagcauuuguuuaccuuugcugucaaaaugucuauaccuauauuacuuuauuugguggcucuaacugauauuccuuuaugaacugugaggcaaucuaugaacucuucaccuuguacucuuuguccuuuuauccucucccaauuuuuauuuguucauuguauuguuuuuccauugucagggcauaugacauuacauuuuuguuuguuuuguuuuguuuuguuuuguuuuuuuaccuuaugucauauuuguuuugaucuuuuucuacaguaaauauaauccacuguucaucaucaguguuuuugucaugguuuauuucguuuucuguuuggcugaaguucauucuguaguaauuucauuuaggaggagucugaaaacaucuuucugugaggucguucauguucaaagcaauuugacuguaguccauucuguaaagacaguuugaucuaauauaaaguaaauugaaucccacuaucaggauuuuguugguauagcucccguuuucuaguauucaguguugcuuuugaggaaucugggacaagcugaauuauuuugccuuuuauaagugguuugaucuucuuguuuggcagucuguagcuuuuugguugucuacauucuuuauguuuugaagacugauaauuuuauaaugauauaacuugguguugggaauuuugggugaguccucucuggcauacaccuuguucuuucaaccuguauauuuggauuuagcacaguuuauuugaauuguauuuuaaaauauuuauuccauacaauuucaucuccaauaugaauuuguuuuaucuucuuucccugacauaugucuuuuuuuuucuaauccuuaauuuuuuuaaauggacuuuucuccuacuaauauguuuccuuuauuuuauuugcaaugucuacucaccacuguauuccuuccuaauuugucuucaugucucugauuuuauuuuuuuccaauacuuucacccuugcaaugucuacucaccacuguauuccuuccuaauuugucuucaugucucugauuuuauuuuuuuccuauacuuucacccuugauuuugccacucuuuuuuuuccuucuaaauaucuuguugucuuggcaucuuuucuugcuuuguggucuuccaaauagaggcaguugcuucauuauguuuuuaaaauuuguggcuacuguuuucaucugcaacugcuccacggcagcauaauucugauguuuuuguuagaauuuuacauuuuucuguuauuugccuucuuuuauuacaugguauuuuuguuuagaugugagugccuauaguguuuaacaaguuggauuuucuugggccagcuguuuuauacaaguuccuuuuaggaggaagcauagguugccaggauagucucacagcuugcuagcugguuuaaacagcuuuuugcugggcagaaggcuuccugcaauugugacuugugugucugauucuuuauguagcaccgccuuucugcuucucuguacugaaucaggucugggguacuucugcugccauccuucuugccucagcuucugcaccuguuuuugcaaacagaggauauacccuugugauucagaauauguguuucaccuuuaagauguguauuuuuacugacccuuuaagaucuguuaccacuggguccccuuuacuucucugguuuacuucuagcuaaaugccaucugcccgauguuggcuucuuugaauagugcuuucguauauuauggagucuguggcuuuuaucugacccuuaguuucaaugauaaaccaauuuguggaauuugguuguguagcuuuuggaugacucucaggaggaaaagaggaaaauguugacugauguuggauguucacaugagaagcccuauuuaacuauaaaaauaggaucucaccuccuuugcucugaaaaacccaccuaaauuuuuagggcacuaacaaagcaacagaacauggucuguguacugggaggaguaaagauaagaaugauagauagauggugccugauauuugucaaacuauaguauauggcauuaaaguacauauuuaauauuugcagaaucuuuaacccacaaaaauaagggauaaauaaggaguugcagugaagaucuauuaauaaaacuaaaagguaccagggcugaauaaaagaugaccaguugauauuguaccacagcucagcuaugccccuccguagcuugcucuauccuccuauaaaaccuuaaaucuaagcuugguucucaucucuuaaggugcuuauuuguuuuuuuggauaagcaaggauacuuugccguucucaaugacuaaauccuucacccuaauucacuacaaguuguuguccauuuuugguugucaaugguuuauuauucagcucuuuuauagagauaugaaacauuguuuaaaagguacucugugaacaaaguuuauauguuuauuuaaaaaaucugauccuauccuacuuuucuguuaaaaaaauagaaaaacagcaaguaauuuaucaucuauuauggguaucauaauuuauagcuauuuuaggguaaucuuuaauguucauagacuaacuuugcaauguuauuugauaauuuuacauuugggacagaagauuauccacauuucuaauuaaggagccuauucuauauuauauaauuuuuguauauuuuaauuuuuccucaaccaggcuuuaugaaauuuuauauaucacuugauaauuaaauauauacaucaaggcauauaaacauuuccuuucuauacaucuugacguggacaugagaugaaugauuuuuaguuaaggaacagauuauuauuaaauauuuacaucuaaaaaggcaaauugcaaggguaaagcuguuagagcuauggccaugucuugguuuuaggguuucucaaaucuuuuugaauuuuuacaugaagauaauagguguuuauuauuugaauuuuuagacuauguacaugcaccacaaauuuuuggugacuauuuuucuagauauauuacaagcauaguuuuaauggucuggccuuagguguaaacacacaaucacuuuuugguaugugguuuuuuuaaagaauaaguaaggcuuguuuuuuuuuuuuuuuuuucucuuucaguauuguuguccagacaugauaaauaacuuuuugggacuggcuaaaacagaauuuucaaguacaguaaauaaaaacacaacuauugauucagagaaaggaaaauugaucauguuaguuaaugacuuuuauuauggaaaacaugaaggagauguccaggaggaacagaagacucacacaaccuuuaaaugcuucaguugcuugaaaauucuaaaaaauaacauuagguauguaaauacuuguuuuuauuucuauugaaaauugaaaugcugcaaauaaaaauguuauacuuuuauuuuguguuuucuaugccauucuagguaagugauuuuaacacuuucuacugagaauaaaggcggauucucuuguugaaaagcucuguccuuucuuguguuguggaguuugacucuuggauccaguuaguuauauuucuuucacauagcuuaagaaaagacuguuuauuuuaacuuaagacaaaaugaacuucuuuuuucuguuuuagucgugauuuuugaauuuuuauuagacauuuuuuauuuucuaauugccuuugaauuuuauauuucuucacauuacaagaagaaccacucuguguuuguucagguugagcuccucuauguaaugcucaaauuuuucaauuuauauuuauaguuuuuagaacauuaaucuugcaggaaaaauuaucaguuuuagagauguaucaguucuaggaagcaugucuguuuugauuuuaaaauuuaacagcuuuagaaauuuggggauuuaauucccaguggaauauaugaaugcuuuaaauauuagaaauuuguacuucauaaucguucaguuguaaucuuugaaacuauucuguauaaauuaguaacaagagaaaaguaauaagaaauugagugaaauuauuuguugauuauguagccugauauuuauauuagauaagguuuuuuccuaucacuuuacuauaaaaauuuucagauauuaagcagaguuuugaaaauuucacauuggacccuuguacacuuaaccaccuugauucuaccauuaacauuuuacuauacuugcuuuauuauguaucucuucauccuucuuagaacuaucugauuuuuggugcauuucaagguaaucugcauuguguuugugcauguguguacagcauauacauauauguaugccuuuuguguuuauucuugguaacugucaucuguaauuagcauuucaaagcagcuguaguuacuucugaguucagcauuuauuuguuuuccugugaguccuuggguccaaaaagaagcauacauaaaaauccugaaauacacugugauauacaccuauaacaguuauuaaugguuucuuuaugauagugcuuuauaauuuucaaaguuuuuucacuuauuuuauaugaauuuucuuauuucuuuaccuccucuuaucaaacuuuaagggccaucaauagcuaaugguugcaguaguuuaacaaaagggaaaguguauuuugagauaaaacguugaaacaguguugcaguagaacucuaccaccuauuucugaugucaugccaacaucgggaaaucauguuaguaaauaugguaaaaugcagagcagugugguucauugacuuaaugucuuguacugaaauaugagguuauguuauuucagcaguauuuuuuuggccuuuccuuuaagauuagcccauuuaauagcaaacaugaaaauggggcugggcauggugguucacgccuguaaucccagcacuuugggaggcugaggcaggaugaucgcuuuagcaaaggaguuccagaccagccuggagaacacagugaaaccucaucucuacaaaaaauacaaaaguuugccgggcguggugacgugcaccuguagucccagcuacuuguggggcugaggugggaggaucgcuugagucugggagauugaggcagcagugagcuguaaucaugcgucugcacuccagccugggcaacagaacgagauggucucaaaauaaaaagaaaaugaaaaauucauuuuuuugguuauguuuaugaagacuagcuacguauguuuaggcuuucauaauauuuacagauuuuaagaaaauuauaucugauaauauccaggaauugaguauuuuuaaaaauacugaucauuuauuaaauguaaccuuaaugguaaacaccucgugaacaaagaaguuaaauguauuauauaauauuuuacuucaacaguaaaaacugggaaggcaacuugauauuuauagagaauaauaagaaauugauagcucaacauuucauuucucuucucugccaugucaauauauugugguauggaguuucuuuccuacauugagugucacuaaaaauaguuagauuuaucuuguucugugaacauccuugcaagagguuuugcuguuucccucauuucuauugguuugagaaguaugaguugaugggaacucauauaauaauugggaaaaagcgaauugguuaagggaacauuuuauguuaauagacuuuaagugcugaaagcugugagcugaaaguuuaauggcucaugaucuuuacucuaaacguaaauauuuaacaacgaccaggauuuuuuguaagcauuuguagagcuguuguuaaaaccaaaggaggaaaagauauuucaagguguaccauagcccacucuaaagagaauagugcuguaaauuugugaaaagagguauauauuauaaucuucaugaugauugcuaucuagauugaugacauuaucacuuaguuucaagauaauuucuuuuagggauucaaagugaauaauuguuaacaguugaccuagucuaaaaauuauuguuuuuguugaauaacuuuacucucaaauucagcaaaaagcuuuaguaagcucuuuuaaauguauuaccauuuauauugcacccucugccauugaaggucauaauuccugcucauagaagccuauuagggaagcugaaguagcagaauguaaaacugaaaaauguauguugccuacaaagggcacugucugcaaguuaagaugaacagucugugcuaacaguaaaccaguaucauuaaauaaaacaaaagguucuuguaauuguaggcaucaaaacugcuauuacaugcauuuagaaaccaagauacaaguaaaaauacuaguaauuugucauuuaaguagcuggaaucuauuguauauuuucaaggccuuaaaagauuuccuccugacucuguagcugccuuuggugauaggguuuccuuuauuuuaguguuuuauuuuaaaauguaaauaggauuccaaguauggauauagaguuuccuuucuuuuaguauuuaauuuuaaaauguaaauaggauuucaaguauggaucagaagccuguucuuuuaucuaaaaaaauuuuuuaaauaaucugaaauaaugauuaagaguuauaucaaauuguugaucuuucagauuaauuacaugaaugaauuauuuuaaagcaaagguaaaaagauguuuacuuagccacuuaaagaaagugauuauuuaaaagugcauacuuuccuaggcaacuuuaagacuuuugagaguuugaguaauacaucuauauuuuuaagauuuagguucagauucuuguuugugagauuuccuuuuuguuuuuaaaucucaaguuuugcaccuguugacaaccauuuauagguuuaugaaccacaugaaacaccauuuggaacuugagaagcagagcagugagagcugggaaaaccauaccaccugccagcacugcuaccgucaguuucccacaccauuucaguugcagugucacaucgaaaguacacauacgccccaugaauuuucuaguaaguuaccaauacauuuaaauauuccauauuauugauuucgcuaauauaaauugugagaaaaccuuaagaagccuguuagaaaaaugagaaugagaacuagacuuuggaauuugagggcaaaauugaaaggccaaguuuuaacugugauaaacuuuuaaauaaaauuaguuacuaauauuaaagugccucuugcaaauaauucaguaugguaauugccuugacauaaacuaugcauuauauguuggggacuaaauuaggagccuaguauccuaguuuuaaaauauuaaaucauugcucuucauuuaaacuuuaauaggaaaaagaacuacuguuuuaguuaaaaaucacaggcggggugcaguggcucaugccuguaaucccagucagcacuuugggaggccaaugugggcagaucacuugaggccaggaguuugagaccagccuggccaacauggcaaaaccccgucucuacuaaaaauacaaaaauuagccgggcaugguggugcaugccuguaaucccagcuccuugggaagcugaggcaggagaaucacuugaacccaggaaacggagguugcaguaagccgagauugcgccauugcacuccagccugggugacagagcaagauacugucuccaaaaaaaaaaaaaaaaagaaagaaaauuacagauguuggagcaagauagcuugguuuuaaaucucagaucugccucuuaauauagcuacaagauuuuagccacguuacuuaauacuugaauaaugcggauaacagaaauaccuuucuuauaggguuguuaauaggaguugaguuaauguaggugagguaaugugagugcuuagaacuguucuuugcacauaguuaacaagcuguuuaacucuucacaacugucccuacugcuacuguuauuguuguugauauagauguauaaaauuaauuuuuauauuaauaucuuaaauauuauuauacuguuucucucccacauuuagcuauuuguaaaaucugugaauugucauuugaaacagaacauguucuuuuacaacauaugaaggacaaucauaaaccuggugaaaugccauaugucugccagguacacauacauuuuauuguuuuuuuaaguguuugguuuguuuguuguuuugguuauaaaauuuaagccuauuagaccagcggucagcaaacuuaugcauaacuuggcauaacuuaugcauuauaugagggauaggcagcaagcuggguuugguccacaggcuuuuguuugcuuaucucuguacuggacaaagaugaguccuguuguauguagaaaaacaaacauauggacuuacugugcuacauagggaagaauguagucauacaagggaaauacaaagugcuguuagauacaaagaacccuaccaaaugcuuuggcaaaaguauuuuuccaaagaagaagaauuugaaggaagaggaaagcaaggaaaagauaaauugccauugccauaaaccuggaggccauuaacaaucuaaaggagaaugcuguuucauguagcagaaaaacauuuuauagagcaagaggugcuaaagcuugaaacuucaagucaagacagaaggugauagauaaaaagaucugauaaagagaaggagaucuaguuuuguuuugggauguaucccuuaacuuugaaagcuacguuuaaugucucaaagauggucuuuugguguugccuuagugagauucuugguugcaaaggcaucagagcuagauuaguaguacauaauguucuccugacaaauuauccaucauuguuccuuuguaauugcauaucaguuuuaaauuuucaaguuaaacuaagccuucuuucuuuuuuuagguuuguaauuauagaucaucaucauuuucugauguagaaacucauuuuagaacaucccaugaaaacacuaagaacuugcuaugcccguuuugccucaaaguuauuaaaauugcaacaccauauaugcaucauuauaugaagcaucaggugagauuuaccaguucuuauuuguuuauuauguugucuuagugaaaaaacugauuaugacuuggagaaucuuuagauuuguucugcaagagaagcagaguuguuccaaaugacacuauuaauuuacacuucaaguugaauugcuugugaaaauuccacuucuuuuccuuacuuccuuucuggugauggugugggucauaaauaaugaaaauucugaaagauagcuagaaauaggaagcugaggauugacagaaaaagaaaaaguugaguggaauauccaaaagauugaauauuucagggucuaaagguagauaugagaaugauuuugaagggaguuaucaggacaaagggaauaaugaguuugaacugaggaagaaaagacugaggauuuauaaucuuauuuuucguuuugcucuucaaacuuuauuucaacuuucuaaccccuuaucauuaugagaagacauguugucauugaccuggaguugucuuuuauaguugugugaccaugggaauaguaaugacacuuacugaucaguauaugaacucuggcagagaacuauauuuagaucaucacuuguucccuggauggcuuccaccaguuuugcuauauaauuuuggaacucaauauuagugcuuguaccccucccuugaauucugauauuaugcuuauuggcucuuuuccugaagcaauuaaaccaucuuuuauuugggcuaaaaauuuugaugcaauacuaauccuguucuugcgugcuugaaagaacaacagugccuuugccaaaauuagaaaccaauggauuuaccgaaucugaucauguaaucaaauuuugucaacucacuacaaagcucaauacauucucuuauuauugauuaaauugacaugccaauuuauucagcauuggugcucacuuugcugucauuuucaguuguuaguuaagucaugaaauugacuugcuguuuuuaauuggagaagaucaugaaaguagaauuuccagaucaauuugggaucauauguguugugacuaggaugccacacauccuugagaguuucuggcaagaucuauucuaagguuuccccaauuacauauaguaaauuacauauaguaagaauuaccuguaaaucucucaagucucccaaacaauguaguauacuuauaaaaaauuuaauacagauauuuauuuauucuuggaauagaucacuguuuguuuuguugaacauaguguuauaaaaaaaaaaaaguaucuucaucacccuuagugcauuucuuuaugaacagaauuugggaaacacuauucuugauaccccguauuucaucuuuggacuuuaauuuugaaagggagaaugagguauaaagcaguagcucuaguucacgaugggguuuuuaaacauaaucuuucccaggugcuuugucaaacuauagagugagauagagaugugggaagaauaguaacuaugguagagauuuggggaccugcuaugugccugugugauuuauaagcaaguugucaugcccugaguuguauguuuuaacuugccauggcugccaauuuucuuuuuuguuuggagugccugggagguagauagccagcaguaaagagggggcagucuauuaguaaggaucauugggcaucuuugaagguauuuacaauuuguguaaugauuuacaagacuggaaaaccauagcugagugggauuauaaacuuguaguugagauaacauuauuaccaaaguauuagacaaucagaauaguugacuccaugccucauuuuauugucuuugaagaacucaguuguaacuuuuuuuaaagauuauauuauuaugucuuuagugauuuuagaguuaauaacccaguuugugugacuuuuaagaaauauugauagaaauuccagauguguuaaauaugcucauuagagcuuuaauaaaacaagcaguuaacauacacuaauuacuuaccuuauggcagcagcugguacuuuacaugcauuuucuuguuuaauccucucaaccacuagauguauauuauuauuucaguuuuauagaugaggaaacagagcuuuagagaaaguaacuugccuaaugucacauugucuaauaaaggcagagucaaaauuugacuuagcauccaagcuuuuacugcucuaccagaguuggauuucacauuggcauugggucuaaagguagaaauuacauauaguaagaauuaccuguaaaucucucaagucucccaaacaauauaguauacuuauaaaaaauuuaauacagauauuuauuuauucuuggaauagaucacuguuucuuuuguugaacauaauguuauaaaaaaaaaguaucuucaucacccuuagugcauugagaugcaugcauacauaaaagagauguguaagacuugaguccaacuaaggaacugguagauuaauguauucuaccuuaggacucugggcaaauguucauugaaugaaaaggcagauauuuugaacuaaauuguacaugcuacucacaugcauuuucucuguuaaucucuugcuuucugccucacuauucauuuaagaaauauuuacugagugccuuaguaugugcuaggggcugcuuuagguaucauauagcauugaacaaaaccaaguuugugcccucuggaauuuacauuauaguagagaaagauaauauauuuguguauguguguguuagaauguauaugcuggcaauaaguacugugggagaaaauguggaagaugaggagugcuaaagauuggggaggugguaggaguacaggaguggucaaaaaaggacguuguauaaagaauguucaaacaugggccucucugaaggauauaaaggaguaagccaugugaauuaccucggagaggugacauuauauaggcagugaggugaguguauaccugggaugcucaaagaauagcaaggaggccaguguggcuggagcagaguaaauuaauaggaggaagaauaauaggagaugagguuauagcaauagaaugcaggccaauucauguggagcuuuguaagccacagccaagacuuuggaaaggcacuagacauuuuuaagcauauaaaaagaugugccauguuuuuauuacuggcagcuauggaaagaaaaguccauagagaagaaaggauauuagggggagaagauagaaaguuuuuauaguaguccagguaaguggcuugggccaguaugguagcaaucguugaacgagguaaugagaaguggaaagauuaugaaugguuuugaaguuagagcugagagguuuuacuaauguguuugacaguagauguaagagaaagagauuaaauuuuuugucuugagcaguugcaagaauggaguuuucauauacugagauauggggaagacugaauaaggaacagauuuuuuuuuguaggagggggacagggauauaggaaggaaaucucgaguucaauuuuguucagguugauuugagaagcguauuagacaucaagcaguaauguuacguaggcauuuggauagaugguauuuaaaaaccaugaaacuggaugauguaaccuacugagugguuauagauagagaaaagauuucugggaacucaacucuggugaacuuuuuaccugcuguauuguuuugguaucuauuuuuugguuuuucucuucuuccuugagcacauauaagugaauuuguuuaaauugccuguaccugugauguaauccaauguaucacacuuguaaaauagucuuaagagccuaggaggucaaggcuguagugagccaagacugcaccacagcauuccagccuggaugacagagugagaccuuguguuaagaaaaaaaaaacuuaagauccagcuauuaauagaauuguaacacauauuuauauauugcuuugaauuuuauaaagaacuuucauuuaugaagugcuugcuguaugccaguaacugugcuagguacuuccuuauauauuacuucacuugauuuuuauaaauaauugguugugccaaaaacaaacaaacaaacaaacacacacaaaaaaaaccacacacacaaaacuucaggccaauauccuugaugaaccucgaugcaaaaaucuucaccaaaauacuggcaaacugaauccagcagcacaucaaaaaguuuauucaccaugaucaaguaggcuuuaucccuagguuggaagguugguucgacauaugcaaaucaauaaaugugacucaucacaaacagaacuaaagacaaaaaucgcaugauuaucucaauagaugcagaaaaggcuuuugauaaaagucaguaucucuucauguuaaaaacucucaauaaacuagguacugagggaacauaccucaaaauaauaagagccauauaugacaaacccacagccaguaucauacugaaugggcaaaagcuggaagcauuccccuugaaaaccagcacaagacaaggaugcccucucucaccacuccuauucaacauaguacuggaaguucuggccagggcaaucaggcaaaagaaagaaacaaugcacauucaaauaggaagagaggaagucaaacuaucuuuguuugcugaugacaugauccuauaucuagaaaccccaucaucucagcccaaaagcuucuuaagcugauaagcaacuucagcaaagucccaagguacaaagucaaugugcaaaaaucacuagcuuuucuauauaccaauaacaggcaagccaagaaccaaaucaugaaugaacuccccuucacaauggccagaaaaagaaugaaauaccuaggaauacaauuaacaagggaagugaaugaucucugcagugagaacuauuaaacagaucacugcucagagaaaucagagaugacacaaacaaauggaaaaacauuccaugcucauggauaggaagaaucaauaucaugaaaauggccauacugcccaaaguaauuuauagauucagugcuauucccauuaaacuaccauggacauucuucacaaaacuaggaaaagccauuuuaaaauucauauggaacgaaaaauagcccgaauagccaagucaauccuaagcaaaaagaacaaagcuggaggaaucacacuaccugauuucaaacuauacuacagggcuauaguaaccaaaacagcuugguacuggaacaagaacagaugcauagaacaauggaauaguauagagaacccagaaauaaaaccgcacaccuacaaccaucugaucuucgacaaaccugacaaaaacaagcuauggggaaaggauuccccuauucaauaaauggucauugggaaacuggcuggccauaggcagaaaacugaaacuggaccccuuccuuacaucauacaccaaaauuaacccaagauggauuaaagacuuaaauguaaaaccuaaaacuauaaaaacccuagaagaaaccuaggcaauaccauucaggacauaggcauaggcaaaggcaaagauuucaugaugaagacaccaaaagcaauugcaacaaaagcaaaaauugacacaugagaucuaauuaaagagcuucugcacagcaaaagaaacugucaacaaaguaagcagacaacuuacagaaugggagaaaauuuuugcaaacuaugcaucugacaaaggucuaauaucuacaucuauaaggaauuuaagcagauuuacaagaaagaaaccaaccccauuagaaagcgggcaaaggauauggacacgucucaaaagaagacauacaugcggccaacaaugauaugaaaaaaaacucaacaucacugaucauuagggaaugcaaaucaaaacuacagugagauaccaucucacaccugucagaauggcuauuauuaaaagauaaaaaaauaauagaugcuagcaagguuauggagcaaaggagugcuuuuauacuguuggugggaguguaaauuaaccauuguggaagagaguguggcaauuccuugaagaccuagagacagaaauagcauuccacccagcaaucccauugcuggguauauacccaaaagaauauaaaucguucuguuaagacauaugcacacauauguucuuuguagcacuauucacaauagcaaagacaugcaaucagccuagaugcccaucagugguggacuggaugaaaaaaaugugguacauauacaccauggaauacuaugcagccaaagaaaggaaugagaucauguccuuugcagggacauggauggagcuggaggccauuauccuuagcaaacuaaugcaggaacagaaaaauaccguguuuucucauuuauaagugggagcuaaaugaugagaacacaagacacauagaggggaacaacacauacuuaggccugccagagggcagagggugggaggagagagaggaucaggaaaaauaacuaaugaaugccugggugaugaaauaaucuguacaaaaaaccuccgggauacacguuuaccuguguaucaaaccugcacauccugcacauguucccugagcuuaaaaguuaauaaauaaauaaauaaacaguuguauuucaauggacauagugauguaucuggcagagauacagcuuuagauaaggcauuccuuuauaauuauauguuguauaauuaugugugugugcauguguauauauauauauauauguaaaacaacauauaacuacaaaagagugguuucucuaaaaccacuauauauauauauuauauauauauaauauauauauauaauauauauauuauauauauauaauauauauauauaauauauauauauaauauauauauaauauauauauaauauauauauauuauauauauauauaauauauauauauauaaaauauauauauauauaaaauaaugaggguaaaaauugcaguugauaaucuguaguagaaagaacacuggaucagggcccugguaaugucaguaacuagcuauggggaagugccuuagcauuuuuuugggucccauuucccaucuguagaauaaugacaggacuggguuugaggagggacucagucaagggguucucaguaaguucaguuguucuguuuuaugccucuucauccacauugucugauguaguagcuacuagccacauauggcuuuuuagauuuaaauuaauuaaaguuaaacaguauuaaaaauguaguuccuuagucacaguggccacauuucaggugcucaauaaccacauguggcuaguggcuacuguguuggacaauacagcucucaaauauuucauuaucauaggagauauuauuggacagcauugguuuauguaaccacuucuauaaaauaaccuucuuugaaaugucugguuagauuuauuugguuuuagagaguuuaauuuauuuuaccaacuuuucaaccaacuagaaauagcaaaaauuagaaauaauuuccuuuuucuaggauaaaaacguaguacaucucauuuucaaaguauguguuuacuucaaguuuauaaucgaaagagauuucucaccacaauuaauagaaguuuuauuagaaccuauugauagaacuuucauguacaguucuuacauaguagcgaacacuuuugaaacccaaauacuaauguaaugacuuuuaaaaaaugaggcauuuuauauuauuaugauaggagauguuaaaccgcaaguuuuuacauuauuuagguaucauuaaaauuaagucagcaguuucaggacacaggauuuguaguuuuugaaauuauuuuucccccuuuuucuguuuuuuucuaaacagaaaaaaggaauacaucguuguacaaaaugcaggcugcaguuuuugacaugcaaggagaaaauggaucauaagacucaacaccaucgaacauuuauaaaaccuaaacaacuagaaggauugccuccuggaacaaaagugaguuaaaauauauuguauuuuaacauuuuguaugauaauagaaauuaacuccugcccggcuuuauauauugaauguauuuuuaaaugacuucagauuuuugcucagacucuaauuuuagguuuuaauuuuauguguagaaggaaaaacuucuaaccauuguuuugaguucagugauagcuguuagguuagaguaguaguccuuuuuaaaaaguacaacucaauuaacuuuuccugggucaauggguuguuucaauauuuuauaggcuauuuuugagcuuucaguugaaaguguauauguugacuuuaguugcuaaacuauaagaugcuugagaucaggaaucauguuuuauuuaucuuuguguccccagcaucugguacagugccuugaguuccauaaguucucagauguuuguugcaguuguuauuacugaguuuacucugagaagcaaguucuacugcuggauagcauuguguuuuaagugagcaaacacaugucugacugcauacugaugauuguaauuuacuuuucccuuuuugccuuauguacaucuguuuucucugacuucuuuauauacagucagcucuugaauauuugcuccaguggagggaaacagaggcauggauaauccaaagugaauaauccccaaaacauuuauuuuuggcuuuggguacuuuccuuugaauguggguaugucuguuauuugaauuaacuaaaacaauauaaagccaugcucugaagacaugauagcaagagaagcuauccagcauccuucccugcaauccauucauuccauguugggacuagacaugcagaacacuaauguaagcagugcaguccucucucauuuuuucccuuauuaauaauaauaauauuaaugauaaugauacuaaauguuuuuauagcaccuuagaauuagacuuucaguguacuuuuucauacauucuguugucuaauucauaccacaauccacugagguuaauaaggcagguauugccccauguuauagaugugaagaagcauagagaggauaaguuccuuguucaaggucacauggcuaggaaggccuuuugauuccugguccagugccauuguauguuacccaagcacauguaugucauaggacuuccuuauugacuguuccucaaauaccggaggaggguauagucaaaugauuaaccagaauguugguaggcacuuguguuuuucauugucaaccaacagaugaaauuaaacauuuucucauucugaauacuaaaugaugaacuuuguauuaguuuacuuuaagaaauuucugaauauuauuuagcccucuaugcaguauaauaaauugauguaacuccucccauaacauuuguaagcauaaaucuugggcacugagccccuggaaagaggagaucacauuuacuguagaucuguuucuuuuauaguuguuaaaggguaauuuaggccuuucuagaauuauuuuucaggcuugagauuuaaauuuugagcucuaugcuugugaauuucuuaaaguuaagucagggcauaaaaauagcuauggaaugugcucuuuguauauucauauaauuuguauuaacuccuaauuauucacugauaacuguguuaacauauaacugauaucaauacaaaaauguaauauuacaacuuaauaucaaguuuaauaucauuuaauaguuugaacauuuagaauaaaugggagacuuaccugauuguaguuuauaugugcuuuuuucaaaauucuugauuuuuaacuauuuuuguaccaugauauuuuaauauuaauguacugauuaaucucuuaaagcaaaucuucucuuuauuuuuguagguuacuauucgagcuucaguuggaccucugcaaucaggagcuucaccuacaccuuccauuagugcaagugcuucuacccuucagcucucaccuccaaggacuaaaaauauaacugcuaaaaauccugcaaaaucuaauacaaguaaaccuaauacagucaaauccaacgcaaguaaaccuaauacaaguaagccuaauggaaguaaaucuaaauacaaaccaaaaaucucuaauaugcaaaagaaacaaagcacauuggcuaguagcaauaaaaaaaguaaagucaauacagcauugaggaauuuaagguaaucuuuuauuccugauauacaauauaauuuaaacuuaaguauaaaaacuuauacuuuaguuaagagaacauuauuaaggcucuuccuuauuauuuuuguuuuaaaauauauuuuuaucauuuuuuuaaugucucccuaagguaucgucggggcauucacaaaugcauugaguguuguuccgaaauaaaagauuuugcaaaccacuuuccuacguacguccacuguaguuuuugcagauacaacacuagcuguagcaaagccuauguaaaucauaugaugagguaagaugaauuaaauguguaaauugccaauuaaaauuauaguucagcaaguuucuguuucaaaaacaaaguuauccuauuagaagccaguuuuucucuucaaggagcuaaaaggaucuaacaauaaggaacuuuuaggauauugccugguccuauuucucagcauaguaacuagaaauuaugggacuaaaauuguaagaaaaauuaagcuaaugaaauuagaauagguuuguuaggguaauaguuuuucuuuuuuauuuuuuugagauggagucucgcucuguugcccaggcuggagugcaguggcaucagcucacugaaaccucugccucccaggaucaagcaauuccccugccuucgccuccugaguagcugggacaacaggugugagccaccaugccuggcuaguuuuuggauuuuuaguagagacaggguuucaccauguuggccaggcuggucucaaacugcugaccucaagugaucugcccgccuuggccucccaaagugcugggauuacaggcaugagccauugcacccggcugggaaauaguuuuuccauggaacuuuuuauugccccauugguguuucaauaaugguuacuuuccaacagaauuuuaaauuuuuaaauauauuuacuaaauaaauacuuguaaucucaugagcgucauccuccuuuuuuuuuuuuuuuuuugagacggagucucgcugugucgcccaggcuguaguggcgucauccucuuuaaagcagucacuuugagagacuuuaagauuuucaguggagucuguuucucuuucuguauuccaacugucuuuuuauccaucugucaggccaucuauacuugcauccauucagugaaaaugagacaccauuccaccaugaugccacuuuuggaauucuuuuucauuaauucauucaacuuagauuauuugaguacuuacuauuuacacuauguuaggaaaagccuucagagucugcauuauuuucauuuuuagaucucauuaggggaauacuuuauuccuucagaauggguuuguauuuuuuuuaaguaggcaaaaguuguuuagauauaaaccugagaguuugcuuuuucaaaguaaguuuguucaguuuuuguuuaaaauuagaauuaauguauuauaagugacuuucuugcagauuacacaugacuucucuguuacuugcuggucauuaucaacuacugcuuucaaggauucuucuaccuuuuuugguggcuucagcacuucucucgguuuucccaugucuucaugguuggccugaccucaugguaucuugcuucuuuagugccagcauuucacaucaacuuuuaaguucauauauugucuuuuuuuuucuugaaacuacaguacuauuuaaaucucuuccuauaaacuguucauuccuuuuggauuuccauuaccccaugauguucagagcuuugacuccuuuuuccagccuaguagcacccaucuuaauuuuguagucaaccuuacucucaggaucaucuguuuugauuguggcuuuuuguccuagaauccuuuacaucuuuagucaugcucacuggcauaaaggccaagguaagauuugaaccucuucucuuuugaacuuccucugugcucacuucuagacuaucaaaugguccuugauuuagucaacucugauuucaaaaacuuuaauucugauuaggucuuauuuuuuuaaaaaagaucucuuuauuuuuaccugcaacauuuguuuaauccuucuucaguacccuaaagauuuuauuuuaguuucucaguuguuaacuuggccuauuaauuagucaauuguaggucauccuuuuuauuuuuccuaaaauuaacucuuuucaaccccacguauuuuuccuguuaccuucaaucagacauuaaucuuaaaaaucuaacaugucucacuuccccauuaacuguccuuucucccccaguucaccaugaccauauucaguuaacuuggaucuucaucucuuucucucuauaugguuccuucugcuuacaaacauuuucagguauuuaaaaaauuuuuuggaagaggacaguuugucccaacugccuguuuuccuuauuucuugucuuccuuuuuaccauuaacauuuguaaaaaguguuugcuaccagcuuuauugugauucauuucuuuaccuuuugaguauugcccccaccuaccaacuaacauuccucuuuuaaagauuaucuguuaugaacauaucaccauauuuacucccuauuuuucauucuuacuccucugugacuucuuuagaguauuugacauuguugucacucacuuuuuaaaacuuaauuuguuuaauguuccugacagccaugugaaauuaauuaauuuaaaaauuuuuauagagacuacuucauauuuguggaguacaugugauauuuuguuacaagcauacaauauguaauaaacccagggauauccaucacuuccaauuuuaucauuucuucauuucuucuucuuuuucuuuuuuugugagauggggucucacucugucaccccagagugcuaggucuugcagucaaagcucacugcaaccucaaacuccuaggcugaagugauccuccuguguuagccuccugaguagccauauaggugugugccaccaugcccagcuacauuuaucauuucuuugugaugggaacauucaaaauauacucuucuaauuaguuugcaauauacaagaaauucuuguucauugucaucacacacagcucuuagugucauauggaacuaaaagcuuccauugccacucuuaggguuggguaggucuuuuugucuuuuucucaaccucagugguacccuugcuucccucauugcauuaggugcaucccacugaauggcgaacucuucucugcaguguugauucuuguuagaaguuugagguuuauauauacagaagccugauuuucuccaaagcaugagaaccuuuaauuccuaucccguacuaacucuguagccucucaauuggucuuuuucccuuuggucucauaccugccccaauccaucccuguaaguugguuaaucuuccacagaguauaguuucuuccauauuaauuuucuuucuuuuuuccuuuuuuuuuuuuuuuuuugagaaagggucucacuccaacccaggcuggagugcaguggcuccaucacaguucacuacagccucaaccuucugggcucaggugauccucccaccucagcgucuugaguagcugggacuuacaggcaugcacuaccaugcucagauaauuuuuuuuuuuuguagggaugggauuuuuuccauuuugcccaggcuggucaugggcuccugggcuuaagugaucugccuacucuagccucuuaaagugcaaugauuauagcugagcacccccucugcaccuggccccauguuuguuuucuacagugacuauucgguauuccuuguuaguucccagaauacccuguuccuuccucucaguuuaccuucuuuuuucaagugucugaucaccacagccguuacuuucuuugaauuguguacuauucaucuauuuugccuuuuuuuuuuuuuuuuuugagacagagucuugcucugucaccugucacccaggcuagagugcaguggcaagaucuuggcucacugcaaccuccaccucccagguucacgcaauucuccugccucagccucccaaguagcugugauuacaggugccgccaacaugcccagcuaauuuuuguauuuuuaguagagaugggcuuucaccauguuguccaggcuggucucaaacuccugaccucaguugauccacccgccuuggccucccaaagugcuggauuacaggcaugagccaccgugccuggcccuauuuugccuuuuauuguauuuauuuguguuuguauuaucuucuugagaagaagggggucuuuguauuuaucauaucaccuagcacauuacaaacugcaggugauagucauuauuuguuuuaauuauaaaagguccuaaauaaaaucucagaagaagguguucaaaaaucuugaagcaguuggaguauuguuggaguaagaucuuuucaaagaaaagcaucauuaaauguguaauuuuuaauuuuuuuuaagcagcauuuuuuagguucaguucuuuaaauuauuguaccuuauuggcuuauagcuuuuagguaguaauagaaauuaucugaaaaaaaugcacauaaauugcucuauaaucuugcuauuauuccucaaaaugauguauaagaagcauuuuucuuuacauaaaagagaauuaaguuaacauacauaagcaguaucucuuuuuuguagcagaguuuuauuauuucaaccagguucauguauuuuauuauguaccuacuaggaagguauuuaauacaauuugcuaagaaguauggcaagcugggggugaagaaucaaacaagucuggauuugaauccaaccuucacuguauacauguggaacuuugaacaaauuacuuaaucugacucucagauugcauuucuugaaaagaaaguuauugugacuuuuagaaaaacuguauuaaagugcuuaauaacaauuugcacuuaagagauauucaaguaaugauagcuauuaauuucuaaguugucauuauuaggauugggggaguuccugacuguaauuuucacaauuuagaaggggaaauaaauuuaccuagguuauugugauaaacaaaugacuaugaaaguacggaggagguaaagaugaaaucuuuaaacaagaaauaagggaagauuuucuguaaauuucacuuaggcuuugagggaugauuuuuaaaauuuccaaggaaaaagaaagcuaguauaaaaauuuguuucuuacacaguagguacgacagaguacugaauuuuaaaaaggucugcuugacuucauuauaaauuuuacagaaauuuauugacacuaaaugauaaucauaggacuaguuagacuauuaugucuucugccuacaguuuucccccuuuuuuccaguucauccuuucuuuugcuguaggcaaaucuggucaggucauucuuuggccuaaaauccuuuccuaacauugauagaaugaacuucagauuuucuggaaaauauaacaccuuuccauaucagauuccuaacuacuuuucaacuccuucaacuccuuuuauucucuugaaaauucuucuauaucuucacaguuacucuuugcuuugccuggaagugaagcaguaagagucuucuaacugcagugaacuccuaauuguuagcuggcuucuaccccaucugucuugcagcuuuccuucaugcaaccacaaacucuguaugugucacuauugacuuuuaucuuguguuaauuauuuaugaauauguauucauugauuuagcaaauauuuuuugggcauucauucugugccauccccuuucucccccaaacacuccccccaagcaaccauaaacucuagggcaggcagcuugccuuuguuguuguaucaucggccucuagucuaaugucuuaaaauuuuuaaggaaauuguuccuuuuauguuucuuagaaaguaagguuguuacuuauguggaaucaagauuaugaagaaaauaugauuagaggagguuuuugaccucaguuuucuugagguauaauuuauacacaauaaaauucaccuauuuuuagagaauugcuuaaugaguuuugauaauuauauacugucagcuaaucaaguaagggauuuuuuuaaaaaauuagguuuuaacauuauauuuuuacuauauuguaauaaaaaaccuuucuuagauuuauuucuauauugcuauuaccuuuauggagagcuaauaggaagaaggguaguauuuuuuuuuccuuuuuaugugugagcugugaauucacuuuucccuuccugugauacacaaaacuauaaguauggaauuaaauacagagaaaucaagcaggugguagaaaucccuuuuuauagaugagaaacucuaaaacaauucagguaaccaaaaauuuaaaauggucaacauuaugauaugguauaaguuguagacaaaugcagaggcuaucaaaagacccuauacuauaagauuuucucuccucuuauauuuaauagauaaauaaaccauaaauagccugcuuguuugaagagaaagaauaaagagcuuuuaaaucucguuuaaaaauaacuuauuuugguucacauguuuuaguaaucaaacaaaaucuuggacuuauuucucugaggaaauauaguuguguauacaaguuuuugcauauaauuucagggcuucccaacuucccaauguacucuucuaacaaaacuuuguuuuugugauaccaucuuaaauuuguaaacucuaauaguaauuacuccuagguugaagaaaugacuauuagaaaucugaggauauuuucuggggauuauagcuagugacacauacagagucugugauugcaugaaggaaagcugcagauaguuggguaggaauauauguauauauauauauuuuuuuuuuccuuuuuuucccuauacauacauguggugcuggggacaauuaccuuguaucugagaguaagcauugacccagguguguuggcugcuguuucuuaaacuuuagcgugugugugaaucacugaaaaugcuuguuaaagcaaauuccugagcuccucugcccuuuguagguugagggguugucacgggggaugggguuguuggugggggaagacuacauuuugaaauacaguagucccccuuaucugcugggguauauauuccaagaccccccagugaacgccugaaacuguggauaguauuacgcucuauguguacuauacuuuuuuuuuccuauacauacuauguauaauaaagguuuauuuauaaauuacacacaguaagauaauuaacaauagaacaauuauaauaacaauauacuguaauaaaaauuauaugaacguagucugucucucuuaaaauauguuauugugcuguauguguguaacagaagccacagaaagugaaaugugguuaacgguggugaggagggacaacuguaagcuguuaggugauauuuacacuuuuggucuaauacuggcuuucuaguacaggaaacuuuccuuacuggaauuaaaaaggguauauagaagcuauuaucaugggcuacaaaauuggguuaguuuucuuuucugugcuuagaggaaacauuguuuuaacucaugaguuccuuuuuuuuuuuuuuuuuuuuuuuaauaaaaaacacucuacuagaaagccaggcucgguggccucccucuguaguuucagcuacccaggagacugaggcagaaagaucacuugagcccaggaguuugauuccaacugggcaacauagugagauccaucucuuaagaagaaaaaaagucuacuaguaauuacaaggaacacuguaaauguuugaauuuacagaugguaaacaguggcauuuagcucaaguucuguuuacuucccagaucauuuggauccuaccccacucccccuacacaaacauguuaaaauuggagaguaauaaaaaagaauuacuauuaauaacuucauauuguagcacacguguuauuaacaaaaauuuagaauuguuuucaacucaguaaaucaaaauauguaauuugauguucuuuacauuuucuuaauucucaguauuuccuuuuuuaauauaaugguaagguacagugcuaaccaucuaagaauaugccuaggaaaauagugucauuagaauauaauagguaaaauggaauaucagauaaaauauugaauuaaauggaagugacaggcauuauuuuauuauuuacauuauaaucuuuuauuacaaacuagaaacuuaaguauggacuugaaauauaguuauaaauuaaugugacuuauuguauaauaaaauuuuuacuaucucuuuuguuucuccagcuuucauaguaaccguccaagcaaaagguuuuguauuuuuaagaagcauucagaaaaucuccgguaacuaguugaucuuuuuuuacucuuucuauugaaaaauuguaaugacuuaaauuuuuuuuaacacaacagcuuuauugagguagaauuagcauaccauacaauuuauguguuuauagguuuuaggauauucacagaguugugcagcaaucaccaguuaguuuugguacauuuuuaucacuccagaaagaaacccuguacccauuaguggucauucccauuucucuccagcucuucccaucccugaacaacaacuagucuacuuucugucuguguaauauuugcccauucuggacauuucauauaaaaaaugauacaugaugugguccucuguggcuucuuucauuuagcauaauguuuucaaaauucaucuauguuguagcauguaucaauauuucauuguuaaaaauugcugcaaaacccauuguaaagguacaucauaguuuauuuauuuagauuguuuucauuuugaggcccuuaugaauaauacuacugugaacaugugugugcauguuuuuguauggacauguauuuuuauuucucuuuaguauauacuuaugauuggaauugcuggucuguuugauaacuccaugcugagcguuugaggaagcaccagacuguuuuccaaaguagcuccacuauuuuacauucccaccagcaguguuugaggguuccaauuucuccacauauuugccaacacuuuuuauuaucucuuuuugauuauagucacccuaauggguauaaagugguaucucauugugguuugcuauaacuuuuuuuaaaccugauauuaggguaccuaauuugaaaauauaaaugauugcuacuggacauuagagaguuguguucauuguauucuuagaccagaaguaugauuagccauuguucucuugcugaauuuauuucaguggaaaggugguguccagaggaaaccuugaugcguuugcauuguaaaaugagaacaaaaauaaggcucgccaacaauauuugaauauuaaaaagauagcuaagcuaucucuuaaaggaaugaacacuuuuuuaguuuugaaguaaauuuccuuuaaccacuggaauucuugaaaucaguauaugauuuuuauaauucuaauauuuucuuuugaaaauaaagagaauuauacaauuuuacuauacugaaagaacuguugauaaaauuuucuaaaggcauugauaguuaucuuugguuauaccacacacuuagaauccacugagcgcuauuguuucauauucuucugauuucuugaacuuucuuuguuuauuuuauguugccauugcuccuugaaaugucagugucuuuguuccaccaagcugaucuguagagauaaguuuagcgaauacuuauuuugaugcuuuugauuaguggaaaauguagaagaggggaugguaugucucaagaccuuugcauuuauuauuuccuaugccuaguuugcuuucccccagauauuguaugguuagcucuuuugucuccuuuaggccucuacuuugauugagugagucuuuccuugacuacaaaauuuaaaacuguauccucuucccuuugcuuuaucccagcauucccuaucuccuguuuauguuuuacuuuucucuagaucaucuaacauacuuuuauuuuacuugcuuauugccuauguucucucacuauauugugugugguuugguuuuuuugucugugccuggcacauaguaggcacucaguaaauauuuguugaauaaauuaauguauauauugaaaaugauguacguggaaaauaggucccaucugugauguuagacuaguagcucacagggagagaaaauaucauucaauuuuuaaaauguuaguacuacuuuuaaaauauuuacugaaucuagggaaauaauuaagcuacauuagauguuaccuuuacuaaaaacaguuacaagagugaauaugguuuuauugcauucuaagaaugagaguuuaauucaauuuuuaccucauuguggucaagcucaguuguguguuuaguuucucaaugaacuaugugguuuuaaagaucugggauguuuuuucacuaaaccuggcuagucucaaauugaaaauuguucaauuucugugaauagagcuuagcauaguuauaauucuauaugacaaugauuaauguaauuauucuuauugaaauagacuauucauuccguaacuauuuauuacguaucugucuugcacauaaaguagcagguccuguaaagaugacagugaugaagcaguguuggaaccagccuucagggaauguacaguacaguuuauugggugggaguuaaggugugaacauaaauaacuaugcguuuuaauaagugcaaugagacuuauuucagagaggaaaaauauuacaguucuuguagugaucuggauagguauuaggccuacuuggcuuuaaaggauggguauuguuucuacugguagaagaggcacggggcauucuaguucaauagacuaaauuuuuuucaagaguucuguuuacaauucaaauuacuuuaggcaacuuaacaucauuuguacauuuaauauaauugauuuucuuuuaaauagcacuucaaaugcuugguguaaccaacucccaagugcuuaacucuuauaagaaauuaaauauauaguggcuaaguuaucugaagcauuuuaguauuuuuacaggcuuaauauuuuaaaacaccuuucagcuaaaaaucacacaagucuaaaugcauuuuaaguuagaaucuuaauguacuuuaugucaaguguauucaaauacuucaaauagcaaaugcuaaacaguuagauccagugaggacaaaaacucuuccuguacucaaaaauaaaguauugauaacuagggaauuguuuccuaaccucuuuaaacauuuauaauaauuacacauuucauuuaagaacuacagcacucaggccgggcgcaguggcucacgccuguaaucccagcacugggaggccgagguggggcugaucacaaggucaggaguucgagaccagccugaccaacauggugaaaccccgucucuaguaaaaauacaaaaauuagccaggugugguagcaugagccuguagucccagcuacucaggggccugaggcaggagaaucgcuugaacccaggagguggagguugcagugagcugagaucacgccacugcacucccgccugggugacagagugagacucccuaguucacagugcugagaugaugaggaacucaaguuugcagauuuuaguauuuuauuaacuacuuuagcuaguucaguguuaaguaagaauaauaccaaccuugaugguuguagugagaaucagaugaaauaauaaaugggaaaacucuugacacauaauguacaaucgaugguggcuaaaacgugaucuguuuuuaaagccuucccauuuuucuucugauuuuaucuccaacugaauaaaacaccagauucuaaguaagcuccauucgagcauagacaguacuauuucuuguucaccauuauauucacaauaccuaguaguacaguauauauaaaaauagcuccaguaaauaucaagugaaugaauacgcuauguucacuuugcagaugcgugggaggacaaauagaaugugacuugccuaaguuacacaaguugguuguggagccaagacugacucuaggucuucugacuccuaacuuuuaacaauugguaugacagguaaaaguguaaaauaaauacuuucuguaaauaaaugguagcauaauuuggacauggcuaugucauuuaccagagaauaaugucaguuuaugucaaauuuauauaacaaaaaugggaaguuauaguuauguauggcacaaaaagcaaauuauggaaaaauaaucaucaaacuuauaaguggauuuucauaaaagauaaaaaucuuuuuuuaaugcuuuuuuuuuuaggggcauuacucuagugugccuuaauugugauuuccuaagugauguuucuggcuuagauaauauggcuacacacuuaagucaacauaaaacucauacuugccaaguuguaaugcagaaagguacguauauguaacugugcuacuuuagauuuuugacuuuuauuccaguauuuuuggucauccacaauauggucucuuuacuaaaucauuauucucacucaucauauuucauaugcuguuguaaauguaaaacuuuucuucuaauuucaguuucuguuuguaucccaacuucugagcaccuuucugaguaaguuuaauuuuuauucagugcauuuuacuuugauggauuuuagcacuauugcauuuuuaaauguaucauuaauacgaaugaaaaguauuaaaguauguuguuguuuuuuuguuuuuuuuuuaaagcugcuuguugaaauagguuccugcucuauggagcucgugaccuggugcaagacaaguuggaauuuccuaaguucaaaguucugagauguuuucuuacacaaaggcaguugagcagccaaguucaugacacuagcucucauuauucagcucuuuucagcuuucaaaugggacuagauucuuauuccaccuuaucuuugugucagguugacauaucuuaacauauuuuuuuuucuccaguuugcgcugucuaaaaauaacauuuguugcuauggucuuuucuuugcuuacaauaauuuuuguuuuucucugcuguacuugccuucagaauaauagauuccaaauuauauggcuguuugucuuuugucuguuugucugcuuucuuaauuucuuauacgucuuaaguuuuaggccagauaauugucuuuuucucauucguugucugucauugugcuauuuuucuuauuuuucagaugcagaagcagcccagagauuucaaaaaauauccaggguauaccuggacagugucccccuucgauggacacaacugaugccuguucucucuuuccaaggaaugugaauaauuugacugugggaccugcucuuagguuguggccucaagaaaucagaucuuggggagacucccuuucuacauggcuggccucccauaaggcugauguuguuuggccagagauggcuuuaaggcccaccaaauugagcauacuucccacugggggcuuuggcuuaugaucuuaagcuuaugagucaguuaugaccaagaaaagcccaucaaaccacugcuucagcauccaaguugaaguuuagucauuuuggcugcugccuuuaaaucuuucucuagcaugaaugcaguccaaggaauauaaaaacucuaguuguuaggaaaccauggcuacuuucauauccuuggaacaacaggucuccacaauuaaguuccaaaauugcaguuauuuuuacugacauauaaaaucuauuaaccaguauuaauucuguaauuuuuuaacaauaccgauucuugcauuuugauuuuuuaaaaauuaauuuaauagcuugguuuuauguucucaaaauuuauuaaugucuauuuuaugaugucuauuuuuauauuauauuauuuaaaauuuguuuaguguuuguuuuaagaacuccaagagauuucuuagaauucucuacagauuuuguguagcugccuauuuguagauuuuaaauuuggcuguuacuaagcccauuaaacauuauuagauacucuguccuauugggauuauuauuaauauuaccuuaauugugaguucuuagguguaaagaauuggcaauacuacuugcagaccuuaagagccaguuuuaaaguuacguauuugugcgucuaagauguaaugucuacuuagccauuaauguagcuccuuuggguaaagguaacauguuaaaaaacauacauauggugaccaguaaugcauguauuucuuuccuuuauauauuuuaaauuugucauguguuuauuuuaguuacauugaauauagaucuaaacuuuuuauacuauuauccuuuuaauaaaaauuauauuguuuaagugccucaggaauuauuugcuaaugaauaaaggguguagauuuuaucuuauaaauaggaacauugcucucauuguuauauggaagccuuguuacuuggcugcagacagugcuauaucuaguuaguauaccuugcauuuuuuucuugcagcacaaugaaaagguuacuauacuaauuucuuaaauuuuaaagacuagcaaaaugccuuuugugaucuuaauagccauaaggauaggcaggccgguuuagaugaccaguuaaagccgguuuagaugaccaccuauuauaugacguguuucuugcaauuaauuaucaaaagaguugaaucuaauaguucugaauuuccaaacuaauuuauauuuuaagugaaagguuuuccaaaaucuccgcaaguaguuuguuucuuaguaguggacuuagugauauacuaguuguuuuuuuuuuuuucuuauuugucucuaggaauuuuuguuaucuccucucucuacccaguuuuuaaaaguuuauccagaaacaauaacuuuuuccauuuuuaacauuaguucauuuacagauauucaccuuaccuuggucauaggucaaaagcaggauaaaccacauuguuaauauaguaauguaggaguacagucaauccuucauauccuuggguuuugugucugcagauucagccaaccauggauugaaaauauuuggggggaaaaacaauaacaaauaacaauauaacaauaaaaaauacaaauaaaaaacaauacaauauaacaacuauuuacauagcauuuacauuguauaagugaucugagcaucugaggauuuuguuauuccugguggagguuuggggagguaggggcgaccuguggggugggggcagguucuguaaccaauccccuaccaauaccagggaaugacuguacugcuuuguggucuuacauagacuuuuuuuuuauaguauguaucaaauucauuuucuuaaaguaugaauucuuaaaguucuuucccaguaaauucauuuuuaaaaaaagguucaaauaaaacacuuggcagucaguacaaaguuugcuuauuguaagcaauuaguugaauuuucaguuuagugcuaaugaguuuuaguuugagucuaaucccuccuuaccaucauuuuauucuaguuuauucaucuggucagauagccauuucaugcauaugugcuuuuugguuacuguugaauaaaauaugugauugguucaguuugaguccaucaucauucuuagaaaaauaauuauuaaacuacagaggcucagauucuugcccuguuuuugucacauuuuggcaaaacacuuugccucuuugggcaucauguauuuauucagcgaauauuuauugagcaucuacuuugugccuggcauuguccuaguuucuagaaauauagacuaaucucugcucuuauggaacuuacauuauauuugugaaagacaauaaaaguaaauaaaacauauaauauguuagaugaugaucaauacuauggagaaauaugaaucagagaagggugauaaaggaguaugggguagguguuggaaggcugccauuuuuaauuuagugaggccucacugagagaugacauuugagugaagacaugaaacaggcaaagucaaacucagucaugaaauuguucuuuucuguuucucccuuaccuccauuucuccccuccucuguuuucuuguauaucuaccuggauggaugaauuauaacaaaauagaaguaaagguuugaguuuuguaaguuucuuuuucuugacaaaaaguugagaauagaaugauaauuuccucuaacagaucuugagaguguaagaaucugugguaaauacauaauaacucaaguuugcuaaacuaggcuacuuaacugguugccuauuuuauuguugaaucaaauauccuaaaagccacaauuucaagagauuuuaaaaguugauuuaguucucugagugacauccauguuuguucuaagcaaaguacaaugggaaagacauugacagucaaaauauuagaguuaaaggacccagcugccucacuaacuuuauuuaagguacaguuacuucaguuucuuuuucugugaaaucgaguugaaaauaucuuuguuuugaagauguuagaaauauguaaaauguguuuuacagauguuaauguguguauuauacuuuauuaaaucccccuaauuuaaugagcuuuauacuuagcaccaguaguaacuacauggcucauucacaguaugauauagacaaccuucccauauauucuuugucacugaacauugacacccuacuuuuuaugugugcaagauucugugucagguguuggaaacaugaauaaaacaugguuuauagcaccaaagcaauuacagaauaagggaauuagaaauguagacacugaauccacauuuuuuacagggacuauagucaacugauuucauaaucaauuaaaccacuaauaucauguauauauugcauuaugggauuuuuuuugugaaaugcuguaucagaagagaaucuggaccuauucucaaggugaaauagcacuuuauucugcuauucucaaaccaguaagucauuaauuaucuuucauaaauguaagcaguaaguaaacucuuaggaacagaauggcagccuuuuucuauaaaucuuauauuuuaaaauauuauuucuguuaagagauacuuacugucauugaaccugugaccauugaagauauauaaggguucauuccauuauuuuccugugaaauuuugaacuuacuuggaggaauuauuggcucuggucauaauccuaaauuauaacucuguagcucuuauguguucaaaauuguugggagacuucauuucauuaauuuagcaagauuaaaaaaaaaaaacaaacugaucuauugaguucauuuugggcuuguuuccuucuuuaaacuuuugaaaugugaccgggauuuuagccccuagauucucucauccuaccauagacauuaauaucucaaaccgaucuuuaggaacuguaaaauaguucuuccuuuucaaaauagacuuaauauauuugcuccugguauguaauugcaagugguuucuggcaauuuggacuucugccuuugauaucugguaagcagggagaauuugagacccagugagauggaaaaauaaaugaaacuuuaguguagucuuucauuuaggacaaacuguaccaaucucuaccagugauucugagguuacuaccauuuuuuucagucucugguuccugaggguuguugcuuauagauuauaaauuaaauauccaggguauaauucaauauuaccaacaaaccaaaauaauaaaauagaguccuagacugucauuaaaaucuucugccuacauugauggucuuauuuuuuuucuucacguuuuuacacaugaauauuuuggucuuuuuuauuucuugucucucugucuuuaccuaguucuuucuucugucuaucuaaaaugauuauucugcucuuuguuauaauagcuuuagauggccaaaucauacccugguguucuaagauuagcagaucauuucauacuagaaaaaauagaacugguccuaaggagaauagaccagcaaucaaaauuaaugucuguuggguugagggugagguggaaacaugguauacuaaauuuguuguauacucucaagcagauucugagcaagaagauugauucuauacucuacccauacccaugacaauaauaacuaacauuuacugagcacauacaguguggcagacacuuuucuaaguguuuugcauuuauuuacucauuuaauucucacauauuugugagauaugagcuguuacugucugauuuuauggaugagacaacugagauacagauauguuaaauaauuugcccaaggucgcacauaccuguuaaguggagagccucaauuuaaauucugucagucugucuucagagacuaaacuacucaguaguauccucuauugcuucucugcuucugcuuguaguuccagguguacauccugccuuguuugugauuggccaagaaacuggauaggacuaagcuucaguguuaaggcccucuuucugcagaaggguaggcagcaacugacacaaucauacgauugggacaguaaucuagcauaccaguuuacugucccaauccuauguucuauugcucaaacuucauagaaauacugcccuaaugauguuugggcaauauaacauuugagcaaagaaugguauaaacuggucuuuuaguaggauuaauuuagcagugauacucagcauguuuuagaguggaaaacauauagaggcagagagaucaguuaagguuuucaguuucccuggcaugaucauaagggagccugguucacaggagaggaauuggcuugaggcagugcaguggaaauuugaaguagaacccacacauuuaauccuccuucuauugcuuaauggcuuuauaacuuuagcauuuuuaggccucagauuuucucaucugcaagauggggguaguugaauaauauaaucucuuaggacccaagucuaauacacugugauguuucugaacugaauugucaacuguuugaaaaauaacaaaguguauuaaaaauggaggagucauucucuggauguugauuuugaaguuauaugaagagaagugaugguugguggccaggugugguagcucacaccuguaaccccagcacuuugggaggccaagacaggugggucacuugggcucaagaguucgagaccagccugcgcaacauggugaaaccccaucucuacaaaaaaguauaaaaauuagccaaguguuguggugugacuguaaucccaguuacucaggagauggugaugagaggaucacuggagccugggauguggagguuacagugagccgugaucauaccacugcacuccagcuugggcaacagagugagaccuuguuuaaaaaauaaauaaauaaauagaaguugugguuggaauuguguauaaggaugagauacacaagaggcaggucugagugguaaauauuuccauaugaauguucuguaagcaccacaaauccaauauguccaaaacugaauuuauuuuucccucaaagaaugcuuucucccuucuucgaauuccauaucaugaauaaucucuuaccagccagggcaggcauuugagggggucauauuuguucuccacauuuaccuuuauccaguguauacuuacauucuuuugguuuuaacuuguucucaucucccuaaaccaaccuuuucuccauugacacuguuacuguuuuaauugagaaagucauuaacugucucuuaacuggacucucagcuugucuucuaccaauacagaccuuugucuuucugaugcacaaauuuggucauacuuuccuauuagcauuaaaguucuuagcaugaacacuuuagcauggcaaucaagaccuucccugaagaggcucuuguauguuuucaguuucaucuuggacuacuuugcuuugugccugacauuucagugauaugagaccaccaauucucauauugucaucuuguuucauacuucuuugcuuuuucauacuuucucuguuucauacuucuuugcuuuuucucugccuuggaucuccuuacucugcuuugcuaauucuugcucuuuuugcaaaaccaaguucacuguaguaucuucauugcuuccuugccucuuucccuuucauaguggcuuaggucucugaacaaagaugucuuuucuaaaccuuuucauaauguaaacauuugcuucauuguguuuucuucacagugaacuccuugagaggagagacagucuuuuuuaacuuuggacuggaacacuuaguacaaucccugaaauauguacaaccugguaaauguuuugcucaggcauccuuuccacauauaaauauauugauaauucucagaacaaaugaucagaaaugguagaguagauguuuuacuguuaugucuuagucugaugauuacuauauuaaauuuagucccugaaugucucagugaauggucuuuuuauuuuauuuugcuguuuuuuguuuguuuuuuugagacagggucuugcuguuuugcucaagccagagggcuggauugcagugugcagucauggcucacugcagccucaaaguccugggcucaagcaauucuccugccucagccuccugagacugagcugggacucagguauguacaaccaugucuggcuaauuuuuuaaaaauuuuuuuguagagaugaggucucacuauguugcccaggcuggucucaaacuccuggucucaagcuauccucccauuuuggccucccaaagcauugggauuacaggcauguggcaccacgccugggcuaaguugaaggucaugauuacuggcugacuuuacuacugguugcuuuacagccucuuuucaacuuuuuuaguaugcuuacaaauauucuuaaagauuacauuucuaacaucagcauugaaaauuuuggcuuuuaaaugucaucagaaagaaagaauguggccuagcugaaaugaaucugaauauuuuuccccuuauaguucuuccccucaccccaugguauguuuauagugugaaugaaaccucaaaggaacauacuacuauaagugagccagaauguuaaauuuuguauggauuggcugggcacgguggcucauaccuguaaucccagcacuuuggaaggccgaggcagguggaucaccugaggucaggaguucgagaccagccugaccaauaugaugaaaccccgugucuacuaaaaauacaaaaauuagccaggcaugguggcaugugccuguaaucccagcuacuugggaggcugagacaggagaaucgcuugaaccugggagguggagguugcagugagccgagaucaugccauugcacuccagccugggcaacaagaacgaaacuccgucugcaaaaacaaaacaaaaauuuuguauggauugcuccuaagaccugcagaaaaaugcaaauagggucauuuuagucuuuagagggaaaagcuuguccuguagaaauacaucagaaagaucuauuucagcagauuuucauagaggggaaaaguuauuucuugcaaucuugaucacuaaugauguugaaauugaucaccagucaguccuguucucuuugcauugaaauuuuaaauaguguuugcuauaaauacuacacuauauuuuucuauuaagaaguauuguaacauucacagguggaaaguauaauuaccuaauggugggucauuagcucagaacuuugagcuuagcaaauuucugucuucuaccaaaguaauugaaugucuaaaauaaugacuauuucagcagguaucuuuaguaaauaagaauuauagguaagaaaauuuuucuuuucuaaaaguguuaaugauguguuaguaguauuaaucuuaaaguauacuuuuguaguucaaaguuugaguguacauuuuagugaugcauuuuauaauuuaaaauuuauugugugcuuuucuaaauauuuuuaagauuuauuuuucuaaauguguucacuaguuauuacgauucuguuccuuaaagagaguacuaauaugguaaaaggcacaaaacaagauugaaaucauaggccucuuaaugcaaguuauuucaauaacuuacuuuguucucaccuaccaguuucuugccaguacaauaaagagugauaaaaaccucugucaccaaccuccaucacagagauagcaagaggacuguguuuccucuguugaaaugccagcaauaaugaacauacuuaacggggcucauuuuaauagcugcauacaauuaauuuauuauaauaggcauaugcuaaaaugauuagcauggugauauuucuuuuauaagaauauaauaggucuuacuuugauaacauuuacuacgauaaguugagggagaaaaaucuuucaugaaauauuuaaauuguucugugaccaauuuguuuuucaaacugaauuuaaaaugacuaaaugcuuagaaauaaaaaugaguuguaauauacacauuuauuucaaaacuucauuaauuugcuuuuucaugcuuuuugcuuuuuuagacuaauguuucauguuuucuuaguacuucauaacuaauuuuauucuuaaaacuuauuuuccuuuauacugcauuaaagcagugaaguuauacuguauacuugaugugaucucaucuuuauaaguauugugcacaauuaaauacuugagacaauuacaaaaucuuuaacccccaaaaugauugacauuugugucuuuugucaauuuuuucugcaaguuuuauucauuuuaauuggcuuaacaaguugguuguaaauuauuguagugcacugccaauauagugguuuuacaaaggacauaaucuauauuaaguagcaguuuugccuaauagcuaaaauacagauaaguaauuucauacaguuaauuauuaauguuuaacaaaguauaaacauuuauagcccuaauuuuucaaauaugcccucaaaggauggaugaagaaggaggguuuugccaacucuguuucauugauuagccaugagaguagcuuuuaggaugguugacguuucuauccuauuagauaucuuuuuuuuugucaaugaaauuuaagauaauauaguugcugcuuauguuaaauauguuauuccuuagguauagcuauuaagccuucauaaaauuauguaucacuuaacucuugauuaaugacauuucagaucagguagguacccuacuuacacagauuaaaauugaguuuaauguauaauaucacaaauaauauuuagucauuucugcagcuucuaaaacaaagauccuuuggauaagcuaguucuuagauuaaauugauuauuuuacaagauuuucuggauggcauauaccuuuguuaauguuuuaauaaguuauaauuaauauuuuuagaaaucaagaaguuuuaauauuugagcagugcuuauggagguuuuaaagagaauauauuccucaaaauucuaauuacuucugugauuuuacugccuccagaguaaguuaacuauaauauuguuauauuuaguugaauuucacaauagauaaaauauuuaucuuuuuucacuuaaguccuguaaucguaaauacugaugcauauuacuuauguaagcauauaaccugcuuuuaauuuuuaaagaguaauucuuguuuugaaacuguuuuacuaauguguaugucuuuuauuuuaaauuguacuuagcaaagagaacauuucuuaaguguccuuguuuuuagagaacaaggaaauaaaugucuuuauugauuuagcacauuuaucgaaucuacuauuuagucucauacguuuaacuuuuaccuuaaaacauuuacagaggucaauuuacuauuaaaguauaaaauguacauuaguuucgaucuacauuuuaauuauuuuaggcuggcagagaaagaacuguuucauauuuuaccaucguacauauaaaauaaaauauucaauacuuaucuuguuuucaagauuaaaaaaagaagcucccgcaaaggaacaagaaccugugucuaagguaaaguuuguuuuacuuuauaccuuaaagguuuauacauuugaaaguauuauugguaugauauaaaauuuuuuuucaauuucagcaugcauacaucaacaauauuugggauguugugaggaagaaaaaaaaucgagauuuaaaauuuuucauuacauauaaaaauaucuagcccuaaguaaaauuuuaagguauucuuguuuugacaaagacaucuuauauuucacuugccuguuauuuaguucaacuagugaguaauggagauaaauuuaugaauuaaaaauccccaaaucaguaaaaccucaaucauuuggcacacuggaaaaauuaaucuuuccagguuuaauuuucugggauauuuuaacugucaaaagguuaaacuaauuuuuaaaauagaaauauuuuggauguaucuuaaauauguuuuaaacaaguacucugaaugcagaacucagaauuaucauauaaauguuauuuaccggacagucuaauagaugacuguagaaauaguuuugcucaacuacuugcuuucuugaugucaauuuauguugauauuacuuaaugauuguuugccucuuuuugaguguaaugaagugagguagauuugacauuuaucuuuugaauacuuugucuugaauggcgcauaauauaagugaaauccaggcagaaguaucagccuucuuccaagcagcuuucuuuuguaccauagaaaguuuucuuuuguuuaaaaguuuuucaacuacaaauuucuuuaacagaugcagguuuuuaaauuuuuuaaucuauuucuucuugagggaguuuugguaguuuguaguuuuuuugaggaauggguucauuuuaccuaauauguugaacucgaaucuuauguauauugagaaaguugcuuauaguaucccuuauugucuuuguaaucuuuggaaucugcagugauauccccucucauucaugauauugacaguuugugugcuuuuucuauucuuauuauauauuuuaauuuuaaacauguuguaaauacacagaaugcaguauuacaguuuuuacuuuagacaguuuuuuuagggcaauuaaaaacuuuaaaauuagcuuuauauuuaccuuuauuuuuaccauuuccuauacucuucauuucuuuauguagucuucauuucuguuuaucgcauuuacauuaaaaauucuggccagggauauaauggagcaaauguuuccgguuuauacagggguauacaagccacuguuugccccuaaaauaauuaugccuaauuuguuccuuguuuaacucaucauaauuuaacagaagaaaaugcugcauucugugaauuuaaauaugaucaacuuuuuuaguauuguacaaaggauauauaguuuagggguaggggaauucagugagcaaacaggauauucuugucuggucuaaaaacgacauuaaaaucacauauaguuacauuaugggcaucaagauaaaugcaguugagacacuuugcacacaaauuaaagaugauuaucaaauauuaaaagauauaauaucaaaugacaaaauacauuaugcugaaauugaaagcauauugguaugaauagauuacaaaguguuaugcagauuaucuguauggauauuuugagccaaguggaagaagcuaaagcuuuacagucaguaaacaugacuaauauaaagcuacacacuuaauaaaaggccuaucccuuugcuuacaacaauugaagguaauuuugaaaguguauuugaugaacauaaaacuugagcaagagauaugcauauucuucucaaauuuuaaaauaaaugaaaaaaguaaacaaaugagaaaugcaugagucacugggugaagaguauugauaauuaugagggcagugcuuauuaaauagaaauuaagauuauaaaugcccuaauuucauauuuuguauagagauauaaaaaauucagugaaauguuuucagauuuugaauuucuaaacuggagaaaaauuguuuuguauaaauacaucugauuuacaaagacgagccacuaaguuugcacuuaaauauucugacgauuuaaauucuauagaaauucuauaugaaauaguuuaaagcagcauuugauaucaauaacauacaaucaaguuuguguuugggucuucuaaaccuucuuaacauauuuugcuuagugcagucuuaaacagauuuggaaaugguauucaaaaauuuuaaacaauuccagccacaguggaauccugcaaaugaagcuuacuguaaacugaaguuaauauaacauuuuuuuaugauugucacuuguucaagagaaauuguacaugacaguuugcucauuugaaaacaaaauaagaaaagaauuagauuugaaaauguacuguugaugcauuugcuuccauuagccaggagaauaaaauaauacuguuuuuggcauaaauaaaaucuuuaaguuuaagcuaaugugaguuuaauucuccuacuuuuaaauuuuucaauauuuuucugacuaacauucuagaaaaaaaauuuuuuaaauacacagaaacaggcugggcacaauggcacacaccuguaaucccaucacuuuggagacagagcugggaggauugcuuaagucuaggaguuagagaccagccugggaaacaaagugagacccuguugcuaaaaacaaaaaacaaaacaaaaacacaccacacacaaagcaaaacuuauaggggcauucauuuuuucuuuugccucaggcuucaauauggcuugguauagcacugauugcagaauaguuacaucaaaauuuuugagacuguuaugcugagccagaaaguaccccaugauuucuuuuccuuuucuguaccuuauguuauuuuucuggaguuaaaaauauguaucuuuuuuacucguuuguuuaguuuucugugcaccuaaugcuguauuuuuuucuaacguugcaauuucucucucaaauauuuggaaauaguuuuuccaguguucacacacauaaaaaaaaaaucgcuggggagugaaggggucugaagaucuccucccagacuccccgccucaacuuaaacuaguugcucccuaagccugugcuuaguuuuguuaugucaagauuauccuuugccacucccuuguauuggauguccuguuugcugaaccaugaauuauuccucauuucuuggcuuacucaucauuuugaugaauuguguccucuacuagcuuccugagaaggugugcaucuuuuuucaguuuuugcauaucuaaaaauauauuuaugcgaaugauaguuuggcugaaguacauaaaaauaauucccaugcaguuuuuaaaauguuguuuuuacuaucuucuuauauccaguauuuguauuaagucugaugcaugucuugcuccaguuucuugguauuuagguuacuuuuuuucuuuuuggaaacuuuagugauuaucucugucacugguguuuugaaaucgcaugauauguucacccauccuuuuuucauucauuguauuaggcaucugacaaaccuuuggaguuuggagauuucuguuugggagaaguuuucuuguuucauuucugugguaaaugcucacuuuuauuuucuguguucuccuuuuuuuaagaaacuccuauuguucugacauuguucugacacugagccuccugcaucaacuccuuuuuuuuuuuuagcucauuuaauuguauguuauuuucuuucuggccuuucaucuuuuuguuuuuuuguuucaaucuuuuuaaauaauuuucuaaacuuaauuacuuauuuuaguugccauauuuguaauuuugaagagcucuguaacuuuuuauuuguucuuuaauucucuuuuuuacaguuuuuguuacuguuuaauggauauaauaacauauaccucuuuggagauauuaaauauuguauauauacuuuuuucuuuuguucccagcaauguaucugaugucuccaagccccuuucuuuauuccuuuuuguuuuuuuugguauuuuucauguuaagguaugucuuuuguuauguggugauccuuacccgcccauacauaauuaaagaaugaggcuaaaauaaucauugaaaaccguauguguuugaauggagacagggcugucuugcauagccauucagguugaacacugcagaacuccugcggauacuauuuaaauauauccuuuguagucucaaaaauuacuaauguuuaccauauuagaaauugaaauaaugauauuuuaaaacuauugucaaaaauaaaaauaauaaauauauguuaacauaaaucacauuuuuuuucugaaaaauaacuauuuuccaaagcaacagaaauuuagugagaaagaauggcuugauuuuacacuuuugcauauuucuuuaaugucaagcuuaguagaaaaaaauuggauucucauguuucugaauccaaucuguugugauacauucuuuugguugaaauguaugaagaauacccagccucacccaguacuucaauaaucuuuuccaauaauugugauuauucuccuuugauacugcaccaaaaguggaaguuuucuugcuuguugcacuguggaaucuagcuccguaucacugacuuuuuuugcuuuguuacaucaaaaucuguuugucuguuuuauauuuugaauggaucuuuuauccaugccuaauuuuguaauaucaugcauuggucauuuggaacuuauuggccccuuaagugcccuggaucuuccaaauguugaaauauuucauuauauaauaucaagcacucacaguaaauauuagcauuaaucuaaucagugguggguaggaguuuuugcuugauuuuauuacuggaaacgaauacugucaguuguuuuccuugauaugacaggcucacuuuguuaauuuuucaaaaagaaaaagucuacugaaacucuagucuagauauucauaguuugacagucauucuuuaaaauaaaaaugauccuguucuaugaaaaaaaugugguuaaguacaacucacaacucaaucacagacccaaauauuuucaguaggcaaugguugugacuuaugcauacuuucuuugcauuuugucacacaaaauauuaaaaagauaugagcucaaagauugagauuuaauaaaguuuuuuuuuuuaacuugucucgguguggugugaagaauacaauguguaugguggugaagaauacaaugacuacuaguacagguugcuacugccuugauuuauauuaauuugccaccauuuuuacacacuucuguuuuuaugccaagaguugugacuucagaugccuccugaaaguggcuuggauucuccagguguccauaugucauacuuuggaaacggaugauaugaauuacaauguguugcccucuggauuugugcacuguacugugugcacaaucugcaugaaaauugcguagacuucagugugggaaaauuaggugcugaacugacugauucuuuguugaggaggauggucucaacaucauuauggagaggccaggugugguggcucaugccuguaaucccaacacuuugggaagcuaaugcaggaggaucccuugaggcugggaguuugagaccagccugggcaacacuggagacuucgucucuacaaaaaaaaaaaauguuuuuaacuagccagucauguugagcacauacuguguaguccuagcuacucaggagacugaggugagaggauugcuugagcuuaggaguucgagguugcaguugagcuaugaucaugccacuacguuccagccuuggugacagagugagaucuugucucuuaaaaaaaaaaaaaaaaaauucauucuggaaaauuuuuucuuugggguugaucauuuucuccagagagaaaucuagcuucuagcugagagugcuagguuggggagugaguucucuggcuguuggcauucuggaagccaggcagggagaaggauuguuaaguacguggacuuuuacuaaaacuuuguuuucucaguaucucaugccugccuuuuacuuuuccugguguucauaagucuagacuaucuccacuucagaaaguuaacuuuuaggcugggcacgguggcucacuccuguaaucccagcacuuugggaggccgagguggguggaucauuugaggucaggaauucacaaccaggcugacaaacauagugaaaccccaucucuacuaaaaauaaaaaaaauuaguugggcaugguggaacaugccuguaaucccagcacuuugggaggccgagguggguggaucaccugaggucaggagucugagaccagccuggcuaacauggugaaaccccgucuguacuaaaaauacaaaaauuagucgggcauggugguggguaccuguaaucccagcuacucagggggcugagacaggagaaucgcuugaaccugagagguggagguuguagugagcugagaucauaccacugcacuccauccuaggugacagagcuagacucugucaaaaaaaaaaaaaaaaaauaggaaggaaggaaguuaaguuuuagccucuuugguaagggaagggauaggugccuguuguguaaguugcggggaaggagcauuuagauuucccagcaaugcuuuguuuuuacuuuuuauguacuaaauaguagacugaccaccugcaaauaccagguguuuuugguucucugggcaaauugaucucuuuuccuugcacuccuccacugcagacauucauuguaacuuccuccauacugcuaaaucaguaaccacucuuccaaugacuuuccuguuucuaaacauuuggugaaaucuguuuagcaauuaguauacuuugguguuuucuucaucuuuaugaguaaaaauauuuuauuucuuugcccuuguuuuagcagaguuuugagacggugaguagauaagugugugugauuaauacaccauuaucaauuuuacaggcuugagucgaucuaccauagugguuaagagguagauauagauuugaaucuuuacuacuuauugugguauugccuuggguucccacucaagucuuauuucucauauauugaaauaguguuuauaaaaucuaauauguagauuaaaugagauagugcauguaaaguucuuaauauacugcuucaugcaucauauguacuccauagcugguaauuguuacaagcuguuagguuggccuauggcuuacugagguuuuacacuuuucuugcuucccuguaaaacauuugaaauaaguagaauguuucuuacuuuguguacuguuucauguuuuugguuugacaguggaaggguuaccaugacucaauaugaaaucauaaauucagaaauguuuuaucuaaauaccugugccuaauauauuuauauaaaauacuguggaugcaucuuguuauucaaauucaaguuguguuuuacuaguuuucuauuuaaguaauuguaauuaugauccacauuugaaauagagguuacgaaaagcagauauugacaugaguggguaacugcuuuuuuaccuugaaucagaaacuuuugguacacugaaacuuuuauagguuuaaaaacauuuucaaaaccugcauauaauuauggaguauucuaauuauauuuuauauuuaauaaauuauuuuucuauuucuuuguuauauuaaguugcacacuuguuucuuuuauccagaaaguuuaguauaauaaaaauaguuuuaagauuaacugugaauguaaaagaaaaguauuauuaauuauuucaggaaauugcaagaccuaacauggcugaaagagaaacagaaacaucaaauucugaaagguaaauauaaggaaaaacugaauuucauaaaauucaaguauacaaaauaacacuugagcugcauuauuucacaguuaacuggcaaaggacuauuuaaauguuuguauauagugcuauuuucuguaauggcucuuaauuaaaauaaaacuuaaaaacuuuaauccaagaaaaauauucucuauauccuuuguuuuuaaaucuuuuaaacauauagagcauauuuuauguuguuaaauuuuugagaaacuacuuacuagcaaguaaaauguuggcagauuuucuuugccccuauuaaaugaaaacauuuacaagaugcugcauguuacuggacaggaacaguuguugcacauagguaaucuuaagauuuuuuaaaguauuuucaaaaagcuauaagacuacuuauaugguaggaucacaauaguuucaaaacucaggguuuggcuuuuaaaauuuucauacuuugguagaauguuaaagaacacaagauguuucacagucuuuuagcagaagagaaucugaacauuccaauuagaacuuuauuccaaagaaggguaauuuuauuuugucuuuuaaguaauuugacccauuuauaucuguaugcuauauauuuuacuguagguugccuguuagucuguugagauuaaucuuuugucccuaaaagcaaguuauggauuaaguuccuaugaagguguuucuuauacuucaauaguaaaguuaucucgcccuuucuucaccuugaauuuuuuguaaguucuugggggaauguuaacaaaaaaucaacuaaggaguuagaaaaugcggacuggucaucucuguauuauuuaacauuuuacguaaauuguaguuaguccauuaugaucugaacaaaacuaagaauuauacaaauuugaaaugaggaaaaaauaauuuuuuccauauguaauugaccaguuaagauccaaaaaaugaguuaagugauugaaauuaaugagaguauugauuaaaguagccugguguaaaaaucagaaucuuucuaccacuaacauaugauuacaaaauauaguggacagacucacucaaucauaauguaacaaaaaugauacaaauaauugaucacagccaguugcagaguucuuuguuccuucuccauucccacugauucacuugacuagccuuaaaaauaucuauaucuauauauagagagagaaauggccaggauccagaugaagaaaagcaaaauuuuccaugauaaaaaauaauauauuaacuacaugauagacuauuuuacaaauuaaauuaugaauuuaauaaacaugggauuuguuuuggaaacugacaaacuuaaaaaaagauuuauauuuuucucacuauuaauaccauaauguauuuaaucauuccuuucuugcuggauaacauacuagguuuuuggcugggcgcuguggcucaugccuguaaucccagcacuuugggaggccgagguggguggaucacgaggucaggaguucaagaccagccugaccaacauggugaaaccccgucucuacuaaaaauauaaaaauuagccgggcuugguggcacgugccuguaaucccagcuauucgggaggcugaggcaggagaaucaccugaacccgggaggcagagguugcaaugagccgagaucaugccacugcaccccacccuggacgucacagugagacuguccccccucaaaaaaaaaaagauaaaaagauauuagauuuuuuauauuuacuauuuuaaacauuguuuuaaugagcauccuugauaaauaucuuuuacauauuaaaaguaugaaauuuauggggaagaguuguagauuguaggugauuuguuuaguucuaaaguauauuguuaaucaauaauuguuaaaacugggugcuacugguuuaggaauagucuaaagacaaaucaguagaacaaaacaaauagcagagaaauagccuuauauaaauaguaauuuaguaaauaauaaauuaccuuuuggaaauguugcuaggauauuugugcaauucauugggaauacgucuaaaugucagauuaaauguaagaaauaagguauauguaaucauuaaauuuauuuucauaaaauaagcauccuuagaucuagauaauggacugaugaucuucuuagaaaucuuguuucucauauuuugugauucacuagauaguuucuguuaacacuucagggccagaagaaacacacagaagcacacauauauauauguguacaaacaugcacacacacuuagauguguauguauguuauauauuuacauauacuuuuucaggcauguguuuuuuuuuuaaauugggcuauuaaaaauuagaaaaauauguuugaaugcuuaucugauuuuauguauggaaagacauucuaaacauaagaagcuauuuaaaucauaaaggagacugggcaugguggcucauaccuguaaucccagcccuuugggagccaaggcaagaggauugcuugagcccaggagaccagccugggcaacauggcaaaaccuugucucuaugaaauauaaaaaaaauagcugggcuugguggugugcaccuauauuccuagcuacuugggaggcugaggugggaggaucacuugagcccaggaggucaaagcugcagugagauauuugcaccacuguguuccugucugggugacagagcaagacccugucucaaaaaaaaaaaaaaaaaaaucauaaaaaaauauagauuuuuuuccaaauauauuuuuuuauuuuagguacuuuuacaaguuaauaaaaauacuuaaauuuaaacuagaaacaggcaagagauaugaacagaugaaaauaaugacagccaggacuaaaacuaguugauagauaucuuuuaguaugugauuccagaguuucucagaaucuugccuaagaaaauggccuccuccuaaauuuuacugccauagcgaggauugggaacuuggacuguuuuccuuuuuggugggcaaauguaccuugacuuuuuauuuuuuagaacacgucuuuauuuugacaguguucaaaaacauugcuuuaugaagaaauacauaauaaaugacuuuauuuuucaguaaacaagauaaagcugcuucuucaaaagaaaaaaauggauguaaugcaaauucauuugaaggcucaucaacaacaaaaagugaagaaagcauaacaguuucagauaaggaaaaugaaaccugucuugcagaccaggaaacuggcucaaaaaacaucgucaguugugauucaaauauuggugcagauaaaguggaaaagaaaaaacaaauacaacacguuugucaggaaauggaguugaagaugugccaaaguucagaaaacauaaucuuaucugaucagauuaaagaucacaacuccagugaagccagauuuucuucaaagaauauuaaggauuugcgauuagcaucagauaauguaagcauugaucaguuuuugagaaaaagacaugaaccugaaucuguuaguucugauguuagcgagcaaggcaguauucauuuggaaccucugacuccauccgagguacuugaguaugaagccacagagauucuucagaaagguaguggugauccuucagccaagacugaugaaguagugucugaucaaacagaugacauuccuggaggaaauaacccuagcacaacagaggcaacaguagaccuggaagacgaaaaagaaagaaguugaaauuagucauuuuaaguuucaguguaccaacgauaagggcauuuggaacagugcuaucaggugagcucaguggugcuguuguagguucagaaauggaaauauguaagggaggucacacauacacuuuaccuguauguucaaccuauguuaucaaacaaaucaauucaccaauaauagcaugauuaguagggauucccaaaaaguuuuuaaaaacacgaacaggauuuuaaugauaauuaaauuugcaguggaaaggucucauuuaaugguuuucaaggaaaugggauuugguugcugacaugaauugaugauauuaguaauauuuauaaagccuuucaaacuuccaucaauccuaagcuaaaaaucuuuauuaccuguauauccuuuucaguuaacugagaggaagggauuuggaaaccauguacuuuuggggaguaauugauuaaaaacaauggcugauuggcauuguuaaugaaggcuuuauuugugaggaugaugcugguaaauggagcaugcuuagaguacuaaauugaucuaaugagaauuuggaugaacauaaacuuaauuuuggauuuaauauaacauuccagucagacgcauguaaacagaauauuugaaucuuuguaccuccauacaaguguuagccugccaggcuguaagcuuaccuuaauuaaacuuucagugaaaguggaauuauuaagauauaaauuuauauuugugcuuuuugucaguguguaagcuguguagaaauucuuugauguauuaguuguauuaauguaaaguagaaacccauuguugaaacuccuguagcuauuaugcuuuuaauauuguuuuaaugaucuuccuuagaaauaggcccauaaaaauggucuggaagccaaaccaaaguaugguauaauguagauauuguaaagcaguaaacugaaaacauguccuggcauguauucagccauguuuaagugacuuuucuguaauuguaaaauaaaaacuucaaaugggaccuaaaacagugauguaaaagaacugguuuuggaaauuuagccuaauuuaucuauaagauggcugcuaaauugauuuuucaguucuuuuuaucaucuagaauauaauagauauagaaaugaauaauaugaagaacaguaguuugcuuugaaauacuaauaaacuuuuauuuaaaaugcuucauuuuuacuucuuaaaaugugcuuuggauucuuaaauuuuguuucacugaauguucaauguuuuaaauggcgauuaaaauacucugcuguauauaguaguuuuugaguaaauauuugcaauaaaaaucugcccccgaauaauucuauuuuucca

SEQ ID NO: 16054 - RNA, 3616 nt, Homo sapiens
uuaaaaagacacuccauuuuugaaagcaaucagccugagaggguaaauacuuuaccaauuguaucauuacucaaaacauuuuuagaaugucucucaaaauuuugaucucagcccuuacuauauuuuucaaaaaagaccuucgauaguagacuaauuuuuauccuuugaaggugaauuuuuuuuuuuauaaauauagucuccauauuaagaacagguuguguuacaaauguccuuuuguaagucagcugcuuggaacucauuccugucucaaaacccuggcaggaaggauaagacagccaagcuaugagccauuggcagaggcucuccagagugcaggugcugagaagccagagcugaggcuuggggucggaaaggggcaaaacaacuggagcuggauuugagaugaaaaauugugauuuuuaaaaggggcuggggguucaacagauccucaucauuauugaguauggggagagaguuauagcuuccucauugucuauuuccugcuccccacaccaaguuguuguuguuaacuagaaugaugaaaagcagaaauugggauggggaaaagaaaagaaagggcaagguguaccagcaggauaguuguuccucuccuuucuucucuucauuguuuuuacugcccacaacuuacuuucuaaugaucucaaugccacgcccuaaaucugaaaugagcuuuuaaaaaauuuuuauuuuauaauccauuuuuccuaaaauuuauauuuugcuuauuuugucaauuuuuuucaguguuuaucuuacuguuuuaaagguuuucucagugacacuuuuuuggaauaucuuaacuuuagucuuguuaagaaauucugcuucugaauuucuucuaggucauacuggaaucauuguauaguagcaauaaaauaauagugccuauuuccaugaauugcugguaggauuaaaaacuguuuucuccauacaaauuuauuccauuaugaggaguggcuucagcaaauauuuauugaauuauugaaugccccucaugggcuaaauauuaaaaucaugaaaauacauguauuuauuucugauuagaaauggggggagggaaauuuacugaccuuugagaaaauguaaaaaugcuguguuggcauuuaucucagcuucugcacauuuacgauauagcuacgguuuuuaaaauccuguuguuaacugaaacugucaccugauuuuaaaauccuguuguuaacugaaacugucgccugaguugaaccauauuguaagaugacaaaacuauauugacaauuguuuauaaauucgaagucuaaugcuucauaaagaaauugugaguuaaaauuugccauuuugguugcuuuguccaguagauggcuacauucucaaagaaauucaaaggaaccucccuucuauaaaggagaguauuuauugcagcuuuccuuucuguuuauuuucaggaaugaaaggaauuacccagccuucugcuuuuauaccuacagcugaaaguaauuccuuucagccucaggugaagacuuugccaucuccaauugaugcuaaacagcaguugcaacggaaaauccagaagaagcagcaagaacagaaacuacaauccccuuugccaggagaaucugcagcaaaaaagucagaaagugcuacaagcaauggagugacuaaucuuccuaauggaaauccuucaauccuuucuccucaaccuauugguaucguuguggcagcugucccuagucccauuccgguaauauaauuaaauaguauuuggccuuauugggauggugggaaaucaacuguuuacuuaaaaguggcagaugaaaagaaggcagguauaagaguagccacaaacugauuuugugaccacaggaagauucauuccccuucagucuuuuauucaggauguauguuguugauuacaaaguaagcuaugaaacauuauugaaaauauaaagauccaagacauacaaaguaugcacauaaccacucagagcuuuauguaagagugaguaauuuucucauuuuuagaguuguuucaucccuggcugagccaagauuuuuuuuuuuuuuuuuuuuuuuuugagacagagucuugcucugucucccaggcuggagugcagugcugugaucucggcucacugcaaccuccaccuccugaguucaagcaauuauucugccucagccucccgaguaacugggauuacagguacucaccaccacacccagcuaauuuuuguauuuuuguguuuuguauuuuuaguuggccaggcuggucuugaacuugugacgucaagugauccacccgccuuggccucccaaaguacugggauuauaagcgugagccaccccacccagccaagauaauuuaauugcagucuuuuuuuaaaauuuaaacgcuuuucuuuuuuacauucagauggaguaaaauucuaauguguaaugauuacuuaaauguaggccuauccguggcuuaucagauacaggacuagaaccuuggccaaguucuuuagcuaguuuauuaaccucuauuuguagauaaggaaacagucuccuccuuuccuaucucacacaacugagguuaugaugaagggacuuuuaaaaugagaguaaguuggugcuuuauguuauuauugauaauaauauuuaggaaguauuuugucguuuuucuuguuccuauuaucaucaucguguuauuaaaauaugaaauacaugguaaccgcacuauucauuauagggcaaacuggaguagacaguaguuguaucuuauuugcagugguuuaguuacagacauuuaagguagacacauuuauaagacaguuuccccuaugagugagccaucuuagcauagauucugguagguaaccuuuacaguuguauguuucuucaagauuuuaugucuucuuccuguaacccccuuaaaucauuguuucagcaaauauucaucacaggugugaagcuuuuagucuuaauugaaaaguaacuuaauguucuuacauauuuuuuaauuauaaugcauuaugguugcauuuguuacauuuaugugucugauuguguagaaccuggucuagaagaacucucuucuaacauaggaacuuuuuucuuuuuaacauuaacauuuaauaaaugacuuaaaaguauauacagauacaugaauuacuauuuacaggcuagaccuguuaaaucugauuuuuugcuaucuuuuaacagguccagcggacuaggcaauugguaacuucaccgaguccaaugaguucuucugacggcaaaguucuuccccucaauguacagguggucacucagcacaugcagucugugaaacaggcaccaaagacuccccagaacguuccagccaguccugguggggaucguucugcccggcaccguuacccucagaucuuacccaaaccagcgaacaccagugcacucaccauucgcucuccaacuacuguccucuuuacuaguagucccaucaaaacugcuguuguacccgcuucacacaugaguucucuaaauguggugaaaaugacaacaauaucccucacacccagcaacaguaacaccccucuuaaacauucugccucagucagcagugcuacaggaacaacagaagaaucaaggaguguuc

SEQ ID NO: 16055 - RNA, 3616 nt, Homo sapiens
gaacacuccuugauucuucuguuguuccuguagcacugcugacugaggcagaauguuuaagagggguguuacuguugcugggugugagggauauuguugucauuuucaccacauuuagagaacucaugugugaagcggguacaacagcaguuuugaugggacuacuaguaaagaggacaguaguuggagagcgaauggugagugcacugguguucgcugguuuggguaagaucugaggguaacggugccgggcagaacgauccccaccaggacuggcuggaacguucuggggagucuuuggugccuguuucacagacugcaugugcugagugaccaccuguacauugaggggaagaacuuugccgucagaagaacucauuggacucggugaaguuaccaauugccuaguccgcuggaccuguuaaaagauagcaaaaaaucagauuuaacaggucuagccuguaaauaguaauucauguaucuguauauacuuuuaagucauuuauuaaauguuaauguuaaaaagaaaaaaguuccuauguuagaagagaguucuucuagaccagguucuacacaaucagacacauaaauguaacaaaugcaaccauaaugcauuauaauuaaaaaauauguaagaacauuaaguuacuuuucaauuaagacuaaaagcuucacaccugugaugaauauuugcugaaacaaugauuuaaggggguuacaggaagaagacauaaaaucuugaagaaacauacaacuguaaagguuaccuaccagaaucuaugcuaagauggcucacucauaggggaaacugucuuauaaaugugucuaccuuaaaugucuguaacuaaaccacugcaaauaagauacaacuacugucuacuccaguuugcccuauaaugaauagugcgguuaccauguauuucauauuuuaauaacacgaugaugauaauaggaacaagaaaaacgacaaaauacuuccuaaauauuauuaucaauaauaacauaaagcaccaacuuacucucauuuuaaaagucccuucaucauaaccucaguugugugagauaggaaaggaggagacuguuuccuuaucuacaaauagagguuaauaaacuagcuaaagaacuuggccaagguucuaguccuguaucugauaagccacggauaggccuacauuuaaguaaucauuacacauuagaauuuuacuccaucugaauguaaaaaagaaaagcguuuaaauuuuaaaaaaagacugcaauuaaauuaucuuggcugggugggguggcucacgcuuauaaucccaguacuuugggaggccaaggcggguggaucacuugacgucacaaguucaagaccagccuggccaacuaaaaauacaaaacacaaaaauacaaaaauuagcugggugugguggugaguaccuguaaucccaguuacucgggaggcugaggcagaauaauugcuugaacucaggagguggagguugcagugagccgagaucacagcacugcacuccagccugggagacagagcaagacucugucucaaaaaaaaaaaaaaaaaaaaaaaaaucuuggcucagccagggaugaaacaacucuaaaaaugagaaaauuacucacucuuacauaaagcucugagugguuaugugcauacuuuguaugucuuggaucuuuauauuuucaauaauguuucauagcuuacuuuguaaucaacaacauacauccugaauaaaagacugaaggggaaugaaucuuccuguggucacaaaaucaguuuguggcuacucuuauaccugccuucuuuucaucugccacuuuuaaguaaacaguugauuucccaccaucccaauaaggccaaauacuauuuaauuauauuaccggaaugggacuagggacagcugccacaacgauaccaauagguugaggagaaaggauugaaggauuuccauuaggaagauuagucacuccauugcuuguagcacuuucugacuuuuuugcugcagauucuccuggcaaaggggauuguaguuucuguucuugcugcuucuucuggauuuuccguugcaacugcuguuuagcaucaauuggagauggcaaagucuucaccugaggcugaaaggaauuacuuucagcuguagguauaaaagcagaaggcuggguaauuccuuucauuccugaaaauaaacagaaaggaaagcugcaauaaauacucuccuuuauagaagggagguuccuuugaauuucuuugagaauguagccaucuacuggacaaagcaaccaaaauggcaaauuuuaacucacaauuucuuuaugaagcauuagacuucgaauuuauaaacaauugucaauauaguuuugucaucuuacaauaugguucaacucaggcgacaguuucaguuaacaacaggauuuuaaaaucaggugacaguuucaguuaacaacaggauuuuaaaaaccguagcuauaucguaaaugugcagaagcugagauaaaugccaacacagcauuuuuacauuuucucaaaggucaguaaauuucccuccccccauuucuaaucagaaauaaauacauguauuuucaugauuuuaauauuuagcccaugaggggcauucaauaauucaauaaauauuugcugaagccacuccucauaauggaauaaauuuguauggagaaaacaguuuuuaauccuaccagcaauucauggaaauaggcacuauuauuuuauugcuacuauacaaugauuccaguaugaccuagaagaaauucagaagcagaauuucuuaacaagacuaaaguuaagauauuccaaaaaagugucacugagaaaaccuuuaaaacaguaagauaaacacugaaaaaaauugacaaaauaagcaaaauauaaauuuuaggaaaaauggauuauaaaauaaaaauuuuuuaaaagcucauuucagauuuagggcguggcauugagaucauuagaaaguaaguugugggcaguaaaaacaaugaagagaagaaaggagaggaacaacuauccugcugguacaccuugcccuuucuuuucuuuuccccaucccaauuucugcuuuucaucauucuaguuaacaacaacaacuugguguggggagcaggaaauagacaaugaggaagcuauaacucucuccccauacucaauaaugaugaggaucuguugaacccccagccccuuuuaaaaaucacaauuuuucaucucaaauccagcuccaguuguuuugccccuuuccgaccccaagccucagcucuggcuucucagcaccugcacucuggagagccucugccaauggcucauagcuuggcugucuuauccuuccugccaggguuuugagacaggaaugaguuccaagcagcugacuuacaaaaggacauuuguaacacaaccuguucuuaauauggagacuauauuuauaaaaaaaaaaauucaccuucaaaggauaaaaauuagucuacuaucgaaggucuuuuuugaaaaauauaguaagggcugagaucaaaauuuugagagacauucuaaaaauguuuugaguaaugauacaauugguaaaguauuuacccucucaggcugauugcuuucaaaaauggagugucuuuuuaa

SEQ ID NO: 16056 - RNA, 2296 nt, Homo sapiens
auuaugaaauacugcuuaaacuugcagcucuaccagagaacaaauuauucuuugaacaagaaaauuauuucuuaguguuuucccucuagccuucugaaauguggaccaauauuacugcagggaaacuuuucaguguauugggauuuuagcacgggcuuucugcugaaguauacaauuuuucauggcuuauuuuuacaccucauaaaauauuuugaucuguuuuccuaaacugaccauggaagaccugaguagcuguccucaccgacuuuuccggagacccuuucucacuagagaagagcugagaaagcugaccuggucuguaauggucugagaugcuugaaaaaucaacuugggaguaaaagguacagguuuucuugggccaacuuuggaccacucuugugacucucaauguagaggaaguugccauggaaaacaaucauuuaaaagacacacuguucuuuugggagauggugaucaagaggaaagucguauauauuuucuuacaugcuacugaaggacugacucauuuuugauaacccguauuugcccaagaaucugguauacucgaguuuuuggcuaaagggaagcaaacuaguaaccugcccaagaugcuggcagaacuucagccuugggaaaauguugaggucuccaggacucucaacucuaaccccaaacuucaugcuugcugaagacacagcaauaauacuggaagggcuggccagcugccaagagaacauuccugucacccugauuuuaagaguaaaacagacaaaugaaguuggugacuucaggucuaaugauugaccacagccaaagucacuuuggauuuuucuucuaaagauaagaaaaacuacugggaagaugagacauucuuucggucugaucuacaggaggaauuguguuuccagacggcaauguagcuuugcuccccugcuggagaggagaaaaauaaguaauaggguuugugugaacugggcagaaaauaagggccugaggacccaggcugacgaauggugagcagaggagggcaugaagugggcuucugcugaaggugcgguggaaaggcugcgcaucucuccggcugaccuuacugcugcaauuugcacggaugugaaaugaaauacaagcagguaggcgaacccgcugaggccacugacagccaugugacagccuaccagucagggugaaaugucuccaaggcagugacaagagcuguaacagggaauauuuucaccaauaagagaagcuaaggaccuaggacagacuccaggcaagcucucugauggaaauacaaaaagggauggcuuugcucucuucugcccucauuuuuucccaucuccauuguuaguccugccaacagaaggcagugggcuuacagacauggguugaauuauucagcuguugauuuugaauagaaaaacacugugaaagaaaauaaucaugaaaaauguguuuacgaggaagacuugggauauuuuucaucaauaaagcaucaagaagcgauuucagauuauauaccagggaauggagcaaauaugacucagguucuguaacuuuuagaacuagcugucuccccaaauaccaugagauuucauucaguggugauugcaaccuggcauuuuuacagagaucuaaacuuuuucaggguacguuugcauaauucuuucauuuaagguguguuacaacccugcacaguuugaagggcccauauuauuauuccccuaggauagaugaucaaacugaaacucauaaaggccccacagacuugcucaaggucacauacccaguuaaagguagcccuagggcuggaacccaggccuccauucucuuagcuguuuucaugucaucacacaaugcuaccucuguuucagcauaauaacaucuccugcuuugaccuggaccaguuuguagauaacccagccuuucagagaaacaugcuggagcuuccucugugggaauuccagcauaucuugguguucagaaaggcagcuagaugcuaagagugggaggaggcuuauacugcuccuuuccaagagggacaggauaguuugaacagacuugcaaggggaacguuuccucuucaaaaucuuuguuuuguaaaaauagacgccauuugguagcagccuaguguagagauaauuagaguggcuugaauaaauugagcuccucucagguaguuuuauuucuccaacacuaugcuuaaagaguuuuaaaugaccaagauuucucaaaauauuauuaaguaggaaaugagcaaauacaauuccaacuacuuuuaugaauccaauauuguaau

SEQ ID NO: 16057 - RNA, 396 nt, Homo sapiens
ccuuccgccacggccgccauggagagcagcagccauggcucugcgcuaccuuauggccgugggccucaacaagggccacaaggugaccaagaacgugagcaagcccaggcacagccgccgccgcgggcgucugagcaaacgcaccaaguuuguagcgggacaugauccgggagguguguggcuucgcuucguacgagcugcgcgccauggagucacugaaggucuucaaggagaaaugggcccucaaguucaucaagaaaaggguggggacgcacauccgugccaagaggaagcgggaggagcugagcaagguacuggcugccaugaggaaagccgcugccaagaaagacugagcccccuccccugcccucuuccugaaauaaagaacagcuugac

SEQ ID NO: 16058 - RNA, 594 nt, Homo sapiens
aaugguucgcuacucacuugacccggagaaccccacgaaaucaugcaaaucaagagguuccaaucuucguguucacuuuaagaacacucgugaaacugcucaggccaucaaggguaugcauauacaaaaagccacgaaguaucugaaagaugucacuuuacagaaacaguguguaccauuccgacguuacaaugguggaguuggcaggugugcgcaggccaagcaguggggcuggacacaaggucgguggcccaaaaagagugcugaauuuuugcugcacaugcuuaaaaacacagagaguaaugcugaacuuaaggguuuagauguagauucucuggucauugagcauauccaagugaacaaagcaccuaagaugcgccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaaaggaaaaaua

SEQ ID NO: 16059 - RNA, 81608 nt, Homo sapiens
cauugugacgucacggucagcccacguucugauuguagauagccggcgccuuccucuucccaucgcgcggguccuagccaccggugucuccuucuacauccgccucugcgccggcugccacccgcgcucccuccgccgccgccgccuugcugcugcucaaagcugcugccgccccuugggcuaaaagguaaagccgucagcuccgggaaacuucgucgggggccgccgcucggccaugacacccgcgcgagcgcgcggccgggaagcggucagagagaacugccguuaggucucggaccuggugccgagaaagagcugccggggcaacccgcgcuccgcccgcggccuccagcuccgccggcuccgggguacagcccggcuccucgggcgcggggaaaggggugcgggugcgggcgcgggcggcucgccccacgccgaggcugaggcagggcgcucgggagcguucucugugcugcggucccaccugugcgcgcugacaggcgccgcggggcacgacaccgugcccacaccagacgcggagggauggaucuguccgccuggguccucccgcccugcgggccggagcgcgcggcgggagagccgggggagcgcucucggagggagcgcgcuuucuuuggagucggcgaaacccgggugaguucgaagagccugugcgagggucugcgggcaccgggcgccgcuggggggacucuccggccuuuccuuuuuguccuguucucuccgcuuccguuaacccugcggaccuuccguccgccccucggagggaagccugcuagcucgggaccgcuucaguuuuuauugaaaccagacaacggcagcccuugguacucagggagggaugaggcuggugggaaagcgagagggcggggacucgggggcgaccggggcggcccuuucugggagccugaucccuggagaggcgggagcgguuggcugcgagggaggcgcgcggcgggggggcgguugugcucugcgccgggggagcuagaguguguguugucuugcgaguuguaaggaaaagugccuuuuuacuguuuccacgccgguaagacucucccaccccaccaccucgggucgacggagcaaugccuagagcaagaguuguucuugcugaacugcgucuugcaaccguuccguguucuugcacuuggcgguuccccccgccccauccacaauugugaauuaagcuccuugauugcaaauuuggagaaugcauuuggccaguuaugcaaaguggcggagguggcggggucgggggcggggggucucuuucggaagaauccagugcaugguuuauuagcuagacugaggaaccgagaggugcuagaugggauuuguggggagcgagcagccuaauuuguuuuaaauagcgggacccguggcaggaagugcuucauagaauuguacggaagagcugauguugcuugucagguuuuguaacucauucuccuaaccgcuuggcagauaaccuguuggucugcacuuguuuugcuugcacgucucagccaaaagcauuucgugcagaaucuacagauagaaacaggcgguuuugcauuagauggccguggacaaacauuuuagccuuccaucugugauuggggacaaguggguuacuuuucugguagcucagacacugccugggauucuccaggaaagcucugcacuugaaagggaaauguuacucauuuuccuuuuagauuuuuacccuagauucuaacuucuuauugccaggaacuuuuucuguacuguuucucuuuuugcauuuucguuucuauuucuaauugaagacaaaggggaaauuuuuauugauaguuacagauagguaauguuacagaauguaguacagaacuuugcugaaaagcgacaguagaaggcuuacuaaaauuugauguuuuucaagaaaaauaucuuguaacuucagauauugaccucaccuccuugacucaauuuccuugucuauacauggggauuuuauguggcaggaucauuguggauuucaagagauaaugcaaaugagagcccagcauugagucugccaaauggugguuugaaaauguuuccuucccauucccugaaaucaacagcuucuucuugguuacagaccuuaauuuuuggauguucuguuugcaagaaucuuuuuuuccacuaccucuucuuuugcucccugcauaaugguugcuugucuuccugcuucuagaggugagcauccauccuugggugucuuauuuccagcuugaauuacacaaaucaaagcaaaacuguuuacuuuucuugaggguaacuuuggugccuagguggguaguuagugugaagagagaguuuuaccucuugcuuuccuggcuacauucuucucuccuaaaagauuuuguaauuuuuuuuuuuaauuccuccucuuugccuaccagcucuucuguuaucaaaaggcuaauccucucauuaguuaccuguaaauaagucuuuccuugaaugcuuucugugucagguacuuauuaauacgcacauguacauaaacgguugcuuuccacacguaauucuuauaacaccucugugagguuuuaucccccaguuguuuuuuaagaauugaggagcacuaugaagacacaugcacacguauguuuauugcagcaccauuuacaauagcaaagacuuggaaccaacucaaaugcccaucaaugauagacuggauaaagaaaauguggcacauauacaccauggaauacuaugcagccauaaaaaagaugaguucgugucuuuugcagggacauggaugaagcuggaaaccaucauccucagcagacuaacacaggaacagaaaaccaaacacugcauauucucacucauaagugggagucgaacagugagaacacauggacacagggagggaaacaucacacacccgggccuaucgggugguggggggcaaggggagggagagcauuaggacaaauuccuaaugcacgcagggcuuaaaaccuagaugauggguugauaggugcaggaaaccagcauggcacauguauaccuauguaacaaacaugcacguucagcacauguaucgcauaacuuaaaguggaagaaaaauaaaaaagaaucucuaggauuaaggccuagagaugacaagugacuuguccaaauuccuauagcucugucuccugcaacaucucugcuccuucauauaucccugugcugccaggauuauuugcccagugggcucugugccauuauguaacacuguuacuccacaacuuaaaaaucuaaccuuguguuuaaagguucuuguuaauccauccaagacuaacaauuuauugucucuuaaaucugucuaaaaucuguucccuuccuuguagcccacacuugauucauuuuuuaaauuaauucauugacuucucaguuacugauuuugggugugaggggcuggauacaaaaaugaauuacaacaguuccugauuccagaggguuuccugauuuaguauauacuuuaagccuguauacacauacuuaaucuacaccuuggaccaaaagagagucagaagcagauuucugggacacuuauaucuuuauaucugagaaagcuuuauggcagagcuauccauguuaagggccuagcauuccugaauuggucaggaugcuuuuggugcaagaaacagaaaacccaacugagaccuaccugugcaucugaccugaaaaguccugagggcaggacuuuugcuccauuucucugaaguccccucagaugucuguuauguccuagacugauuuuccaagaugacugacagcagcugccaccauaaucucacauggggauucccugacuuccugccacccuccaaagaguccuuuaccuuaaggugauugacuuaggccuugguuacuugaagcaauaacuggaacaguggacauuugauaagcugggggcccaucccagaaccagggaagugaaguuaaaucuccucagcuagcugcuucaccuuuaagaagggccugcagaacacaggaagucagcuacagcgucuguuuuaaggaccgaauggaugauuggauuaaacuaaauugacuugaauuaaaauuagaauuuagccuuacauuuuguaaaggacucuuaguugauaggcaggaauaggaggacaugcguucuaggcaagagggaguuuggagaguaagcgaguguggaaucauugggcaaaaagcaaauagcacaauuggcagaagcugguuuagaaggcaggaguggaagaaaaggugagaaaggcaaguuauugauguaauaauaauggcuaacucuuacugagcuauuguaugucagaccuugcacugagccccucacaaggacuuauuucuauuauuaauggaugcuacagcauucccauuuuacagguggaaaaaggcccagaguuuagacacuugauuuggggucacaaagcauuccagcucagaucaccuugacacccuggccugcuccgucuccuaagguguuugguagaauaccaccaauaagcuuuugaauaagaaugaggacauuaugagugcugugcuccagaaagacagucuuguuagaguguaggguggauuguuguggguuuguuagagauggccagggcagugaaaaggccugaccugaagccacagccaugagcacagacuugagagagguaauugugagagacuguguccaggauaagacuugaagaccaguuggauuugagggccagcaagaggagggauacucuuccaaagagaagagggagcuuugugaucagauggaaauagccccacagccuagauagauauccagacuagcuguuucuuccaauuccuccucuucacggccaaccuuugucuuagcuauuuuuuugguugccuuucugcaagaacauguuucuaccacauuucaucuauugucagcuuuucacauuucacaucuggguagagauggagcuuauaaucaguggcaucuuaaaaucacugcagguaacuuuccacauuuuaauauuacagaauugggaugccuccuacacuuuucccuggugagaaaaggaaagccccaauguuaccaaagguggugcagccagaugcuggcagagccaggcuucugggcuucuuccaccagcuggguuaccucugcucccaugauaguuauuaaaacacauguagcuucacguuacagguuuauaguaaaguacauacauguuuguguguuuauuaaaacugaaguaauuugagaagauuggaaggcaugauuguuuaaguagggugccucauucuuguauagaaucuggcugccuugguuucuuguccuaacuugaagaaaaucaacucugagcauuggucucuuuuccuuuaaaaugaaagauuaaauuuuauuuucauuuuugccuagagcaaauuuuauuuuuuauuuuuguuuuguuucuguuuggccagggauagagaaugaaagugagaucauuuagaucuuagaaagguagauguuggcugggcacgguggcucacaccuguaaucccagcacuuugggaagccauggugggcagaucauuugagcucaggaguuugcaaccagccugggcaauauggcaagaccccaucuguacaaaaaauacaaaaauuagcuggauguggugguacaugccuguagucccagcuccuugggaggcugaggugggaggaugacuucaguccaggaggcggagguuacagugagccgugauuacaccacugcacuccggccugggugacagagccagacucugucccaaaauaaauaaagaaagaaggaaaggagggagggagggagggaaaaugucagaacaguugauggagauugcagcagcagcagcaagcugcugguuuucucuuuaugagauuaaaacaucacugcuggagauguucuggccuauccugaccugauuuucaguuucugcaauaggaacccucaccaccaaccccaguuucaacccguaaauguuauuaccagccuuuuugguucccacuggcguguuugcuccaugguaacauuuuuaguggacuuguaggcauucacuuuuagaauuguguagucucuggauuuaaaauauucauacuuggugaccuuuuagaaagacuaaauucccacucuugcuccuccauccucuucugccaguucugugugaaguacaguuguaauugcauucaggcaugaguaugucuuaguauuccuuauuauuagauuggacuuuuuuaccuuuuauuugaugucugcuggcugacugggauuuagggaaaaauuucugauuuauuuuaagauuuuuagugcugauacuggcaugcuuucucuaauugggagaauaacaauuuuauugaaauauaccugugauuuuaaacuguaaucuuuaugguuauauuagguaggcacccucuugcgagcacagguuccaucucuguuaaguuccacauuuaccccauccuuuuccucaugucaacaauuucauccugucagaauuaaucucuuauaagcccaugcugaacagaccuaauugaagccaugcuggcgaauuggccacucaggucuguguuuuaugaguuucugaaccccagaguaguacuuguuccucuuuggucuuggcacagcaaaugcuacaacaaagugaguguuaugaauuucuccuucccugaagaauaguucucaugauaccaaauucaguaauuauucauuugcuuccaggggaguuugaaaugugauguaucucccuagggguaguauucaggguacuucugcuucagucuuuggcagaagaaauaauacuucaauauuuacagaagucguugacgccuccaucagcuguauuuguuagaagcaucugugugaaaauuugaguuugcuucuguccgaacuucugcauauuaaucucugugauggaucugaggugcauuuaaaagaauaccuccuguacuucuuuuaaguaaggacagcugugggaagcagauuggguuggcagccugcaccuaugcgggguuccaccucugccacuuaacagcugcgugggcuucagcagguaagucacucuaccuccuugagacccuagaaucuauguagaacuuggaaggugauaauccugugccuacuuuggaggguauuaaaacuaucaguauuguacaugaaaguuagguggggcacugacuuaauuuaauuagcauaguaaaaacgucucucuguuauauaggauguuuauugaagcauuguuucuaauagcaaaagauuggaagaguuaguagacuaaauguccuugaaaagaauaaaucaugcuacagcugggcaacggaauauucugcaaauuuuaaagagaacaaagcuguucuauggguacugaauauagcugcuugguaccacauaauaggcacuuuucugaaguguucaacauguauuaauucauuguggcuucacaaaagcccacgagguagggaccccaauuuuacagaugaggaaacuaagauaaagguuaagucacuuguccaaauauccacagcuaguagguggcagaggcaggauucaaacccaggcagauuggcuuaaagacucuaaucuuggccacccugcugugcuguacaccugucagaccuaaguagugaucuuuguauuugcagcuuuagauacaugagaggaaacaagguugaguuucuuauucaucguuacauucugggaggcugacgguauaaucaacauauagcuucuguugacaguaacuaaauaaagguuuagauaaagaaagcuaauagggaauaacauuuaugaucaauacuugaaagggugaccguuuguuucuuccauuacuccuuauuuuagauauuuugaacuuaaaccucuuuuuuggggaaaaucagaagcguacacacugaauagcuuacaauuguuaguguaagaaaucaguguucaaaagcccaguugagucaguguucacuagccugacuggucuaguguggcuggauuaguaugacuggccaagggcauccagcauugguuuccuuacccgguccuagccccaucugguuugauuuacaagguauauacgcucagagaaaugcagacgggagggaaagacacucacauucuuuagggagccucuaucuccagauugccugaucucccuugggugaaaauguaagucagguguacaagucguacaagucauguauagcuugacaaugggaauacuuuuugagaaauguacucuuaggcaauuuuguuguuguguguucaucauagaguguacuuagacaaaccuagaugguuaccacauacauagggcauaugauauaccacauugcuccuaggcuacaaaccuguacagcaaguuacuguacugaauacuguagcuagcuguaacacaguggcaaguaucuguauaucuaaaugaagaaaagauauaguaaaaauauaaaagauaaaaaaugauacaacuauguagggcacuugccaugaauggagcuugcaggacuggaaguugcucuggguaagucagugaguggggagugaaugugaaggccuaggacuuuacuguacacucuagacuuuauaaacacuguauacuuaggcuacauuagguuuauaaaaaauauuuuuugauuaggugugguggcucaugucuguaaucucagcacuuugugagguugaggugggaccaggcauuuaagaccagccugggcaauaucacaagacuccaucucuacuuauuuauaauaaaaguuuuuuuaaaaauauguauuauuuuaauauauauuuuucuuccuuaauacauaaacuguagcuuauuguaacauuucuauuuuauaaauuuuuuaaacuuuuuuacucuuuuguaauaauacuuagcuuaaaacacaggcuguauggcugcaaaaaaaauauuuuauuucuucguauccuuauucuucaagcuuuuuuucuccuuuuaaaguuuuuuaaacuuuuuuguuaaaaacuaaaacaaacauacacauuagccuaggucuguacaggggcaggaucaucaaugucaccgucuuccaucuccacaucuugucccacugaaaggucuguaggagcaguaacacacaugagcugucauuuccuaugacaacaaugccuucuucuggaauaccuccugaaggaccuaucugaagcuguuucauaguuaacuuuuuaaaauauguaauuagaagguguacacucaauuaaugauaaaaaaguauaguauaccaaauacauaaaccaaugacauaguucuuuaucaucagcaucaagcauuauguacuguccauaauuuuaugugugauacuguuacaggucuagcuaugcaguagguuuauuuacaccaacaucaccacaaauguuuuauugugcuaugaugucacuaggcaauaggaguuuuucagcuccauuauaauguuacaggaguaucauuguauaugugguccauuguugauuuaaaggucauuaugcgaugcgugacuauauuuugaaaacauucugauagagaaugacauuaagucauuuugauacaaggccccauuaagggccacugugcugggccaugguguucaggcuauagacaagucugccaccaccuucaguucucuuaggauccuuagacucuuucagaacugaguuuucuuucugggugugggacacuagguuuggcaacauuguaauggcuauaaguaucagcauuccuaaaauaagagaaucacaaaauucaugggguggcuuauauauucacauggaaucugaacaggugauaaaacaacuguugguuucagagacaugcuauagaggagaugaauacacaguugcuagacugugugucccuuugaaaaaugcuguauuguagcaggauuuucccccauuuuuuacacauuuaacuuugcuucucccucuccucacucacccucacacccaaacaacaguuauaaaaugugggcguguagauugaguuuuaaaaaagaaauguguuuuuguguuauaugccuuauuuauguuacacaggcuugaauuaaaaucuuuuaagacauuuucguuugggggguugcauaacuaaucuuuauuauguuucuccaccgucuuuuaauuucagcuuaagguaucacugccuuuguauacuuugcacaaauuagguuggagaacucaauugauaauuuccucaaaugauaauuuauuuugaauauucaaguaaucacaucaguuaagagacugcacucagauaagaaccaucagcaguugccuguagcagaaaauguugcuuaaaagccuuuugaauauuugucucccuguuauuugcaauugcagucuuuugguuuagauguuuagaauaugauugaaguagagcccagacugcuuaagcucaggcuuuaagggaaccauuagaggcguguguaguaucuuggugucuguuaccuaccuuggccauugauugucuucucuacaagaugcuucauccaagaaggaaguugcccuuugaaacaggugcccuuugagcuucuccagagagacccauaaagacauuaucccaggaccucauguuucuaggagaaugugauaaauauugugaugguuucauuuucagagcagcugccuuuucuuccuuuugcaaggaguaggaacaaaagcagcuucuuuuuguuuccuuugcaagggcuuagaauaggcucagugugacccaagggaaguuggaugugacaagugacaguaagguaaguacuuuucauugacccccugguacagaguucaggcuugaacuuaccaucuuuuuaagaaaugggacuggcguauuaaauuuaaaauguaggcaaacaguugcaaaguacugucagaagaccaaaucucauugcaugaucuacuugccccauggauucaaauauccauccacccacccaccauccacccuuagauauuuauuucuagcccaucuauuucuuuugagcuccagacucauaacuuuucaucguugggugccccacauaccuccccuguuggccaacguagucaggagcaccauccuccgccaguuugcccaagccauuaagcuggaagcaaugcuuguguucuccucucucaucaaccaugcuuuuaccaaacuuugcucaacugucagucaccaaguauuacucauucauacucucuguccuucuaagcuuauuccccuuccccacauugccccagccuuccauagcaugucagauccuuccuggacaacuacaauuucuccuuggcuccuugccucuguuuucuugauuccuaaaaauuagaugagguuguaccuguauagugcuuugcauagugucugccauguuuaucuggcacauaguguagguaucuagcaauuacgugccugaauguuucucuaaauacauauguaccuuucaaauauaaccaguccuauaauaugugcuaauggcugugugaagcugaguaugccuugauagccugagaauacauaauguuucacaaaugaagagcuuaccugggcaggagacuuuagaaggccaguugccuugcuuccagcugaaggaguagaacaccagcagcucucagaccauacaaauugcuagacaccuuuuccuguuguggcauggugcaaugaggagcucuuaccuaugccuggagacaugccaucuaaggacucguuggcugcagucugugcagaucuucacauacaaggagauggccauagcuguggugcucugcagauguggcaguggcuucaucaggaugaacgaggggccccuggagaugaucaagcugcucacacugcaauacaagcuacuggaauuaggucugcuucuggacaaggaacagcuugcuggaauggacauccauguucgugugaaggguaguggucaugugguucagauuuaugcuguccuucaguacaucuccaaagcccugguacccuguuacccaaaauauguagaugaggcuuccgaggagaucaaagacacccucaccagaccuugcuggugguucaccccuguugcuaugaauccaagaaauuugcaggcccuggugccugugcucacuaccagaaaucauagcaguaagcccaucaaaaagaucaagguuuaccuuuauaguaaacaaugguugaaggucuuuaagguuaaaaaaaauugcuagacaucccagcugcccuagaagcagagaugacaugugcuguuauuuuaaagggccuugcuuaccugcauauuaccuguuagggcuuucagguagaauauaccaaugauagaccagucugguggcacuguucccaaggacggaauagggugaacuuugaugucuaggcacucaaauacuccauaauaaaaugaucauggaaacuggcagucuuacuccaauugcccaggauggagugcaguggcaccaucucagcucauugcagccucaaauuucccaggcccaggugucccuccuacuucagccuccugcauagcugggacuacaggcaagcaccaccaugcccagcuaauuuuuuauauuuuugguagagacaagguuucaccguguugcccaggcuggucuugaauuccuaggcucaagcagucugccugcuucagccucccaaaauccugagauuacaggugugagccauugugccuggccuggcccucuuauuuaaccuuguuuugguuggcagcaacauugagcccaggcuaaaguacaccauacaugucggacagagcuuaucugccucaguagccacuuggucaguauuuguugaucacuuaaacccacucaguguuggucauuugucuguguuagccucugcuaaggaauguggacccuacacgugacaauacaguuaccaguaaaaagacucaguaggaauuaugagguauauacucgaaucaacagguaguuuauuauuauacuacggguauggcuguguauguugcaguuagguucagcugcagcgauggacaugccaaaauaauagugguuugaauaaugguaucccaaaacaaaguagaaguguguaucucuuaugaaaggcaggguggaugguucagggcuaguaugacccugcguaaauuccuugcucaucauacgucugucaggcuuaguguggccucagucuuccgagcagcaggauguaagaagaaacagaaaguagaagcgcggauggugcuuucuuuuaugggaaguucccagaaacagccuccagauaacuuugcuuacaucucauuggcuagaacaucaccccguggcugcagguggcuggaaaaucucaucuuuauucuggguggccaugugcagcuaaaaguacugcuacuguuuauagaguuugggcaagaaccggcugucugugccaugggugguagacgagaccagcaguccccacucacuuggaacugagagucugggggaaggauagugacaaaauaaacagauacuuacagugacaaggccucugagaggucugcaaaggugugcccugcgaguaaacaggaaggacaccuaaaucagacugguggggugggggaggggaugaggaaacguugccuagagacuaagcaagaaucucucuggacugaggaaaugggcaggguauugaagcaaaggcucggaggcaaagggggcagguaguugggugauggaggagcauaugaggaacagaaaguagaccagggaagccagagggagacaggguucugaucacaugggcccuggggccacagggacagguuuggucauuuuccccggagccuuugacugguuucuggaggugaguaaccuagacaggugcuuucagggggugaggagcagcacaagacuagaggcaggaaauauccacugggagagaguguacuaaucugguugggaaaugaugguggcuucagcuacauaguggcuuuggggaucaagagaaguggaugcaaauccuguaaaucccauagagcuuggaauuuagaaauaauuuggccuuuucacguaauaggugaugaaaccaagaaugagaauuuaaauggcuugcccagaaucacacagcuagcuguggagcagcaccagauaucauuucucuaucuaacucuuuccuuuaugucacuguugaaugugcugauuugggagaacagggcauugugggcauuuuggagccagcaacaggaccugaauccugguguccauugcagagggaggaguccacccugcuuugggggcuggauuccugguaagguuauggggcaggucacagaaaugagggaguuggaaggaaaaaccaggugugagaagaugauggauucaguuuuugguuuguugauuuggagauucaggaccaccaucuguagguggagagagaucagauggaaacugguccuugagauuggaauuggggaugcaggauuggguggaauuggucaaaacuuuucuauacccuuucuuuaaauuucuccagugaaagggacucagcaacuguuuuugaguccauugugucauguaccuuagaauuaagagauuuuuccaguguuuagcccugaaugauuuuugcugcaauuugaauucugugcaaccacagagauuuaauaaaaauaaaauagguuaauacuuaaaaauuaguaaauuaaaauaaauuaaguaaagauaaaaguuauauggcccucccuugcauauuuuacccugugcugcaggucuucucaggagccucucuggcucugguuggucucuugguccaggcuguggccucugucucuuggguuuucauacuguaagauuucuccaacugaguuugggaggcugaagccccaaacagaacuugauggcuugugcuggaaaaggggaaauggguucugcuugcuacaacguguuaaauucuguuuuuaaaaugucaguuuggcaucaaacacuuuuuuagacauguuuacauccuaaaaguuuuugguuucagaaguuuuuuguccuucacaauuaacuugguugcagugauuaaaguauagccuauuuccugggaaauaggagacaauuucagagccacuauagaccauauugacauuagagauuguaggauaccauagacagggaggucaauagacaggcaacgugguaucauaguuguuuuaucucucccuggucacuguccuucuaccuaauguuguuucaccguggaauuugagcuuacaggugaaaaagacuuucagugaauacugcaccaaguauaauuuaaaaauuuuaaauccuauauagauauggggcaugacuaauagaguaaugacuuccauaaaccacacaugaaaacugcuuuaauuauaauuaucauuacuuuuauucuccagaaagggaaauaagguuaaaacaagagagcccauucauucuaaguugaccaguuaaauuucuuguucucccuucccuuuguccuuugauuugauaaaaauaagauuuuugugugcuaaauugugaguauucauuuacauuaaucaguaucccuauaagacaaagccccugaaaacauaaacugagugcagcacgauuuaaaacagagagggaggagacagucuugguccuguucuuggugcccugcucauuacuaacgucucaguuguacuguccacuauaaacagucaugauuuuuucccccauucuucagaucaagucaguuuccucuaaugagacagucuaccugguuuuauaggcauuucucuguaauguuuuccaaacgaagaaagcaaacagcaagcauuuuguugggagaaaucugcaagugucuguucuguggcugugaacuaaugaucuuucagaggucuaguuuaaaagcacugaguuucuucaugacccaugaggauauguaauccaccuuuauagcagguaaguguugagguucacacaggauuaacacucucuuuaacacuguucucuacaccguucucuugcaaagggauacucuucccaacccugaaaggcaugcuuggagagguggagugucacucccagauucuuauuuuagagaagggagugucauguaauuuucucccuaccuuauuuauucauucucuccccucucccccuugcugaccugcuuuucuuccuucagccaggucuucgcuuuaaggagucagcugagcuucagccacugaugcugggggcacauaguggcccaagccacccuguagcuguacccuuuuggggaggguggcuuucguguuuuuguaaaguuuuugaagaaccucuuacaugauacaguuugaacugauuagcaaacagagccaaagaaacuaguaccugaugaaaacugacugacaugguaggcaaauggaaaguuugguuuccaaaaaguguguguuguggcaaguugaagucagaaaaaugaauuuuugacuuugauucugagugaucacuccucuacgcacuccccuuucucuuucucuccuuguccucuccauuucacucccucuccauucucucuccgccucuuuucccuccuccugcuccguucuguguauauguuuguauguauaacacuucagcauuuauguagugguugauaauugaauacauucuauuugcaguacuaccuaaugugauuuaaccacaggaaacuugcuucucucauuauuuaugauuuuaaauuuuaguuuuugguaauuaagucuccaugaggagcguccucauuuggaaggagaguuagcaucaugcuguggcuaaagaaacucaguuuuuaugccuaccaauaaugugaaaaucaccucacuccuguuuggcugauuggguugaauuucucuuaauaccauacugaauguaacuugacgaguuaguagggaacugguaacaacuuauuucacagaguauuucuaguuauugauguaguuuggguguuuguccccuccaaaucucaugugaaaauuucauccccaguguuugagguggggccuacucggagguguuugggucauggagacgaaucccucaugagugacuuggugccaucucaugguaaagaguucaaugugagaucugguuguguaaaagagccuggcaucucucucuugcucuucuuugucuugcuuccucucucaccaugugacacucuuggucccccuucaccuuucacagugaguaaaagcuuccugaggccccaccagaagcagaugcuggcacugugcugcuugugcagucugcagaacugugagcuaaaauaaaccucuuuauaaauuacccugucucagauauuccuuuauagcaacaccaaacggacuaauacaguuacaauauauuuaguguaagauuuauucauuauaauuagcuuauuuccaaaaugaccauuuuaacaaacuucaaauauuuugaguguuagauuuuuaaacucgguguacuccaaguuucauuuaacugcuaaaggacaaguuuagucauacacugcauaaccauauuuuggucagugaugaacugccuauauaaugguggucccauaagauuauaauggaacugaaaaauuccucuugccuggugaaguaggggucaucuuaauguccuagggcaguguauuacuuauguguuuguggagauguugguguaaaccuacugcacugcuaauucuauaaaaguaucacacauacaauuacguaccauauacagugcuugauagggauaauaaacaacuauguuacugguuuuuguauuuacuguacuuuuuaucauuuaaaaaauuuuuauuuauuuauuuuggaaauggggucucgcucugucauucaugcuggagugcagugguguaaucacagcucacugcaggcuugauuuccugggcucaugcaguccucccaccucagcuuccaaguagcugggaccacagguauguaccaccaugccuggcuuuuuaaauuuuuuguugagauggggucccacuguguugcccaggcagaucuucaacuccugggcuccagcaguccuuccaccucggucucccaaaauguugguauuacaggcaugagccacugccugucauuauuuuaaagaguacuccuacuuaaccaaaaaauaaaguuaauugugaaacagcuuccggcaggucuuucaggagguauuccugaagaaaacauuguuaucacauguuauugccccugaaggccuuccagugggacaagauguagaagggaagacagugauauugaagauccugaguaggccuaggcuaauguguguguuucugucuuaguguuuaaggaaaaaaaaaguuuuaaaagaaaaauuaauagaaaaaagcuuacagaaugaguauaaagaaaauaauuuuuaugcagcuguacaauguauuuguguuguguuaauuacaaaagagucaaaaguuaaaauguaaaagucuguaaaacucaugaacaguggcaugcaccuguagucccagcuacucgggaggcugaagaggcaggaucacuugaggucaggaguucgaggcugcagugagcuaugauuacaccuguggauagccccacugggcaacauagacucugucccuaaaaaaaaaaaaaaaaaaaaaaaaguuuauaaagaaaaaaauguuaccauaaacuaagguuaauuuauuauugaggaagaaaaaauuuuaaaauaaauuuaguguagccucagcauaguguuuagccucaauguaguauuuauaaugucuacagugugcaguaauguccuaggccuucauagucauucaccacucauugacucauccagagcaacgucuauucaugguaagugcccuguacagguguauugguuuuuauuuuuuauauucuauuuuuauuauaccuuuucuuuguugagcuauacaaauacuugccacuguguuaugguuaccuacaguauucaguauaguaacaugccaaacagguuaauuguagccuaggagcaauagguuguaccauauagccugcauguguaguaggccauacaucuagguuuguguaaauacacucuaugauguucucaugaugaaaucgcccagugacauauuucuaagaauguauugccauuguuaagugacgcgucuguagaaguucuuuauuuuuaaaguguauuuggguuauuugccauuaagauaagaagcuaaauauauaaugucuuuuuagaaauaaaaucguacagaagaggaaaauucuacgugcaguuuuuaauacaacagcucucaaacuuuuuggucugaagacacacuauucucucuuuuuuauuucuuauuuuuuucugagacgaagucuugcucuugucccccaggcugagugcgauggcaugauuuugacucacugcaaccucugccuucugaguuccagcaauucuccugccucagccucccaaguagcugggauuacaggugccuacuaccaugcccggcuaauuuuucuauuuuuaguagagacgggguuucaccguguuggccaggcuggucucgaacuccugaccucaggugauccacccgccucagccuuccaaagucuugggauuacaggcaugaaccacugcaccugaccgacauaguauucuuagacaaaguggcuugagagaaaaacauuuaaaaaagcaaaaggaaaaaaagauaagauuugcgcuauuaaauguuacugagaaacucaaagagcuuuuguuuauguggauuauaucuauuaguauuuaccuuauuagaaaccaauuuuaaauuguuuuaaaauauagguuuaaaacaauuaugaaaacauuuaaaaauaacuaaccuacuguaugauaauaaaguauauauuuuucaaaauauauuucaaaauauaaaaacguauuuuucaaaacuuuuggugacagugaaaaaguaaucucguaguagcaguagcaguagcaguagcaguaguaguaguaguaguuaguuauacuuuauauauauaguacuaaaaguacuuuauauacuacuuaguuauaaaaacauuuuuccuucuugcuucagcagccauugccuccuguuuccuucugccuaaauaaauucuguguuuuaugccacaggcucuaugugugucaccuucacaugugaacuucaccaggugggcugguuuuggucuuuuuaucaaaugaacauaucuguaagguacuuuuuguagacaggacaguauuuaaaagcaagcuuauguccacuuaacaacacugguugcuugcuuuagugcucugugguaaggcuguaguggucaguuuuuaaaguaaaaacccaaaacaacaaggaguaaacgaagagauuaaggucucaguguagcauuaauagcuuuuuagauguucauuuuauuuuuuuuaauucaucccuuucucuuugcuaucuauacauuacaguauuuaggcuuccagacuagcaaccuuuuggaauaguuuuaaaauagcugauuucuuuuuuguuccugucucuuggauagauacugcuugaccuuuuuuuaacuguugauuuuggauaaugccuuuguuuuaauaaaaaauugcugcaucaugucccacaucuccaucuuguuuuauguaaccauuuaaccuuuaauucuauguguuacaaaaagauuuccucuggccuuuuguguauaaugucagaucaacuagagcucuacuuuggggacuguaaauagagcauuagccuccucuugauuuuacucuaaggaauucuuuuaagauuuuuauaaccucagauucuuugauaccugaaucagguaccaguacaguugagcuacuguauuuccagaugcucagauuuuuuuuaaugggauauauuuugcacuaucuaauauaguagucacuaacuacuacuaguuuuugagcauuugaaaugugguuaauacaacuaagaaacagaauuuuuaguuuuucauuucaguuuacuuaaauagcuauuugugcccuugucugucucauugggcagugcaaugccaaagguaucuggcaguuucuuuuuaaauuuguagguucauucauucauuuuaacaagaguguuuuuuuauaugugugguagccgguagguuuuuuacuaucugugguugucuuauugcuggaaacggaacuagagggauacaggagguggaaaaguggaggcuauugauaauuggcugacuuuuauggggucuugggaucauuguagaugagauuugaggggaaaauaaaguucagggaaggacuuuuagguugaacacuggagcugauuugucagcagaaaaaaagcauccagucgagagaggaaauggaagguaaaaggcagaugggagaugaauaaauucuugaaagaaacgggaaaagauccagaguauaagcagaacgauggaaagauacuguaugaauuggaagggugaagagggacuuuuaaaaaaaguuauuugaaauuuuucaauugaaguguaauuuacauuauauaagccauuuuuaaauguucaacucaguggcauuuaguacauccacaguguuguuugccacagucaccucuaauuccaaaacauuuucacauccccaaaggagaccacugccaguuagcagccacuugccauucuccccucuccugagccccugacaaccacccaucugcuuucugucucuguagauuugccuauucugaauauuuccuauaaauggaaucauacaauaugugaccucuuguaucuggcuucucucacuuagcauaauguuuucaaguuucauccaccccugcuguagcaugugaagagugaccauugaaggaggaggacuuuuaagggauucauagggacuguccagaucucagcaaaaccaucaauucugcuuguuggauuuaccuagcagugaggcaccacagggguagguugggcaucaggaguauuugugacuauagcuuccagccugaguaaggaggguggggacaaagaucugcuuuggugauggcagauugccuacuagggaaggcagacaggaggagugaguggauagaaacuugucagaagagggagcagaauauccuguuucaaaggauuuggguccauuugggguccuaaguuagagaaugcauguggaaacaugagcucaucuaaaguagggucaucucaucuguuuguaggucagcgucacccauaacugucugcugcacuagugguggacacacaguuucuaaaguugcaagcaaggugaaaaguucuguaaucuugcccugcuggguaauggugccaagcgccuguugugagugccuccugcucugcuggaagcauggugagggaaagcagaccuuggguuuuuuucugcuuucucgugaaggccgguauggcugagucaccguacuugcuggugccuagggcaaaacugcuuuccaggcugcuuuccagccucacagucaucccacagauacauaacgccucaaggacuuagauguuaaccacagguuaaauaauuuguauuuggaguaugauuagaauguacagagagggaccuaaccuagucuggggcucugcgggaggaaucagggaagauuucucuggugugcacagauagaggggaagugggacaggcggguaagggagcuuucccugcuugggagcugccggagucaaggacacacugcagaaugugaaaaggaaacgggugggguugggggcagugagcaagaggggacggcagaaguugggcuagggaaagcagguaugggccugggugugaaagggccucuaagccaagugagggauuguaggcuguauccagagagcaaggugacaaaaagcuucaggcaagaguggccccacugauuuuggugguuaaaaagaacucaggugcaauguggagguggauagaaggaggcaagaaugagugccugaaagccagcugggaguccacaggaaagaaaaugggccuugguggugcagcuaggaagagguggauauuuauaagaugcucaagacgauggcuucaacaggcuaagagaugacugaguuauucugauacccuacccuuucugucuacuguguccuuucacaccucuauaucucuucaugcugugccuucgcuugaauuauccaccaaccauugugccuccuaggccuuccacccugcaaaguccuuaauaaccuggccaaaugccacuugcaugaagucuucccugaugcucuguccagaguuaguucauuuaacaaauauuuauggagcauucacguuuuaaugugccuuaaaucauugcugacuugguuuucuggucgaguggaauguuuaacacaugccagccaauuaacauggcugcuuaauaaagucgagguaaaauuugagacacuuuuccggccuaccaagugucacaauucuucccagauuguggcagcccacuccugccuccacuucuugaguagcaauuuccuuauuucuuuccccugcuccuuggccugcccaaaccuaccagucuuuuaagugacaguggaagucccccuccucuggugaagccucucccuuugucccaagccuggaucuuccuccugagcaaagcccucagcccugugacucucugucucugacugggugcuagugggaaaucaacuuuucaugugagucuaguugcuucggucauucagaaacucucucaggcucacugcauccagaagagugcuuaugaauacuugacaggcauaaauaucuacagggugcgguaucacaucaccuucaugguguuccauaaaugauagguaagauacgggcacuuuuuuaaaaaaugacauuuggacauaaguaucagauauuuggcuuaugacacaguaauggguaucuuaagccuagaaguuguguuuuagauugaagaaucauacaugauucucuuuggcuguauuuauccauaaauuguccuguccuuggauaggacaucuagacacuugugaaguggucauuaguaaauugagugugaaacauggcauuuuggagaauaaauugugaagcaaccucccugaaaacuuauuaguaggauaggacauucauguuagcgaguggaccuaggguguugggcagagucagggagaccaggugacuuuuagcacagugcuuuucuaccuuguuucggucuagauggaacaggguuaucaguguccagaaaaaaagucuuuggcuuccgguuaaucuguccgccccagccauugaagagagugggguacuuauuuaugcaauaucacccuaggccuuuucuaguguuuguauaucaucucucugcaaguuucuucugucaaaccucaagcuaauucuuuuccuuuuugauacacuuuggagaugaagaaauucugauuuuuuuuugguaugauagcccauuccucugcuuucucuccaaacuaagacuaaguaguuaucccagagucguugcuauagaccaguauucugcccuccuuccugauucuauuucuuuuccuuuuuuuuuuuuuuuuuuugacaggaucucccucuugucaccaggcuggaaugcaguggugccaucuuggcucacugcaaccucaccucauggguucaagccauccuccugccucagccuccagaguagcugggaccacaggcacacaccaccacacccagcuaauuuuccuauuuuuuguagaggugggguuucuccauguugcccaggcuggucucaaacuccugggcucaaacgaucugccugucuuggccucccaaaguguugggauuacagcugugagccacugugccugguccccaauucuuuuaacucuacuuaauccauguuuuuaaauguuacuuuuaguuauauaaacuuauguaaucaauauccauagauagagaucuguaacuguuuuucuuuucuuuuuuuucuuuuuuuuuuuuuuuuuuuuuuugagguagagucucguucugucucccaggcuggagugcaguagcacaaucucagcucacugcaaccuccgccuuccaaguuaaagcacuucuccugcuucagccuccugaguagcugggauuacaagcgugugccaccaugccgggcuaguuuuuguauuuuuaauagagacaugguuucacuauguugaccaggcuggucuugaacuccugaccucaauugaucagccugccucagucucccaaagugcuaggauuaacaggcaugagccacugcacccgacccauaacugauuuccuuaaauucugcauauccguauuuuaaaagggauaugggaaaagcuuguuacuuauccuggcuuuagaaacugacuaauauugggccgggugcgguggcccaugcccguaauggucgggcauggcccgauggucggucagauggucgggaguucgagaccagccugaccaacauggagaaacccugucucuacuaaaaauacaaaaauuaaccagguguggugaugggcaccuguaaucccagcuacucgggaggcugaggcaggagaaucgcuugaacucgggaggcggagguugcggugagccgagaucacgccacugcauuucagccugggcaacaagagcaaaacuccgucucaaaaaaaaaaaaaaaaaaaaaaagcuggcuaguauuggacgugguagagccauuucucauuccaugaaguuucuauuugagacuuuuuuagucauagcuucacugagaucauguuaucacuguauuugcuuuuaugucaugucuaggcaggccuccuuaccugagaauuaauaugaccacguuuauccuguuccuaggaugccaaaaucugaugauucauuugaauggggaagaaaaaccaaauuaagugucacauaaacguuguaauuaauguaaccauugacucacugacauucuauauuuuacaccauugucuugguguuagauugucuuggacauaaacuguuccucaccuaaaucuuagacuacuacuugggacccaguaguguguuacagguaucuguagguugcuaguuugaugcauuuuucuauuuuccugacaguuaaauuuaaucuuaauaugauugacaguuaaaagugcagguuguggagccaacauucaggguuugaaucccauuuuccaacaagugcaggcucgguaacugaacuuacugagaagauuaaauuaaauagugcaugugaagugcgugguacgaugcuuagcacacauuaaguguucaauguuagcuacuaugauuauuauccuugguguguuuucuguuuuuaaugguguuaugauccugaagcaagggacucaauaaaggaagaauauuaugguuucauaaugaaauccucuuaacucauuagugaagcauugcaaucuguaaugaugcaagcuuuguuugaugcuguaacaaauuaggccagaguuaaugccauuuccuguuaaaccuuggauagcuuaucuuaguacuugaccaauguuuugcugguggagucuucuuuuucagugugacauaauucccagauagugggcugguuguccucgugaggauuuuaaugcccagguaggaguugguugauucuaaauggaagcuguuguguuuuaugcuguuuguuuauucuagguguggugauugagccgaaaagugcaggcaagaggagucuuugggguuucucauuuguguccugugacaugaguaugaaaucucucugugagcaaguaaaaauauuuuuccaacugcucacuuagugccuccgcaugggauuggaaaagucaagcuguuuuauacugcuuuauugacaguaauacuaauaacauaaaccaaauuuggcugacucagcuacugauuagcaaaaauagccugucuucugcgaaacguuguauauauaauuaaaaaaacaacuggaagagucuucuuacuucaaguucuuaaauacuuuaaaaauuuggcuuuuuuaaagguaguuuugugccucucucaccagaagugaauuuucccuuguuuacgggguuccuguaaagcuguggauggguuuguagauucaguuuuuuaaaugacaguccauguccccagacagaauagauauuuaacaaaugcuugaacugugcuuuuuaaaauccauacuuguucucaaggauugcuguuguuuaugugaagcauaauacuucuuagagguuuuaaaaauugguaacuagacuuagcuccuugguuugagggggaguuuuuguggaaugcagacaguucuauuuacuguguacuaauaaccugagagaaagaaaggcuccuaacaugggugaccuguuaacaaauaccagcuuauguucacaaauuaauccuuaggcaagcagagcacacacagcauuugccauuucacuuuucucuuaccaguguuagccgaaauggcucuuuacacaaauuuucaguguauauauuuaguguuuauuuauucagcuguuggaauuucgguaugauuuauauuucugacauacuaguauaguguuuuacauuagacuaaauuaaugaagaauuuuuuucuucaugagauuguccaguuauggcaaugguugcaguuauaaaggcuguuuacauagaccuugcaagugggaacauuaauacauaaaaauguuuugaaaaggaauuuuucaaugcauucuaagacucuucgaccuaauuggccaauuucugggagucucacccauggaaauacuuuaauauacagcuaaaguuuuauguguaaagauguuuauugcaauauuauuugaaaauagugaaaacuuggaaacauuaaaugucuaauauuagaggaauacguaaaaguguuuauauaaauguugcuucagaagucaaauuagguucaugaaaaugauugcuggcagccuucaugcagguaaaugauccaaaugcagaaccguggauggugaugcgcaugaugucugcaggacugacccugcuugugggauuuaacccuuuugucacagguaacguuauuuggaaaugucucugcaguacacauacucuuugguauggcaugggcugucaauugcgaguaugaccucuugcuucauacccaacagaacaucuuacguaaggaagaaggcagggaucucuugucuggugauuaucacaagcauggaugagcuucugcagcaguucaucaaagaauccaguggguggaaggauucaguuggcuguugccauuguaauugcucuuucccuauuuuucucaugggucuccauauacauaaauaaggagaggugauccuucuggccaccuuacugcaagacaguaguuuaaaugaauucaagaauccuguuuuuaaagugcauauuuucagucauuuaaaaaaaauaaacauugggauaauaagccgguuucuaaggaguuaauuucugguaauuacagcgaauacuagagaugguuuguuuuuucaguccuaagaacuuuuuaaggcugccugcaauucaauauaugauugggugggacuaguaagagguggggccugauauucuguggaaggaagccuuuucuacuaugcuauguccuagcauaguagaaaagacacuagaacaaaaguuaagaaaugugggguuuuggccgggugugguggcucacgccuguaaucccagcacuuugggaggccgagguggguggaucacgaggucaggagaucgagaccauggugaaaccccauuucuacuaaaaauacaaaaaauuagccaggcgcgguggugggugcuuguagucccagcuacucggaggcugaggcaggagaauggcaugaacccagggggaggagcuugcagugagccgagaucgcgccacugcacuccagccugggcgacagagcgcaacuaugucucaaaaaaagaaaaaaaagaaaugugggguuguuuuguuuuugagacagacucauucugucacccaggcuggagugcaguggugcagucuugggucacugcaaccucugccuccuggguucaggugauucuugugccucaggcucccgaguagcaggaauuacaggugugcaccaccacacccagcuaauuuuuuuuuauuuuuaguagagacaggguuuugccacguuggccaggcuggucucaaacuucugggcucaagggauucagacugccucagccucccaaaguggugggauuacaggcaugagccacugcaccuggccagaaauaugaguuauaaucaaucuagcuucaucucuaugugacuugggcaaauauauaaaccugguagauacauaggauuaaaaccaaaccuucgucuuacuuacacauuuccaaggaucaaaccagauaauaugagaguacucugaaaauauaaaguguuuacaaagaugacaaagggcugcacacaauuaaaauagaggagagcaggguuugaguaauauauugaaauauaaguucaagagagggcccuagcccugaacugaucucauuauaccgaaccagcacagugcagugaacuaaaugagaacuccagaugaaccaaaugaacaggcauguuguggaaagaaaaggaaguuggauggaagaaaggaauuugggaccaaucaagaaggaaauagggaauauuaauuauauucuaaaugagaaauaaagccaacauccauauacauuuuuuaaaacugaaugucuaaaguaacccuagggaggagagcauuuuagagcugcacucucaguuaugguaccuaguagccacauguugcuccugagcacuugaaauguggcuggaaugacugagaguuucuaauuuuuuauugauuuucaacuauuagaaaacuuuuaaguguuugaaacaacuugaguaugugaauccacuuucacaguugcaaaucuuaugagcucuaaaugcagaucggauauuuccuuuuucuuucuuucuuuuuuuuuuuuuuuuuuuuuuuuuuuuuuuuuuuuuuuuuuuuuugagauggagucucgcucugucgcccaggcuggagugcaguggcgggaucucagcucacugcaagcuccgccuaccggguucacgccauucuccugccucagccucccgaguagcugggacuacaggcgcccgcuacugcgcccagcuaauuuuuuguauuuuuaguagagacgggguuucaccauggucucgaucuccugaccuugugaucugcccgccucugccucccaaagugcugggauuacaggcaugagccacugcacccggccugcagaucagauauuuccaaugaaaauugaguguccacaugaguggacuauaaauguaaaauauuagauuuuaaagacauaguacaaaaggaauauaaaguuauuuuuauguugccuacauguugaaaugauaauauuuuagauauauuggguuaaaucaaauauacuauuaaaguugaaaaaaaggaaaaugacugcuuuaguguugaaauuuaagcuuacgaguaugugcuuuuuuguuuuauuuuauuuuuaucuuuuugagacagggucucaauuuuuugcccaggcuggagugcaguagcgcagucacagcucacugcagccagcaccgccugggcucaagccauccucucaccucagccuucugaguagcugcagccacaggugugcaccaccacucccagcuaauuuuuuguaguuuuuguagagauggggcggggucucaccguuuugcccaggcuggaaguaugugcuuuuuuaaagcauagaaaaagguagaagaaauaaaauuauguuuacuuauguaaauauauuuauguaaauuuauauaugcuaauagcaaagcuccaugcuaaaugcuguacaugaaccaucucaucugauuagguauucauguuauucccauuugaagagaauauuccaggugaggagauugagguuuucagacauguacucgcccaggaucacuccacuuaaucauagaugguagaaggguuaacguggauucagcuauacucuugguagcuuuuuguuuuuacuucaaaaugagacagauauuuuuucucuacuuuccauauuuucuauaggaaacaucauuuuacuauagaaaaaaauuuauuguaacguggggaggcaguagaauguagugguucaaagaguaggcucuggagucaguuggccuccucucaguguaaccuuggacaagugacaguggcugucugccuggguggacucaucugugagagggcuggcaugaggacugagauuauccuuguaaauauacagcagaaagacuggcacauaguaaggauagagugaguauuaguugcuauuaucauuauuauguucugcaaagaaaaggacuugaaaauaagggggaaaaauccaucauuugaaauagugggcgggauuagguuuuuauuuuauuuuauuuuauuuuuuuuaauuuuuuuuuguucucaucuuuuuuuaaaauuuuauuauuauuauacuuuaaguuuuaggguacaugugcacaaugugcaggcuuguuacauauguauacacgugccaugcugguaugcugcacccauuaacccaucaucuagcaucaggcauaucuccuaaugcuaucccucccuccucccccgaccccacaacaguccccguggugugacgcuccccuuccuauguccauguguucucauuguucaguucccacccaugagugagaacaugcaguguuugguuuuuuuguccuugcgauaguuugcugagaaugaugguuuccaguuucaucuaugucccuacaaaggacauggacucaucauuuuuauggccgcauaguauuccaugguguauaugugccacauuuucuuaauccagucuaucguuguuggacauuuggguugguuccaggucuuugcuaucgugaauagugccacaauaaacauacgugugcaugugucuuuacagcagcaugauuuauaacuggauuagguuuuuaaaugguuaucugguucucuuggagagacguuaaugggaugagagaaaucacuuuggaaagcuuccuuauaagcauucagucauuagcagaccauuuagugaaggaaauagcaauuugcuaaauaauucaaccuccugaaguguguaauucauguuugagcauagcuggcuuaauguuuucuuaggacagcaggaauacaugagucccuaagcaaauguguggguuaggucguagcuuaaggaugaacuucuuacauuuaauacuaugaacuuaauguacaauuuaucuuucuuauuuuucccuguaagagaacaugucaguacagugaauuuccacuaacuugcacuccacuaauucaaacuauaugacaugccuccuaaucgaacagguuaugaaacauacacgagacuauaaucaauuuauuaauaaaauuaguaaagugaaggucuaggugaacagaacuuuccauauucucuucuugcagucugcuugccaccccucacacacccgcagcccccaugcuuccucacucacuacauggcaccccccuccagugugagaagccaagagcuuggacuccccccucucccucaccuugcccacccuggacaucucucccaugugaccccugcauucccucuccugcugugccuuuggagggcccccaucucucaucuggacucuugcagucguuuuuuuaaccaaccugaugcugaucucacccucuuuucagccucucgccccaacugucaccccuucuuuaccaaccccccaguuuaaaaacaaacucuggagcucuuaccuccuucuccaacauuguuuuucacuuuuucaucucugccuucugucugauccccacuagcaagccuuaaauauuacucucuuugcagagcuucaccugacccacugguccccauacagaauugacugcucuguauuaauccccccaccccuacccauccuuuucuccuguacauaccuugucauggcacauagaucacuuuauuacaguuauuuacuguuucuccuucccuugcuagagacuuuugaccuuucugaaggcagauuuguggucuuguggauuucugugucuccagugccugugacaguguguuaaauguauguuugaugaaugugugcuucugaugaugauaaaaauagcugccacgaauugagguguuugugcauuaugccaagcacuucauacaauuuuauuaucucauuuaauccucacagcaacuccaugagguauaagcauuauuguccccauguuuaugaguugggaaacugaggucuauauaguuuuagcagcuugcccaagguaauauuacaguguaugcuauuacaguauaguuucagagccuagagaacucuaacugaaauuaugcauauuacagauuacaucuuucucauagaaauggugagaaucuaguccuauugcugccacuucauuaugaguuaaguaaaguauuuuagggcuggucuggagaucuguccuccacugacagcuaggguuuuuaacuuggggacuacugggauuugggcgacccuguaaaugucagucaguuuaauccaaacucucugucauuuugagauggagagaauuucccuuuugcuuuaaucagauuuucacaauugauauggaacccccggaaauuuaagaacaacuaauauaacauuucuccaaaaaauuauuuuccaaaggccagaugacuaauuuacaauaguacaacccuuucauaaaguggagauuauguguuuugauaacuugacuauaugaaugaaaaugauucaucuuagauacuagguuuuuuaaaagugucaauuuucuuuagacucuguaaacagucauucguuuaucucuuaaauggaaaacugcuucucuguuauggaccgaagguuuguguccccccacucucaauucauauuuugaaacccuaacccccaaagugaugcuauuagaaggguggggccuuugggagguaauuaaguuuagaugaggucaugaggguggagucccuaugaugggaucaguauuuuuauaggaggaagagggaccaguacucucucuacccauccccauguccccaaguccccaggaggauacagccaucugaagccaggaagaggacccuuaccaggagccuaauuugcuggcaccuugaucauggacuuccuagccuccagaacccugagaaguaaauguuguuuaaucuagcagcaugugcuauuuucuuuauagcagcacaagcuggccaagacccucuccuuuucuucuccaacccaguugcaauuuauuaaauuguucauguaugugaaaaaaaucauuggagaaaaacauaauacauuuuaaacaugucacugcuucuguaguuacauuaauuuucuucaaauaauuguuuucauuggauuuugcauaggaaauaugugauagcuuuuccaaaucaaaguaggauauuauguacuauuuuauauccauccccuagcuccugaccaguaaaauguucuugccuuucaaggguggguguguguuaagcuguuguuaguuugugcugauuuuuuuuucuuuuuaauuuuauuuuuuucacucaaauuaugacauaagacaucaauuucuguguuuugaagugaacugaaaauaugggucaugacuggaggaauagcuagauuucugagcugaagggaaaggaccagguucucugucccuaccacuugccauagugccuuacacauuuggugcucaguaaaggcauauuguuaaacgauuauauaugccauuuuacaaucucaguucuuuuccuaaaauuuucauaugauugacuucuccaggaaugcauuucuauaauuucuauacaggaauagguauuuguuucuccuucacucuguccuuaauuuucauuuuggaaccuguuggugucucucccuugguguucuggcuguaggugggcaccuaacugacuucauguuaauuugaucacuggcuuuccuucguuuuguuacagcuaaauggcucuaugacagccuagaguugaauuuugguacuugcagagaauugaaaugaaggaaaaaucauauuagccagucggaauauucaguuacauuaacaugacuugcuaaaauccuugcaguuccacuaaaauguaaucaccuuaggacccaauucucaauauuucaccuuuagugauuaucaaggagguuuuaaacacaguggcucauuuguugaauguagcacuuggugaaaagaagaaaagcauugccaagaagagaucuaaucuugcuggauaauuuccaaggaggguuacagaagacgucaccucagccuuuucugggaaacauccacugugcucugaagagcuguggggguugaacagcucuuugcuaauggcaggcagcaaaaagcccagagcagagcacaagcgugguggcaucacucuucaguaagcuauagucacauagugacugcacauuguaaaagugcugcuuaacccuuuuuugcuucucagugcauugauaagaaaaugauccaaaagauggaagaaagcacaguuuuuuuguuuuuauaauaugguaaacuuuuauuauuuuucauuuucaaaaacaucuggaaucugacagucuaaaacuaaguuuuuagccaggcaugguggcucaugccuguaaucccagcacuuugggaggcugaggcgagaggauugcuugagcccaggaguucaagaccagccugggcaacacagcgagacuccuucucuacauuuuuuuuuuuaauuagcugggagugguggcacaugccuguagucccaagcuacucaggaggcugaggugggaggauugcaagagcccgggagguugaggcugcagugagccaucauugugccacugcacucuagccugggagacagagugaugucauaucuuagaaaugaaauaaaacuaaguuuucuauguaccauguauuaaaaggaaaauggcaaggaaacuaauugcaggaacuuauauaaagcaguagagucauaauaaauuuauaaacuuuuaucccaauuaucugugccugcucaucuacaguauuguaaagugagauuuggcauuuauaauucugacucugagauaccucaggaucacaaaaugccucugaaucaucaaagauuacauuuuaaucaggaggauuuuauuugguaucuuucaugauuuucuuacuguuugacagcgggccucuuugugagauguaugauuccucgaaguuaauuagaucauuggguugaucaaaacaguauccccaucaccugaguagucugaauaagaaaauguuuacugggaagcuucaucagaccacugugaaaaugaguauuugaaacaccugcauuuagguaaagucuuaaacuuuugugaauggagucauaguucagacuauuccuugccaacauaaaccuuccuuuacaguuacaggugccaaaaaagucaccaccacaugugauuggguuggggaaguugauugaauuuuuaaaaaaucaaaugcucagccuaguuuguuuuucucauggucguagauuuuuuuaaaaaauugaacuuuuugagagaauuguagauucauaugcaguuguaagaaauaauacagagaucccaaguacucucuacccuguuucccccagugguaacauuguacaggacugcagcacaauaucacaaccagcauacugacauuaguacgguccagauacacaacauugcuaucagcacauguggccuucauaaccacauccucuuccauccugccuucacacccuuuguaaccccaggcaauuuguuaaucucuuuucuaucuuuauaguucugucauuucaaaaguguuuuauaaauggauggcccuuuucacuuagcuuaauucuuuagagauucauucagguuguugaauguaucagguuuguucuuuauugcugaguaacguuccgugguguggauauaccaugguuuguuuuaacaauucaccuguuggagaguaucuuguuuguuucuaguuucuagcuagaauaaagcugcugugaacauucguguacagguuuuuauaugaacauaaaguuuucauuucucuaaaauaaaugcccaauagcuucauuugaauuauggcaugauauuuaauuauauuccuauacuauaauuucuguagcagaagguuacuucuagguuacggaagguuucaucuagaagguuacuucuagauggauacuugaaggcuaaccaccuuucaguuuuuguuacaaauaucacugaugacaaucauaagucaaucuuagugcacaucugcuuguauuuccuuaguguagauugcuagcaguaggcuugaguguauaaaauauuaaaccuuuuuuuaaaguaccucuccuuuucuuaaaguuauuuuuaauuuuuaaguauaucuaauugcagagcauugucauuaccuuagaaagaaacaucauaaacaguaucggucacuucccauuccuucguuuccccagccccuggcaaccacugauggaucugccuauucuggacauuucauaugaauugaaucaucuguggccuuuugugucuggcaucuuccacuuugcauaauguuuuccagauucauucaugauauagcaaaugucaguacugucuuccuuuuaauggccaaauaacauuccauuguaugaauguacaacauuuuguuuauuaauuaaucaguugaucgacuuuuggguuguuuuuacuuuuugacuguuauaaauaauguuacuaugaauauuuguguacagguuuuagagugaauguguguuuucauuucuuuggguauauaccuaggaguggaauugcugggucauaugguaauucuguguuucacuuuuugaagacuugccaaacuauuuuccacagcagauguaccauuugacagucccgccaacagcaagcgccugaguauuucacuuucuccaucuacuuggccaguauuuguuauuuucuguuuuuaugauuauagcuaccccagugguuauuacaugggucuuuuuuuaaaaagagcuguuuuggcaacacugccuugcuuaccuaccagguaggacagccacaggagcgcuguuuauguugaaguuuccaguggugucaguuggcugucucuaggcuuuuguggaagagaaaauuguguaacugccuaccucuccugccagagcaccagacuugaugugaaguucugugaagagcccacccagucaccugucagcucauuuagccacacuggagagucuguugagguacagaggggaguuaccagugucguuuguggacucaguugcuauuuuggaacagaaauuugcagaauccuuuaagcugaaaaauuuccaugcuaguauguaucauaugaauagcaauuauuuacccuuucacagaaaaaaccaacggucuuuucuguguguauugugagauaaagucuggagggguuugugguuuucuuuuuaguagguaacaguucgaaauuuguugcagaucauaagcugccaaauaauagcuuuaagauguacuuuuaaaaaucaacugugugauuggcugggugcaguggcucacucccguaauccuagcacuuugggaggccaaggcaggcagauugcuugagcccuggaguugaaaaccagaccagccugggaacagagcgagacccugucuccaaauuaacaacaucaacaaaaaaaucaacuugugauaauuguaaagagcacaaguuuuggaccaacuacaaauuuaaguaacuuaacuuugugagcuacuuaacaguaaguaaugugauuaagucuucccagugugcccgaaaauuuuuugauuuuagcacugaaagccuuacaucccggaaaaucccccaagaaaaacagaacaguugccuacccuaagccauauaaaccuagaguuaacuacuuaagaucucugaacuuuaguuuccucgucuagaaaauagggauauuuccuuagugagucuuugaaaagccagcuacguaguaggcucuuaguaaauguuagaucccuugucucaggcuaguaacaaaaguguuguauuguuuuccuaaccaaauucuauacuuuagauaauaagccuuuucacuucucuucccaguuccaguuaaaucgagggggaggguuuauauuuuauuaggccgugcuuguaauuggugccuuaauuaugugugguaaccaaaaggaaggcuagcaaggggaaguagaguugucuuguaagaaccucuucuuccagccccacugaccuuguuaauuucuaaggcuuuuaucuauuguuaacaaauuacccccaaauuugccaccuuaaaaugcagaaacauuuacugucacacacguuuucugagggucagaagucccagcaaggccuaccugggugguuuugucucagggucuuucaugaggcugcauucaucugaagcugagcaggccagaagaucugcuucugagcucauucagguggcuguuggcagguggccuauuuccugccacauuguccucucccuaggacuguuugcagcauagcagcuggcuucccccagagcuagugguccuagaaacacagacagaaacaugccagcugaccaagauagaagccacaacaucuguuaucaccuaaucccagaagcgacauaccaucccuuuugcuuuauucuguuggucacacacacaacccugguucaucgggaaagggcacuacauaagggugugaguaucagguguaccaggaucuuugggggcaucuuagacucugccucccauagauaccguauuuacuugaagaaagcuugagguccuguagucuagguaaugaaacgaauauaauaggaagcagcucaguuuaggauugaugauaauagagccagagcccacguuucucaaccaguguucagguucuuccuaucacccaucuugccuccuuccaaggaauguauggaauuguccuuggccaaacauuugauuuggcagcagcagcagcagcagccugucagcaguguuccauacugccccaguucaauaugaugaaacagggaguuacuaaauuccuuucugugucccaagaacagcuacuagggauuacaaggagcaagacagauacguuccuuguucucacagagcuuuauagacuuggccacuguugacuccugguaguaaugguguuauggaucuccucuacugauaguaauauuucugcaacagcaucccccaaaaaagagcuuaccgguaaaaaauccaucaggugcaggauggauuaauguaugcuuguuaugugugauguguaccaugucacacaguguuugaaaaauaugagaacugaucucuaucuugauacgagguuuuauuucagcuugagagauguuugaaaaaauaugauugccuccccgccccccgccccaccugcgcauccccuccccccagcugguggaauuagaggaaacagggaauugcugcagaauuuguuggaauaaaaaauaacuuguccuugagaccaucauccuagucuaggcucugucucuguaauacaguguauggauaccgucugggugauaaaaauuaaaggguggcaggggauuuuaguaagaguccaaaacuuaauugauauauauagcagugguucccaaagcaggcuguuucccagaauuaccuaacgaucuuuucaaaaagauauuuccuagcaucuauugaauuagaauuucuaggauuggaucccaaaaaccugauuuuaaagcuguuaggugauuuuaagaugcaaccagauuugagagcccauugauaugaaacucuagaaagucauucauucauugauccacucauuauucauucauucacucuuaguuucaaugagcaaucaauaauuggucaggcacagauccagacacucuagcgauaaaaugggaacaccagagguucugccguugaagagcuuagagccuaauaggauguggacagauaaacagauaauuacaguauaacugauaaucacagcacuuaaaaaauaagccuguaauuuuaucacugauugagauacaguagaagugaugaugaagaguaugaaaaugaggucagggaggauugcugccccuuuacuucccaucuaggucuuaauuacagagaucuuaaagaacucuguuaccaaacaucuucuuccaaacaacuuuuuuuuuuaacuugauaauguuauuuuaaaacuacauaguucuguaucuuuuucucguaaaacuauaugaauucaggcaauacuaacacaugucaccaucuuuuauguaaauacaugaagauguccucuugagagacugcaugggguauuuuaagaaugauaggcaauagaguuggagaugugguucaaauucuggcuccacccaaccucugugacuuuggcaacucagcccccuuuucaguuaugguaaaugaauaaguuuauuggccaucuaucauaugcuaguugccaggaguacaaaaaaaaaggcuuaucagaugcagauuuauuucugcucuguacuaagguugggauagacacuggccugcucuucuacucacagagaagucagugaccagcaucuccuugacauuucagaggaauuuaucuagagucuuuuauaaauccccagauucacaaguaucauuugugaguccaugccaaauagaaaauaacagagcugugagguauggaugugagcauguuucacugccauggaccuugcagggaacuccaguuuaugccuuagcaaaacucuuccauaaacauugaauaugaaacugaucauugucaaaggucucuguaaugaugauaauaauagaaacauuuuuacgguacuugcugugccacacacuauucuaagcauuucacauaucuuaacucauuuaaucacaugaggaaguuaauguaauuacccucauuuuacagucuaauaaacuaaggcacagaauguuaaguaacuugcccaagguuacacagcuaguaaguggugaagcagggauuugaacccaggcucucuggcuccaaaguguauguuccuaaccacuaccacccaaaagugguugagccacagaugucuuugcacacugcuuacuaauuuguacuguggcagaggucaugucugucucugucacuuuccuguuccucacaagcaauacugcuugacacaaaguagacacucauuaaauaguuuuuaacucagugagucaacugccuuucaaauggcugguagccugaaaagcagucauucugagaaucauuggacacacagaaauaaaaccagucaggaggaugacuaacuccugcaccugauggauuuuuuuuuaccuugcuucacugcagccuugugggcauuaauuaguuacugucagcaaaguucuaugugaaaguggaguucuaaguccaacugcagcaaucuggccuucacccaccagcaaggagcauucugugugugaauuaucguugucuuuuuccaaauaacagugugcuucacucaauuaaaaguuaucaccacuucuucuucuaguuucaaaagaaaauuaaguuggcagcuuuaagaugauaaaacucuacaagaguaauuuucuacaguggugaacccuuuucugaaugcucguuuguuguguggauuguuguaaaugguccuugucuugacucugcugagaacugggggaagaacuuugaacuugacuguacauuucuucuuuagcugugaauaagaauuccccuagaauaaaguucuaaaaucauguuacccucccgcuaccaacugcugaaaaaauguucuauaucugaguuuuuaagaucaaguguauuuguguguugccuuucaagacuagaauacaucuuugucucccaguggggaagaaauuuccuugaauguuuaagagguguguguguuugccccucuccccucucucucuccccucucccucuccccucucucucuccccucucccucuccccucuccccucuccccucuccccucucccucuccccucuccccucuccccucuccccucuccccucuccccucuccccucucccucuccccucuccccucucccucuccccucuccccucuccccucuccccuuucuccuccccuuuccacggucucccucucaugccgagccaaagcuggacugugcugcugccaucucggcucacugcaaccucccugccugauucuccugccuccgccugccgagugccugcaauugcaggcgcgcgccgccacgccugacugguuuucuuauuuuuuugguggagacgggguuucgcuguguuggccgggcuggucuccagcuccuaaccgcgagugauccgccagccucggcaucccgaggugccgggauugcagacggagucucguuaacucagugcucaauggugcccaggcuggagugcaguggcgugaucucggcucgcuacaaccuccaccucccagccgccugccuuggccccacaaagugcggagauugcagccucugcccggccgccaccccgucugggaagugaggagcgucucugccuggccgcccaucaucugggaugugaggagacccucugccuggcugcccagucuggaaagugaggagcgucucugcccggccgccauccuaccugggaagugaggagcgccucuucccggccgccaucccaucuaggaagugaggagcgucucugcccggccgcccaucgucugagauguggggagcgccucggcccagccgcgaccccgucugggaggugaggagcgucucugcccggccgccccgucugagaagugaggagacccuccgccuggcaacugccccgucugagaagugaggagccccuccgcccggcugccaccccgucugggaagugaggagcgucuccgcccggcagccaccccgcccgggagggaggugggggggggucagcccccgccaggccagccgccccguccgggagggaggugggggggucagcccccugcccggccagccgcccuguccgggaggugaggggcgccucugcccggccgccccuacugggaagugaggagccccucugcccagccagccgccccguccgggagggagguggggggucagccccgcgcccagccagccgccccguccgggagggaggugggggggucagcccccugcccggcgagccgccccgucugggagggaggugggggggucagcccccugcccagcgagccgccccguccgggagggagguggggggggucagccccccgcccggccagccgccccguccgggaggugaggggcgccucugccuggccgccccuacugggaagugaggagccccucugcccggccaccaccccgucugggagguguacccaacagcucauugagaacgggccaugaugacaauggugguuuuguggaauagaaaagggggaaagguggggaaaagauugagaaaucgguugguugcugugcuguguagaaagaaguagacaugggagauuuuucauuuuguucuguacuaagaaaaauucuucugcguugggauccuguugaucugugaccuuacccccaacccugugcucucugaaacaugugcuguguccacucaggguuaaauggauuaagggcggugcaagaugugcuuuguuaaacagaugcuugaaggcagcaugcucguugagagucaucaccacuccccagucucaaguacccagggacacaaacacucugccuaggaaaaccagagaccuuuguucacuuguuugccugcugaccuucccuccgcuguuguccuaugacccugccaaaucccccucugcgagaaacacccaagaaugaucaauaaaauaaaauaaaauaaaauaaaauaaaagagguguguguguuuguguguguacaugcauuuuuuguuucuguuuuuguuuuuuaugggcucacacuuuacaaagugucuuuacugaucauguaguagaagagaagagagcaccucuguuagaguuccagauaacuagcacugagaaaguuuuccccgaggaaaugccaucuguaacuaggauuuaguccguguuuuaggaugcugccauuguggagucaggugugccauuuucuuuucuuuuuauuuuguaauaacagguguaucuccucauuuauaguaucaccaauagauaauuauuauacucauaggacagauuggaguacuugccguuaaagaguuuggacucuaaggaguugcagaguuuguucccauaauaccugaacacagaaguaucuagcucauguaaaaguugaaguugcuguauacuaaaugaguugucuagacagcaacaagaggggcaguggaguggaaguaggcuuuguaacaccuaaucugggccuuggagaaaggguuggaaaugaaggcaagaggacagggaggaaggaccacagauaacagccacuggugugacucuccacuuguuagaaggauguuagaagguguuagaaggauguccuucuccagcgaugguuaaaaagugcuuuuuaauuaacuaguagcagccaaggagcaggaaguggaggcuucuguguugacccuaaacguauuuuuguacaacaauuugauuguugcaacauuuaaaaauuuccccuccaauuauccauuauaccggaaugagguuguucugccuucuucagccguggagcuaaccuguggcagugcuuuguagaaucuaucagugccccaguuuugcaguuacucaucuaaaaccccaaauagagcuguguuuuuugccuucguguaugauauauggcaggaaaaaugacuuuaucagagaauuacaagaguuuguuacuuccuuagaauggagguuagaaaguauaggaauucugcagggggaagaaagagaauaagcauagauucagaguguuaggaugacaguacacaaucagauguaccacuguuggugcgguagauauuuuugagccaagauuuaauccagaguuaucauuuauuuaaaugccaacacuuuaacaugaauucugucgucaaguuacuuucauuucuaaagcuuguuaguacuuggaucuucuuuccuuuauggucuucacgacauuuugaauuuuaacauuccucagcaaggugugguuuuauuugggaacugauuuucccaaccuagaaaaaucuuuuuaaauucuagaaucaggguugugacuaccaaauuaaagcaccauuuaauuuuucauucuguguaacuggcagccaacuugaagaauguucccaugccugccuaacguuaacgaguugacugauaaaagugauggaugggaaugagagaagagaaaaugcaaggaaaucucagucugauuccuugcagcacauggguuuguaaacucagcugacucauuuuuaggugaacaauaaccguuaaaaaaaaaguaaagcaggauaugaugaaguuaagcuagacaauagcuaaacguuuuuaaaucaaaaggaaugugacuugacugauaccacaggaaagggagcuuucaaagcaagcugacugcugccuuagaagccagacaaaccaagacuuggcccuaaaaauaucuuuacuguuuuagagucagcaaacagccugguuguggguuuaggaaauaaacuuuucuuuaauauaauucuuauaccaacucuuuacuauaauguauauuuuuaaaaaucuugauaccuuuuaaaacagauuugccuuaagaucccaguacuuuuccuuugcugggcagcuuugucacucucuccuaccccagguagaaauggccaagaugcuuaauauuugcacucuccuugagacguacuucaucuugagaauugugacugugccuucuccucauuaaccccaaccaccuccuuccguuguugccaccuacccccauccccucauguucuguuguccuugggagccaaguggaaaggagguggagggggacugauuugcuguaaagcuuauuguagugucuuuuuucaaacaugcuucuagcaacuaguuugauuauuaguucaaagugagcacugauguugacuuaaccucccacacgugauucaccugggcauauacuugccccuggagggaguugaacaguggacagauggauuuuccacaugagcaggacucucuuuagggcuuuggguuuuguucuuuguucugcucguguuaguauuuccagguuuuuguauuccaggcuaugguaguuccagucuuucucucgaauucaggcccaaggauccuaaaauucuacaacacuuaguauaguacauggggagggaacuagccaggagcgcagaacugauccaugguggugggggugagucagacgaaggugugcugaacucccucacacucucuugcuccuuucagcuguaucuuuaaauauaggguaguuuauaaagagaauggucagcuccagucaguuuuuuguagugagauacuuaaaaugagacacaauuauaauauaguugcaugguuaccaaaaacacuccagaaucuuauaaugggaagcggcuuuuuaaauuaggagugucuuuuggaaaaugugcguuaaaaaggaauucuuuaaaauugguucuaauuuaccugcccguaauccauuuuuacugucauuauuuucuguguguggcucuugaacuagugaauagcuuuggaagacuguuuucauugggacuuuuuuucacugggcccuguuacuacucccuguuguaaccuguaauucugggaagcccccuagguugagugcaggucagagacuccugguuaaagaggaugggaaucgaugcuuuggcuuggugucagcguggucuuuuuccugggaagugcuggccacucccagcccuguccauuuuccugucaguguguggggaaccagccagaucaaagaauagcuuauucuuuugcugcauguaggacuaaagcuccuuuuccauggagccuagugccugggcuuggucccugcuaguacaauuguacagagcagcuguguucccacuugacccagcucacccaggcugccuguagugugauucggguuauugagaaguuaugucauuggcccaccguagcucagaagauaggaaaccgcaccagugaggccaaccacagaccuggcagugugauugggcaucuugugcaaaguaggucaugccguucccauaaauccagauuacuaggcaaagugucaagacuuuugcauagcccugugccucccauuccuuuaguacaaaagaguauagcucagcccacagaccacucagcaagugcccaauuuacuuaacagggcaggccagccuagccuggugaugaagaauucauuugcugagaccuuuguacuguucauguggcauagcagaugaggcucagcaaggaagaugggaaugaaaagggcacguugcuggcaggagggcugcaggaaggaggguuaggagaugguagcagugugagcagauaaggauuggcacccucuucuguuccuagcccguuggccacaagcucucugaaaggucucaagaaagcucucaugacugaccucugucuacugcugagcaaggccugggcaccagacggaguggaggacagaaggccucccauugugcugcccacuccugucauggcuucugguccuugugcaugccagccuagcccugaccccagggccauugugcucauuugugccucuaaauggaacacccacccuuucccuugguagauguguggcuugcugucaccauucaggcucugcucuguugccaccuucucaggcugccuucucuauguuuuccaaaauaaauucccacuccaugauuccagccccuuuauucugcuuuauuuuuuuugcuaacaguuauuuugcauaucguauuguacguguguuucugucuguaauuaauauauguuuauggucuuucucaccagccugcaaucccagggccuucaggucuccgugccuagcaugugguaggcacucggugugugguaugaaugaaaaaugaguacaugguauugagggacacuaguuauggggcugccuugacaaacaugagguuguauugaguaaaugaugaagcuuuuggugaaggugucucuuaguaaccugugcagaaacaaacagccuugccugagaagauuacaguauauauccaauugugggugugguaggggagaguuugggggaaauacugaacaugccagaguccagcccaaaaucaagcuugggauccacagcucaggacucuccugauuagggccuguuguccagggccuaccucuaccugccccuucucccuuuucacuguagucauuucagaaacaauaagcaggaacaauaauuugaaaauuauuaucauuuccccacauguaucuguucuuuuagagaauguuuuguuggcucuuucaauauauuccuaaguuugauugugaaaaguucugcaaaccuaggagaaaaauucucaagccgagaagaaaugcagucuaagaacagauguaccguuucugacaaaaaucguuucuugcgugugcuuuuguagagaacacauuucauuuuauaaagaugaaagagugcuccugugccugccagcuuccacagggccucuucaagaugguuuagacucagauuauuugggacagauggcuuguaacaggauucuucaauaucuccaaauacuaaauuccacagucucuuuugguagccugcugcugguucaguacucuuggacugaaauuuuaccuuauguuuaaucaagcugcuuuucuguugccgugauguuagccuagauucucaaauuggacuauguccuaggcauuuguccuuauaguaauaggucauuuaucgcaauuacugggcuucauauuuuuccggggccacuacuguuacccucuccauuccugccccaccaaucuguauuuucacuuugaaacauuucuucacucuuguuuccagcuucuuuauuuccucauuacauagaaacugacccugacuacagcccucugaaagaucuaauuaaaaagugaaaugauugauucccuuauuuuuguuagacauauuccuccuguuugaucucagaauacuuuuguuugaauuuuguuacagcaugguuuugaacauauauucagcuuauauucauaucaucauucuacugucugcucauuugcaaacuggauuuuguuuuugcuuuacuauaucuggauccuuuuccccauuaugaaugucucauuuuuucuaggucaccagguaugcuccuuuauguuuaucccuauuuuggcaauccuuuguauuaauauacaguaggugcuagauauuuguguauuuaauuaguacauuccuuuuaguuuugucuuucauguuuggguaauaucuguuucugacaaguuccucuccugauauauuaucaacuccccccccccgccuugcccccaccuucucuugcugucucucuagggguguguuagggcuuacaaguggacauuguggguugucagaaugauuggagcucacugauggcauuuaguggacagggaccaaggacaauuaaugauccacaaugcacaggacauugauuguuuccacuguaaugccagcagugccccugccgagaagcagagacagccgugggugguugacaguauucaucauggagccaauccuguggcagacauacauucagaaacaucuauugggggcuuccuacaugccagacacugcucuaagggccuuauuuauauuaccuuauuuaaucuucuuaaaggcaguuacuuuggucuuuuccccguuuuucagaaagauuaaauaacuuguccaaggucacauugcuaauaagugaaaaaaaaugggggguuucaaacccuaguuucuuauaaucuagcaaaaguccguucaugcuuaauaccugauuauuguacauuuaaugugacccauaaguaaguaaguuaauauuacccauuagguaauagaaucuagguuuuaaaaugccuuggaggaaggugucuguccccagugagcagcuuguccaucacuuauucaauccauuagucauagccuuuaugaccuuguuccuccuuauuuccuuucauuuggcuguuugggaugcagccuaguggggagcagggaacccugugaccuccauauacauggcccaccauacaucauagaugaaauuaaauuguguuagugugauuucagugucacaaaaucaugaugguugucuuucaaaacuuggauuuucuagaugauuuucaguagauguugaaaaaauagacacagccaaauugucuuuuagccagugcucuuccugaacccaccuugggcagaacuuuuaauagccuuuaauagauaaaacauuucuuauuuaacuguguuuuaaagaggaauucucuuuacgaaacauaaggcuaaaccuauucucuucagcaccaggauuuucuagaauuucuugucucuccugaagugguucaaucuagggcaggaaaguggcuuaggaccaaaauugccuuucuuaggaauauaguauauuaguacccccucaucgucagggaguacauucuaaggccccuagaauggaagccuaaaucugcagauaguaccaaacacuauauuauauauagugguuuuuuuuccuaugcauacauaccuauaauaaaguguacuuuauaaauuaggcaaaguaagauuaacaacaauaacuaauaauuaaaucgaacaauuaaguaaaguaaaaguuaucugaacaugagcacuucgauccugaggcaguugaucugauaacccagaagguuacaaagugacucaagggugaagaagugucuacggugaggauacgcuggacaaagagaugauucccaucccaggcaggauggagugggacugcgggagauuuuaucaugcuacucagaacugugugcaaucuacaacuuaugaauuguuuauuucuggaauuucccaccucguauuuucagaccaugguugauuucagguaauugaaaucucagaaagcaaaacuguggauuaagaggggacuacuguauguuaaaaucuuaauuguuggauugcagaagugaccuugugcuaagguuuuguaacuauugaggggcaaagguggcugaccugguuauuggcagauggguauggggagcuggugccuucggggagcuggugccuucagggagcuggugccuucguuuccagccaugaauuggugucagcagccuccccaaucacccuugggcaggaaagcugucaggacagaacccuguuaacuacuuugaaagugucauugauggcuccuccuaucucuacgucccaucucaucuggauugacuuaauuguaacuacuacaaccauuagaugauuucguggauaaaguaguuuaucuuaaaauuagccagugaauacauaacgcuucaguguggcaagccaaggaagagaaguauugcuaaaugauuaacagcuuaguuaauaaaaucaguucugccuuugcccuuggacguuauaauauugaugauuauuccuguaagaagaauggccaggaaaguuggaaaaucuagucaguaugcauaugaaaaguugauuagcuacccucuaaauguaaaucuuaaauuggggaagguagggagcuauagaaucuuagaagauggagguaaaucuuuaacugguaucucaagauguuuuauuaagugaaaauaagcaaguaauauauacacacuucuauauauaauaguguuuuuuuaguuuuuuuuaacugugauccccacaguaagaauauauuuuacaucacagcuaaguacauuauacuuauaaauaugauauaauaaaacuaaaguuuuauaaaacuauauucauucucacugagagcaaagcauucugauucucuacuaugaucaauuauuauuuuuaaugcuaaguugacaugaucaucuacuaaugguagauuucacccacaauugugaaaacauccauuuagcaugaccucuuugugcucaaaagaggagaaaucucuggaaguauauugaagaaauguuaccauuagguuccuugugaugcguggcuuggggauugagguugagggaaguaaugagauuuuugccccuuuuuuuuaauuuuuaauacuugaauuuuuuuuuacuguagauaugaaguacuguaaaauaauaauugauaaaaguaacaagcggaaaaaacugucuugucacuguggcauucuguucccugauauggcucuuccuugucuuaccucaaguccucaguuguugcccagacaggaucucuuccugucugccaccucucauuccaguuaguuccacuuuuuuccccacugagauuucagcuucacggaaagaguuuuuauggaacuaagaaaagaaguucagaaaacuggcacuucauuuauaaagugaacucacagaauugugucuuuccuuuugaucuucaaguuagaucuagcacagaagucacuucugugaauuaaauucuuuuaaccuaaggaacugaacuuaaccuugucuguagcauauucuuugaaaagaauuuauucuuuuaugaaaaaauacuguauaaaaaacauuuugaguagagauuaaucaguaucuuuuuuuuucuuaauagguuuucaaauggaacauuuugaugcaucacuuaguaccuauuucaaggcauugcuaggcccucgagguaaggugguuuuugguuuugcuuaccuucugcagcaucacucccugccuauagucccuuguaaauauugcaugaggagauaguagaaaauguuagcauuuucuaugauaagucuaaaacuuuauccuggauaacaaggaauuuggagaagucucugacagagacaccugcugugggugguccuccguugacuuuaacuggaguuuaaaaauaugcuguaaagcuuguagccugagaauacuauagauuucaccauuaucaguggcauuuuuuucucaauucuuggcagucuuuaagaaaaacuaguuuccaaaaugcaguguugcaauaggaguuuaaaaccuuuccccuuuuacaauuuuaagggcuuuuuaaggucuucucauuuuguaucauguuaacucacugguaaauaugcaccugaaccuuacuugcuguaucuuuuagaaaguaaaucagcuucauauugccuucuuuugaugucaucuguaaaagucuuuuaaagucuuuuguauaaagaacuucuuaggcucacagaaaaacuagaaauggcuuuuaaacagacaaaaagaaucucaguuucucaugauuuuuaaaacacaaaagaaauaacaaaaggacuuagucuauuaacauggcagagaugaaauaauagguuucaugucaccuaugauaauagugauaauagugaaggcguggagaaagaguacaaccucucugaaaggcuguuuugccuucuguuggaauuaaaaugcacaugcccuuuugccuagccauucuacuccuaauacuuuauccuguggcuagccuugauuaguuaugcaaugauacauaucaggaugcucauuacagcauuguuuuucaaggaaucaucuggaugccugucaguaggggagagguucuguaaauuaguguauggcccauugaaaagaacaaaaaagaauaaguuagauccaucuguaugugcuuggguugggauagugccuuacuuuagcuguaagggacaaaaaauccaacucuaaauggcuaaaauaauaauaauaauuauuagcuugcauuaccagguggagcaauuccguaguuauuucagggacuguaugauguaaccaaggauccuuguucuugucauuuucuacuuugccacuuccagguaucagcagcucuguccucagaaugggucccccacuucacacaguuguaggauggcuacagcagcuccaagcagcacauucagaggaagaagaaaaaauguuucauuugugugguuuuaagcauaaagaaguuguuucccagagcucuuugccagcugucaucccucaaaacucacuggccacaauugcuucacaugccccugccugaaccagccaccagaggggguuaggaccaccacagauugacuagauccuaaggauucucuaccuggggcuggaguucgggucaggugcccgggaagcacugugcggugugggaggaugaauaugugccaauuuggaaagaugaguauuugugggaaaaugaauaaagcaaaguguaaaucagagguuuaaguuaaaauagggagauuuguguguauuuauuguuugugauauauauguucauacaaaauaacagucugauguuaguugcuaagugggaacugguuuucuuaaaauugacagccaaggcccaaagcugagaacaaaagguguuaagcauccccuuaaagucccuggggccagccauuucccugaaugacuucuaagcacaaccaguucugccggacugacaguaacacccuccgugaccauagcauaacuaguggggaggguguggagggcaugucccucugaagccaaagcaagccagccaugagagaaaugcugggaaaguuuaguguguacagugcaagaaaggaagacugacugacaguuccccacguggacauaugcuuuauugagccuguucuuguucugugaaaucaaggugaaaacgacuggagagaguagcaagaugguccagucugggaggggucaaagaaagggcagagccggguguggugguucacuccuguaaucccaguacuuugggaggccaaggcagguggguccccugaggucaggaguuccagaccagccugaccaauauggugaaaccuggucucuacuaaaauuacaaaaauuagcggggugugguggugugugucuauagucccagcuacucuggaggcuaaggcaggagaaucgcuuggacccuagaggcagagguugcagugagcugagaucacgccacugcacuucagccugggcgacagagugagacuccgucucagaauaaauaaauaaaugaauaauaaaaaaauuaaagaaauggcaaaggcuguccucccaacugcugcuucucugaagacgcaguaggugaaugcugcaugugccucauguucuggaguugugagccuuggcggguaguuaagauugaggagccacagguuuucggggaacaucauagcaggguucaaaggggagcaugcuuuucagagguagcuuccuggggucagccagaguaugaagcugaaucuuucaggggacacauaacacuuaggggcucuggcugccaaggaguuucccgccauccaagaagagguugucaguuugcugcuggcggcugaccuguuucccucucccuccucccugccuaagaaaaggaauaggggcaggagaggcccuuccuauaccaguaucuccucuggauccgccuaggucuucgcucucaugcuacuacuccucaguuuguuaaauacugcccuuuaaauaggcauuuaucugaucauugcugcuucaccuucauguuuuguuuuguuuuuauuuucauuuuugagacggagucucacucuguugcccacgcuggggugcagugguacgaucucagcucacugcagccucuuccucccaauuucaagcgauucucccaccucagccucccaaguagcugggauuacaggugugcagcaccaugccuggccaauuuuuauauuuuuaguagagauaguguuuugccauguuggccaggcuggucuugaacuccugacuucaggugauccacccgccuuggcaucccaaagugcugggauuacaggcaugagccaccacacccagcccuuguuuuguuuuuaaaucauuguccucucugcuguugaccauuacacucauagcaaaggcugccuuucuaauuagugccaguuucacuaacguggcuaagcagcacguuuucugagucugcaugugcuggccacacuugccgacugacacacagcugagauggaggacuucagaguucaaugacugccauuucuuggguuuuaucacccuauguguaaucugguauaccugguuaauaaauccaauuaaugggaaguguagccuucuccuuguuuucuucuuaaguucuuuggaaagaauauuuguauuauuauuuuacugagcaaaaaucaugaauaauacauuguuauucagagcauguaacaaggagcuucaccuuguuugauauguauugaaaauccaugccuccucuccugauugcuuuauuggaauuaagaacaugaauaccaggugacuuuuauaucaucaugguuagagaaauuuuuucaacguuugaaaaguugugaauguuuuuauauaucauuaauuuuuuuuaauuuuucagauacuagaguaaaaggaugguuucuucuggacaauuauauacccacauuuaucugcucugucauauauuuacuaauuguauggcugggaccaaaauacaugaggaauaaacagccauucucuugccgggggauuuuagugguguauaaccuuggacucacacugcugucucuguauauguucugugagguaagucaaagguuaacacagucuuccuuucacauaaaugcacucauauugcuguccuaaauuguauuccuaaaugaggaaagguggccgcuugggguguagagacaacugggcaagcaaguaucuuaaugcguuaugaguguguuuuaaaaucgauuuuucaaaaugucagaguuguuuguacaaguaugccuucuagaauaucuaaaauagaagccuuuguuauugauucuucuauuauguuucguaugauauucaaaauuaaaguauuuucagaaauacucucaugcaagcaaaauacagaguggaaaaugaacaaaaugugaaaaacacaugugaaagcauuuuauuauuaagcaucuaauaagugccugcuucuuguuugaagguaggggaggaaggaaguggguggcacuuguguuugguauguuuuguggcacaucacccucucugauuggauaacuugucaaaucucaguuguuuuuuaaaagcuaagaggagugugacuggugagaucugcauuuagguuuugaauugucugucugaguucaggcccaguuauuuuauaucacugcaauguugaaaaucacauuugaugaucucaaaggcaaauguuauagcuuaaaaaugaaagaaaaaucagaaucaacccuucucuucucccuauuuugaagggguaacacuauagccuuuaaagcuaaaagggggaggaaagcuucccucuggugguaagcaguuuguguacauuuuuccaggaaagccuacccacuuuucauucuuacagcaccaaccuauuucuaacucuucuggagaauuaagcccuggauaaaaccuauacaggcacuccuguauagguuuucaggguuucauuuugguuuuaguucuucaaggaguaguaaagaagaagguagaggugggaggaagaggagagauagaaacaugaaucuuaaaauuaguguucaggggucaaaaugaauucuccaucagccucaggccaugauggugucucccugucuacgugugguggugugcaggagugugggcgugugcaggcauauuugauuaucagagguguugcagcugugggauaucugugucuuguucucccauguauguuucauaagccaagguacagauauucugaauagaaugguagauguuccuagcauuacuuuuaugcuugacaugccaagaaaugcuuacaacuccuuuuuuugcuuuuuuuucuguccuauucuagaaugaagucaguuuaauuagacuccaagauggagaguucaggacuggagccaggggaagugcacaggagugacuccuggccccagcacuaugcacauuucuguguucaagggacaaaaccacagcaagcugucagguuucugagugaacugcuuacuuuuccauaauugauagauaauacagccaugucuuuaagagaacucuuacagaguuuauuauuauacauggcaauauuaauagagaaaaauauuucaugugauuuuuagagaacuuaagcauuugccuuaaauguuucuuaagcccuagaaauauagcuauaauuucauuauuuauccucucuuaaacagaugauucccugguaaagagaagaaaaacacuguauaaaguacagcugugugcaucugaguggaugugggggguucugaacacauuguaauagaagguacagauuuuccucugauagcuuggugagaagagaagacuuugagcagugacuaagcacugaauacagaaauuuaagaaauauacagaauagggaaacuacauuuuuaacucacaguuuagaguacauagagagguaauagacaaagaggcaauguuuccuuaaauuaaaucaaguuuacaaaaagcuauccaggucagauauacccaaguugaaaauaagcccuagugcuccaaguugaugguauucacauuugguuuuuguccgaguuuucuccuguacauauuguaaaacccaucaauaauuccauugucauguguccuuuuucaaacuucaaauaucauuuuagcuacacguuuuucuguuuguuuguuuugagacaguuucacucuugucgcccaggcuggagugcaguggcgccaucucggcucacugcaaccuccgcuucccagguucaagcgauucucuugccucagccucccuaguagcuggaacuacaggcaugugccaccacuccugucuaauuuuuuguauuuuuaguagagacaggguuucaccauguuggccaggcuggucuugaacuccugaccucaggugauccacccgccucggccucccaaagugcagggauuacaggcgugagccaccgcacccggccauuuuucuuuuuauacuuagcauuucuacuccauugaaugcuaagacacagaagagcagucauggaguuuuacaauggaacgaacugaggagaucaugaagccccauggggccccucauuuuagagaaaugucccaggaguuagagccauucuucuguggucacacaccuguaauggucauuauuuuaguuuuuauuuaccuuccugcuuaucugcauauuuggggcuguaaagaauuuuuuaaauaaguagucuuugguauuuuuguuuauuuaauucuguggcauaaauucacagcugcuuuagcaaguucuagauuaauaaaaauaaaauuaacugucacuuaaaggagacaggaagaagcgggguuuuuuuguuuguuugagacagagucucacucuguugcccaggcuggagugcaguggugcucacugcuucucgccuccugggcucaacugaucucccgccucaaccucccaaguggcugggacuacaggagcaugccaccacgucuagcuaaguuuuguauuuuucguaaagacaagguuucaucauguuguccaggcuagucuugaacucuuaggcucaagcaauccacccaccucugccucccaaagugcugagauuacagacaugagccacuacaucuggccaauaggaagaagucuugaaagaagggagaugaucagaaggaaaugaaaggaagucacugaaacuuuaaauuuacuagaaggaaaauaacuaaaucccaguuuuaaaacugugaaaccgaguuuaaaauguagaaggaauauagacuugcucauaguuuguguacuugguagaaacaaaauuaaaaggagagaagagguauuacuucuauaucucauuaacuuuaguguuuauuuccaggaaaaaggucauagaucccugauuuggagcauauuugaauuagugguauguuuuaauuugaaaguauuggacuuuauagcaauccuuuuugcuuuugcuuauuagggguugucuaauaucacaguccauggugaaagcucggaaaugaaauuccagguuauagaagagaaacaacuuaguuugcauuaguuacuuagcuuuguaaaacgaugcccuuacagcaaacuuaaaaaucuugugcgccuuuuagccacccgagauucagggcauuuguccucugaagagaagccugauuuuuugcacuauccaugugucuuuucucuugucuccagucccaaaauugagaaccucuacauacauggugccaaacgguggcuuucccucacucugccuuaucuaccugguuggaucagguuuccccugacccauccagugagcuaucaaagccacuuuuaacuccuuuguuagaguguuacaggugguuucccucuuaggcagaugcucuguccucaugugaagccauucaaugugucuacucuucuccugcugugccucagaccucuuagacccuaagcagagaggaucuaauuguguuuguuacaguccaaaagggagcaaccccgucgaucugccugugccucacgaacugauccuucgacucagcagcagcugccagaaaacagggucaguguugugcagugcacauggcuuugaauuccccaggaacacuguguugaaaggauggcuggcuccuuuccucagaaggaggcacuccggccuuucuuagccgaucuguuaugcugagcucuacucaaaccccagcaacaccaggcucuuucauucuucugggcucuaccccuuaaaacucccacuucugccuggcagucucccucucacuuuugaggacuguguggaaggauccaauuccucugugaagccaugagcguacuaaggaagaggacucaacucuagagagugaauuuuuuuuucucccagccucuuuggcuaucccauuguucccacggacuaugaugcauuccuuucaaaguacucucaugaugugccccuuagcaucccauccuugccccacugacacucacuggcuuaggcuagaaugaaacaauguuuuccccaccuucuucaucccacuguuacuauaccugauuacuccaccaaauggauccugaguauuagaauacaaaaauaagcaaaugucggaaccacauuuucaaguuauuuaguagucaaagauaaaucauggguuacagacaagauuauuuuuugaguaucuguguauguuuccucccuugcaguuagaacuauauguugugaauagugugagagaaugcgcuuuaaaauauucagaacauuuaaaauguaauuuugaaagaaaaaaauuuguaauuuugaaaaagcuggauggaugcaucuggcuuggcauaaauccaaacuuaucuuucuuccccuuuucaauuuuuauuuuaaauuguaauuuuggaacuauuugaaaauauuuaaaauaaaauuauauagaugauaucugugcaccuaacaaaugcuugauuuuuguuuguuuguuuaaauaagaaaacauuacaaaaaugcaucuaaaguacagucccuuuccagacuucuucggaaauuuguacaguuuuucucuggauguauuuuuacuacauauauauguauacaugacaacacauaguacguucuaagauaguuuuuaaaaaccauacgugaaugguauacuaauuaaacucuuuuucaaauagauuuuuuucagucaguauauuuuugaccaauucaucuugagucguauagauguaauucauuaauuauaauuauguuaauuauaguuaauuagaaauucauuuuaucugcuuuguauuauuucaguguuggaauuuauuacaccauuuuauaaguguuucuuuggauggauauguauguuguuagauuguuuuuuguuguuguuuuuugagacagaguccggcucuguuaccccggcuggaguucaguggcacaaucauaccucacccacugcagccuagaacuccuggccuuaagcgauccucccaccucagccuccugaguagcugggacuacaggcaugugccaccaugccuggcuaauuuuuuuauuuuugguagaaacauugucucacgguguugccuggacugaucucaaacuccuggacucaaagugauccucccacaucagccucccaaagugcuaggauuacaggugugagccacugugcccagcuauguggguuuaugcaaguuguucaauuaacagugugccaagaaucuucuuagacauaucuccuuaugcaaauaugguaaguuuuuugaccagauaaaugcauagggguuuaaugacugaauccgacagucucuugucuuuaauggggaaauuuaauucauuuucauuuagcauguuaauaguuauuuuauaccucagauauugcagcauuaguugcagaucacugcaauaaaaugaguauugcaauaaaguaagucauaccauuuuugguuucgcagugcauauaaaaguuauguuuacauuauggucuauuaagugugcaaucgcauuaaaucuuaaaaaaaaacaguagacauaccuaaauuuaaaaaugcuggccaggcacaaugguguacaucuguaauccuagcacuuugagaggccgaggugggagaauugcuugaggccaggaguuugagaccagccugggcaacauagcaagauccucucucuacaaaaaauuuuauaacuagccuggcauggcucgagcuuguuguccuagcuacuugggaggccgaggugggaggauggcuugugcccaggagcucaagguuccggugagcuaugaccacaccacugcacuccagccugggugacagaguaaaacccuauuuauaagaaaaaaaagauaaauuaaaaauaaaaaugcucccaggugcagugguaugugcuacaguuuaguguagccauguucgucagugaucuuaguuaaaucuuccagauaacuggcugcagcuucuauagcagcacuugcugcuacaccuugcccuuuuguguuauggagaugacuucuucccuuaaaccuuaugagcuauccucugcuauuuucaagcuuuucuucugcagcuucaucaccucucccaggcuucacagaauugaagugaguuaguggcuugcucuggauuagauuuuggcuuaagggaauguuauggcugguuugaucuucuaccuagaccacucaaacuuucagcaauaaggcuacuaaugcuuucucaucauuuuuauguucauacgaguagcacuuuuaauuuccuucaguaacuuuuccuuugcauucacaacguggcuaaccugguacgagaggcccagcuuucguccugucucagcuuuccaccugccuuccucacuaagcuuaaucauuucuagcuuuugauguaaagugagagacaugcuacucuuccuuucacuucagcacuuagaggccauuguaggauuauuaacccaauuucaauauuguuguaucucaggaaauaaggaggccagagaagaaagagaugguuagggggaacagcaagucuguggagcagcuaaaauacagacaauauuuguugaguuugcugucuuauauaggugugguucauggcaccucaaaacaauuacaaugguaacaucaaaguucaguaaccacacacagaucgccacaacagauauaauaauagugaaaaaauuugaaauauuuugagaaauauuuuauaauugugagaauuacaaaaaugugacacaguaacacauagugaacacgugcuguuguaaaaaugguaccaauagaguugcuuaaugcagaguugccacagaccucaguuaagaaaaccuguaauauauacaaagugcaauaaagcaaagaugagguaugccuguacuuucugucaccuuuuuuguguauauauguuuucuuuggccuucuuuucuccuuuacugcuuuguagaauuuuuguaaccauuauuuuuuauuguacuuauucaaaaguuauucauucuguugagugguuacccauagauguuuaccaugcauuuuuaacuuacgacaguuucaguugagucaguauuucuauucuccuaaacaauaccagggaccuuagaggauucuagcugugaccccucaucuuucauguuacuguugucaggaguuauuucuaccuuuuuuuuuaaaaaaaaaaaaagauggucuugcucuguugcccaggcugaagugcagugacauggucauagcucauuguaaccucaaacuccugggcacaagugaucuuccugccucagccucccaggcagcugggacugcaggagcaugccacugugcccagcuaauauuuuuauuuuuuguagagauggagucucacuuuguugcccaagcuggucucaaauuccugggcucuggcaguccucccacccuggccucccaaagcacuaggauuacaggcgugagccaccacaucuggccucacuuuuuuuuuuuuuuaagguccuaaauaaucaccauuauugccaucaguguuuacugauuuucuuugcucugugaaauuuauucuuuccuuuuugauucaauuuuuuucguaaguaguucuuucuaugaagggcaauaucuuagucugagugucauguuauuugccuuuacacuugaauaauauuuuaucaaggcauagaauucuagauuaacaguuauuuuuccucagcacuuugaagauuuauuccagagaagucugcuguggucccacuuuugcucauuuguaggguaaucuuuuuuucuuucuaggcacuuugaaaauuuugcauucuuccauucacuccuacuuccuucauuuguuuuuaaucuguuucauccaucuauuguguuuuuaguuuaaauggcuauguaucuuuuacuucugaaaguucacugcuugcucuuuuuuuauuccauaacauggaaguauugucccccccagugauauagauuagaugacagugaucuccaaauuuaaccauuugcuguguugccuuuuuaaguauucuauuaaaagcuugcuuacagauauaucugugagguaaugccucugggauaauuauugucuguguuaaauuucuuuaccuccuaaaacagaaguaaagguuugccuaguguucuguguaagcaucccaaacuaguauuguugggggucaucucagguaaacaugccuuuuccacauaaagauuuuggaaggaguugaauuuaagcugauuucucuuuuucuaaagaauaauuuguuguggggaccucccucgcauuauagguaagaauugauuguguuggaguuuuugcuguguuuuauaccacuuuccuaccuguguuuauagugagagaguugguucugcuuuuguucaguuugccacguugcuagaaccagaagucaguuuuuuuuccuuugaauuuguuuugaaaauuugugaugcuuuuuuauuggaaagaugaaagaaguugagcauuuggugacugaaugcuuuguuugugcuuucuaaccucuguaauugugggcugugaaagcaucuccccaggcucuggguuugaaggccaucugauggaaccacagagcaguugcuuuggaaacauaauauucuaaacugguuguuuuucuuucccuucaggcuuuccuaaaauagauacguuauugugggaaaauaggauuuggaaaaacacuuaagcaaccuggcaauugauuauugaauuuuauuugaaaaauaacuuuguuuaccaaaauacuuugaaaaggcuauuugcuguucuuuuucccauuuagcagagguauagagcaguugaaacaucuggugaaauuaguacuuacaagaaaugccugaucauugccuagaauacuuuucacucuuaguuuccuuacaacuaaaauuccuugcugagaaagaaacuucucucagggccugaaaggaaacaguuaguugucccuaguguaucugacacugcccugagagaaugccucacgguagggagaauggagagaaggaugcagcucaaacauccuucauuccucacccacacccaggggaggggaagggaauacuuucuacagagaggaagccuucuggcuuguccagagccaggccucacuccucuaaacuugccccugcaacaccuggagagcuuggcucugcagcugguguagcuaggagcacaucacucuacagauccucaacuaaaguggacuuaacucugcaaagcaggcgucaguggguaggcuggagaccuuccuuuaaaugacacaaauuauacuuuggcugggacauccagcaccaccuuagcccuaguuggaagcaaaaguacuuaacauuugccuaagaucauagcaaagacagauagugccuaccuuaugucagguauugggcuaacuaaucuaaugcuuauugcacucuuaccaucugcuuucuacagagggaaaguucugggaggccugaacagggagaacugcuagcauaagagggcagggcuugaggauucagggaaaaugccagacauaccuguuucaguuuggauugaggacaggcuguuucuuuguguuuuguuuuaaagacuucucaaguguacagaaccugucuuuuuuaacuuagccaagaguguuacguucagcuauaacccagggguauuccuguucacaaggagaaggaaaaaaaaaaaacaccuguggaggucaugggugugaaauuaucuuaaugggcauccuuaugcucuggacaugaaagauuugaaauguaaaaaccacaugcuuugaccuggcacucccuaauagcacugcgaaaauuggccaacuaaacccuagaggaaauagguacuuucaauuuugaguaguucaugguuaauuuuaaaccaaacaucugcggaagaaaaagaugcaguuaaaggucugcuuuuccacagaauucuucauggacagaguaucccuaccauguucuuacuaagaauucaaaaacagaugaagaagggcaaagaugcuuggaacugcuguuugaggugcauuuggacugagagucaggauuccuuugugcuaaucccagugguaccaagaccugggccauccuuaucacuucucauucccuguuuucucauuaaaaauacgagcuuguaccagaucuaaaaaauacacaguugaggacucacacagaaacaaagcuaugaagagggucaacccuacguauucuuggagauuuugcuuagaaaagcaccuuagguccugugauguaguugaacuugaguauggauagucuauuuuucauuacuuuuuaccccauuucugcauaggagguaguaaacaugcagcuucaucaagcucuuaucaccagaagcagccagucuucuuuggaaagggguuaucuuguugcucugacaucuugggaugcugauguuaauggcugauaagggccacccaagaugauguuuuccuccuuuuucuuuaaguguuuccagugaccuuguuuccugagauguuucaguagcauuccagaaagugccauggaaaugguuauuaugcuaaagguuacaaguuguuugugguuaaauguguuauuagaugggaaaagucaacucaccguuaaaaaugauucacuccuggcugggugcaggggcucacaccuggaaucccagcacuuuggguggccaaggcaagcagaucacuggagcucaggaguuuaagaccagccugcgcaacauggugaaaccccaucuuuacaacaaaaauauaaaaauuagccgggcaugacagcgugcaccuguagucucagcuacuugggaggcugagguaggaggauggcuugagcccaggaaguggagguugcagugagcugagauugugccacugcacaccagccugagcaacacagccaggcccugucucaaagaaaaaagauucacuccaugaauuaugucauccagaaccaggugugaaacucaccuacauuuuuuucuuucauugaaaaggugcaugaaaccaucaggguuauugacuuuaucucauauggagaaaagagcuuguagcuagguuuuaauuauagcucugcacauccucuuggccuaauuaaaguuugcuuuacuccaaggaaggaggaaguguauaaagcuuugcagugguacuguuuguaucucaguuccucagaaaaaagccugcaaauaaugccccugggugguucuuggaguuggcagugguauggaaaauuucguuagguagugguuagcuguuugugauggccugcuuuuucauuauaguauaguccuguccucuuucgaucugauucucagaagcccaagguagacagacaccugccccuauuuucaguacuucaccuucuccagccuacuggguccucucacccuguggugucuacuuaacacgcaacuugaagaauuucugggaaauugaccaaaacagcucuuuggaaagaagcuaggccucagucccaaagggaaagguggcugaugugacuuugacuugaggauugucuccugugaugugcuccuaguggggcuacaggggucaguccuuugcuuugagcaccucuguaguccacuacccauggacacauugcuauccucugagggggauggagggaguagagcccucuacugcuagcccauuuuauggagguuugaugagggucuuaggugaauaagcuucaacucagguccuuggucuugguuuguuaaauuauucuauccuuucugaagccagggagauuugagaauuuccaugaccccauuaugaaauugaugaugaagaguuuucaucuugugaacagaguucagaugaauaugaucacaaagucaagccucguuuaaaauacuaugaagcucucuuuauugcugcacaugaaacauuaggccuagauuuaggggaaagaauuggcagucuugaacucuuugucauuuguuuagcaaauauuuguuugacaucucugguacgcuaaucccugugcuggaauauguugaugcagaugcaggagccacagucaccacccuucgaaaucuuacagaagagcacacaacaggcccauuaacaaagggagcaugugagcaaacagcuacaggucacugcaaggugaggguagaggaaggagaauagaccucaggcucuagugcucaagggaguaaucaugaagaaaauagaauuuuaacugaacuuugaaggauagauaggauuuugagagcuggagauggggguacauaggugcagagggcauucuaguugaaaagaauaaaacaguggucacugccaacacuuauguuuaauccuaugaaccacauugggugagacaggcauuauguacuucauggugggagccuuauguuuaucccauuugaggacugagaaaacugaaguuuaaaauguuggaauaccuuagcuaaggucaccuagcaaaacgugaaaaagcuaggguuuaaugggcuaaugcccaaacccaugcucuuuccccuuggcuacuguguagcgguuaaggaagggcauguuuggagaaugggaagagguccaauuugugugcacguaggggagaagugaaagauaagcuugggaccacguuguggaagacuaaauaccuggacacugcaccuaggauucaggguuucauucugaaggcaaugaugacucacuggaggguuuuaaauauggaaauauggaauucagugguuugaggggcacagcggccccaguggaagugugguaggugugaguagcaguggagggaguguugcauugaagcaugacagagcuccuacagggaaccucaacagguggaagaggaauggugggccuaggucaaguggaguggcaccgagugagcagcuucuuguguguauaccugguuuaugcuucaggagugaaaaaaguucaccacccaauacugagguuugaguucuuuaacuaaacuccaaagacaacagguguuuuauacauggauuccccugccccauuuauggguggggagagggcaaauggaacguuagguuaacuaguuuaaagagucaaggcaaucccaccuggaucccuucuuaaaaaggaagccuguguccaagagucccuucugcugaguuaacaagaccccuucaacccguucucaucuuugggauugaggcgccugcagaauuacaagagaggauuuguccuccucuucuccagagagcuaccuugauuuuccccaccccugccaagauagacauucaugaaugcagucauccacaccuccacaagugcacacacaccagccauccuauuuuaaaacagacaaaagcaaaaccaacccaggaugucucuggacaccauaaaccaaaauagucgcuggaaaaaacagugaugguagguuccagauuuaagauucauaaaaugguaacauuuccaaaaauaucucugaugaagacagucauauguuaguacguuuuuaauuuugccaagagaggcugcuguuuuaaaaaagaggaucuuuuacauugcacgaauuuaucuucaugaaaaccuuacugcguuguccuuauuuuucuuauucgcgguugucccacaaacauuucaucaagaagcaccaguuuccuuucuguacccucaagccacaggagguaguuccuugguucccuccugggguagaaagaagggcagcaaaaagagcacugugcuaagcuggcccuucccucuccaccccaggucucaagagugcaugccagcuuccucccccgaccuccaacgcacuuuggauucagacuuugugucuugcuucuuaggacuucugaucagccugcauggauccugcuugacuggccaugacuuuagagaguaguagaagacagaaaaguuaauacaccuucuaaugaauuaccauguggguacugaucuuucaaagauaguauagaauaguuuguuguguggucuguuuuuaaagucuguuaacaugaagcuacagaaauuuggaacagacccuuuagagauaauuuaguccaaccucaucauuuuauaguaaaaacaacaaaagcccacaggaauuagcuggcuugccccaggugcugggccuggcacucaagccuuccuccuaauuccauggcucuucaucaugaacugaugcuucucccaugcuaaauccuugugcucuucuuuggccaugaaaagccuguuaacucucagugcuuuuuuauguguagaaggugacaaagcagaaggaaaauggcaagaagaaagauaaccaaagaaaaaucagauagaaggcaggauacccagcgugagugcagcggcuacacccauuuuuugccauuuauuucugaugucagaccagguggaaauaucacaaggugucuucagauccuuguaaucaccucuuguucccugggggggaaucuguguugcucgccaagcuaaacucuuguguucaaggacagggaacacaagaauuggggugcagacucuacaucacagcccugcaguuaucacgggcccauugaggggaggggcccgugauaacugcugggcugugauguagagccuguaccccaguucugggguccucucugugacagcauagugccuacugugcugcaagugauucugaggcaugggcacuugugaagccuucaguuugugaagccuaauucauggauccggaggauuguacauacaacaacaggaaauaaugaagauaaaguuggacuaaauuaucccugagccuacagcagugguucucaaaguaugguuuccacaucagcagcaucaguaucaccuggaccuuguuagacauacaaauucuaggcccccagaccuacuggaacagaaacacccccagggacccauguuuuacuaacucaccccucagguaauucuggugcugcacacucaaguuugaggagcacuggcuuagggaaagcagccagaggcuucuguggggcagagcagggagccugugauuggcuuggucugggcacuugugcuaggaccaagggggugacgggcugaggguucugcagagaagcagcgugguaaaggaaggucucugagggcagcagccugggagugacuuuuaagcccaccccuuaggaaauugagacucaagucauuaaagcuuuccuuuuguuuacacuugccuacaauuguuuuuucucagagcaaacuuggcucagcacagcccaagguaaauuaucacagauucugcaacuaauaaaguucaaugaggacuuuacauggcucagaugcuguuggugacuggcucuuucuucuuuuuuaguuaguaacaggaguaugggaaggcaaauacaacuucuucugucagggcacacgcaccgcaggagaaucagauaugaagguacugucucuuuuucagaaacuuuauuauuauaaguguugaguuuuuaaaaauaaauuguauaaaauacaaaauggcccauaaccucacugcccaggcaaucccuguugauauuuuuaaaagaauaaaaaaggcaauauauacacaucaaauuaaaauuugaaugugaaagguauaaaauaaaaccuaaagcaucccccucuguaaaaauaacuccgguuaacaauuggcaggaaaaaucacaugcagucaguauguuauauuuacacaaucaggaucauaagagcaaugucuuaaauuuuuaaaaucauucauccaaguacuuuuuuccgaguagugguguuaaaaauaaaaucugacuuccacucaugagguuuguuuuaaaucacaggccaacagucgcagcucagcaugggcagucaucuccuuagagcacuuguuugacauguuuaauugggcagagaccugacacugcagguucugauuccuuuucuucugugucacuuaucaggucggcugcuccauguuagucccugaaaucaauagcguuuuucagaugguuuuccuuugcuaauggcugugcaggcugcuuccagagggaauaggcagacuucaagguuuugaaccuugagccucauguuuuuguuagucucaaagagugucagggacccuuucaaaaauauucccuguagucauuucaaaccccuccagcugucccaacccaaucauguucuuugguuaaagguacuuggagagugaccauagcucccagccacugauggacauuaagagcucuuggggcacucgggcuucuccgaguugacaucagauuuuuggauauuagugaaacaugucagaggugauauuccagagaagccgugaggauaagccuuaaaucuuugacccuuuccucuuagauuauccguguccucuggugguacuacuucuccaaacucauagaauuuauggacacuuucuucuucauccugcgcaagaacaaccaccagaucacgguccugcacgucuaccaccaugccucgaugcugaacaucuggugguuugugaugaacuggguccccugcggccacuguaaguauuagagacggggacuuggggaacaggugugagcagggaggagaguugaaacuaaggcuuucagaaaaggugcuguuucuguaaaugucuaggucaggcuuucagcuuuguguucaaguugcuuuuaaugauaguuuauguaccuaugcacacaaaacccuuuuuuaguuaagugaacuuucugugcugauugggugagaugagggagauaccacuggggacauauuaaggaauagguacaauauucucugacuuagagggcaacuuuccagguucuuucugguccuucuguaugguguggaagguuugagacgggcaggugaggaaaauaggaucacacuguugcaugaguaccagggagcaaggcucauuuugaaauacagcuuuagcugucaugcauuaggaagucuccacauguucuaacaacccucauauucccugaagcauggugaucaaggugucuucuauaacgagcaccaaaacuugauauaaauuuucuaagguuguacuugguuuuuggaaagcuuguaguccaaaguuucuuauaauuuucagagauugccaccuucagauucagccugggaguuuuagcaaaugucucagucaaaagucccgucauccaaacacugaagaauuuaacugagaaccuaugggucuauuuauggauauuuuuuucucugggauagcacugcccuugauuaccugagccugcuaagauucacagugucauggaauuccagagcuaggaaaaaaaaaaagcuuuccaaauacagauccuuuggguuugggaggaaacuaagaccacagaaagguggguagaguuggggcuuucugcucuuccucccacugucagagcucaugaugguggauuaacugaccuaacuuucuaauagaaacagccccucccuacauuugaagagugcuuuaaauuuucagagaacuuucaggaggacagauuuaaucagcuccacuugggccaugagaaacugaaccagggaauggaugugauguguccaaagucaaaagccaguuccuaucauagccaggaguagaaacuucccuaacaccaggcugugcaccugcaacugcacagggaaaagccagauggcuugguuugguugcugacuguuggggaggaggacagagucuggaaaaagaacuagugguccuacugaacauugaaaaugaugugauaagauggcucuuuuaucucuaaggagcuagacucuugacucuauuauuaauaaaaauguaugaccucagcacugcaguccugggaaauaauuagaagauggcuucagagaccucuccacaccccagcaaauguauagaaacaaccauuuuugagcauauugcccaucagcugucuuccacagccuucagagagcauauuugggcaguugugcauguaaagaaaaacagcugucucugagagugggugggcaucugcagcaaagccuguaggugcugggauggcgucguggcuucagugucagaugccccucuagcagcuacagcugaccccugggcucggagccuccugguggcugccugcccaaguggaaauugaauucucauuacacauccaugcauugcuugcuguugcaguguuugucagcuccguuggaagucaucucucuuucugauucaaaaagaaucuuguauuuuuuuuuuuuuuaccaccuguucuguuuaaaacacuaauacauucuccuucccaaaucccucuguuccugcagcuuauuuuggugccacacuuaauagcuucauccacguccucauguacucuuacuaugguuugucgucagucccuuccaugcguccauaccucugguggaagaaguacaucacucaggggcagcuggugagugacuuggccucuuuccccaggacuuacuuccugguggauacagaccucuuccuggcuuuaguguuauguaauagcaucuaagaugccccuucuccacccuuuuucauuugauguaauuaaauuccuugaaguggguagauuagggaauuuucuuguuuugaacugauagugaacugugaccaugggcauacagcuaguugaauuguacaaagaggucuagaaucuaauuugccaacuucaaguucagcucuucugaguuuuugcacauaagcacauaugcauguauguguguauauguguguguguuuucuaauuauaguccaaaauccaaaaugaaaauuguauguuuccagggguuuuagaaggagcuggagaguaguauggaguccaggguauguguagcccauuacuaggcagcaaggauauuuguuuggcagguauggaugaccccucagcccccaugcaguggagcaccuguuggugaggauggcagcuguuugcuucaguuaacagcuccuccccugguuuacugccagggccaggccacuucaccugauacuucucaccauccuugauuaagccuucugcauucaucaguauauuauagguaaccucuuucucuccucucaugaauucgucuaugaacuaauuaauacuacuacugcucauauuaaacacugacauuuccuaaguguuuagcacauguuggguacucauacuaaguacaugauuuuacauagauuguuccaguagccugauuucauauuauuguccccaagccaggcacaguggcucacgccuguaaucacagcauuuugggaggucgaggcaggaggaucacuugaggccaggaguuuaagaccagccuggggaacauagugaggcccugucucuaccaaaaagaaaaacacauauuauugucccuauuuuauagaugacacugagucaauaggccaaagcuagcugacugagggguguggacauuaaacccuuugcccuguccuugcauuauuaacacauuuuucuaaacacaccaagcugauucagaucccuucaagucaauuaugauuuuucaauauuuaaaaauaacaaucugaaaaaaaagucugagaaaaucuuagagacugaaguguuugauguuucauuuucaccucucugccagcugcuauaugguccuuguuaauuuuuucucacccaccugugaaaaaggaaaauuguugauuaaccuccuuguuauacuugaggagaaaugaugcagaaauugauuuauaccacaguuuugggucuggcggaagcagaauuuaaaagaacagacuggcaaaguuggucucccguuaggcucuguacuuugagguggaagauuaaaccuacccagguugucaggauuuauuuuaagcaccacuccuaguuauuccucagucugcaguacuaaccuuaaaaaagagaaggcaaacagccaggcacagugggucauggcuuggagucccggucacucgggaggcugagguagaaggaucucuugaaccugagaguuugaggccacccugggcaacauagacccugucucaaaaauuaaaaacaaaaaacucuacauagaaacauuggagcugcuagaaauacagugugcagagccuagcccuuuuuuuggggggaggggcagggguugagcuggagucucgcucugucaccaggcuggagugcaguggcgcgaucucgguucgcugcaaccucugccuccuggguucaagcaauucuccuaucucagccucccaaguagcugggacuaccggcgugugccaccauacccagcuaauuuuuguauuuuuaguagagacaggguuucaccauuuuggccaggaugguguugaucucuugaccuugugauccgccagccucggccucccaaagugcuggaauuacaggcgugagccaccacgcccggccugagccuagcccuuuuuaaaacaucuuuccaccauuucucuaaccaguucacaugcguuucaagguuuauucaucaaaauuaaucaaugcacuuaguguuguuugccaguaaagguuuaaaucuacucaucagccuucaccaaaccagaagcguccauggauaaggaguuggaaggauguccagccagguggcacauccugcagugauguuaucagugcccuuucaacauacacacuugcucuuccuucucaaaaaauaaaaacaaaaagucuuggaugucucuauaguguauccuugaaauuuggagaagguaguuuaaauagcuuggagggcagaggaagaauauauauaagacaaacacaccuagaguuuaggauaaguauaguguauguguuguguucaugaagugacugcuguaccugcagcaaggguaguaaguguuaauucagaaauuuaggugaugcugguuaaaaagucugccugguguggggccucguccaugcacugucccuguucagcugcauccccucuguuccccuagcuucaguuugugcugacaaucauccagaccagcugcggggucaucuggccgugcacauucccucuugguugguuguauuuccagauuggauacaugauuucccugauugcucucuucacaaacuucuacauucagguaaaucucacccuucucugggacuuggaaucuggggccuuuaccaacaaaggcccucaucuauuuacuuaaugggcauguggagcccuugcugggugacaggcucuggccucuaauggagucacuaugacaagagcagccccugccucuggggggcucacagcucacuggaagacacuagaauccuguucuagagccugggugaggaagucuugggauuccccugggaaauggaaaacugugcagcaggacccuauguugcuucccucugaccugcagcagagacgugagaggugauuucaaucagaaaucucucaguucacuacccugaacgucauggccaaaugaaauuucagaagagauuuuuaucacaguccucagauauggagaucugcuuuuuugucccagcuuucuuauacauucagucuucaggugugaggauucgguucauuccuaagcauaugauguggugauguaggucuuugcucacagaaagauccauuuagggcagauaauuuccaguggagccugaccacguugcagccacugcugauucuccugccaugcgucaccccccagaugacauguguccugccuuuguugccagugccugguagccauaaggccugcugaucugggcaaaacacggaggucaggagcaagggcagaggcugcaagucccgaggcucagacauuuguccuuucuucuucugugcccacaagcaccuguguguggcauguugaguuucaguggaagucauauacuucugggcuucauaguuuauggcugcacugugggacauacaccagcuacaaggaaggugaaaggauaggacccgaugaagcugaaaucacauuuauucuaacuacuuauagcagcauagcacuuuguucaugaaggcugagauagucgccgaggcagugaggaacuuuugaagacgaacaagggaugugggugucaagagagcugcugccaggugggaaagaccaauuuggccacauaaccccugucaucugccauccagauacuaaaaggcaaagcaaaguguaaauugaauuuucuaugugacauuuuaaauaguauuucuguugcagccugugauucaguuaacuuaccucaggcuaagccucaaaaaaaaaaaggaagaaugauugaaaccagugacaaaagauuuagucaaugaggacuugaccucaggaguuucuccuugauaagauuugaucuugaaacuaggccuaguguuagggaugcaauucucaguaaaguucccuauaaagaaaacuguggucauuugguucucaucugcccuuacacauuuuagaccuacaacaagaaaggggccucccgaaggaaagaccaccugaaggaccaccagaauggguccauggcugcugugaauggacacaccaacagcuuuucaccccuggaaaacaaugugaagccaaggaagcugcggaaggauugaagucaaagaauugaaacccuccaaaccacgucaucugauuguaagcacaauaugaguugugccccaaugcucguuaacagcugcuguaacuagucuggccuacaauagugugauucauguaggacuucuuucaucaauucaaaaccccuagaaaacguauacagauuauauaaguagggauaagauuucuaacauuucugggcucucugaccccugcgcuagacuguggaaagggaguauuauuauaguauacaacacugcuguugccuuauuaguuauaacaugauaggugcugaauugugauucacaauuuaaaaacacuguaauccaaacuuuuuuuuuuaacuguagaucaugcaugugauuguaaauguaaauuuguacaauguuguuaugguagagaaacacacaugccuuaaaauuuaaaaagcagggcccaaagcuuauuaguuuaaauuaggguauguuucaaguuuguauuaauuuguaauagcucuguuuagaaaaaaucaaagaccaugauuuaugaaacuaaugugacauaauuuccagugacuuguugaugugaaaucagacacggcaccuucaguuuuguacuauuggcuuugaaucaagcaggcucaaaucuaguggaacagucaguuuaacuuuuuaacagaucuuauuuuuuuauuuugagugccacuauuaauguaaaaaggggggggcucuacagcagucgugaugaaacuuaaauauauauucuuuguccucgagauuuuaggaaggguguagggugaguaggccauuuuuaauuucugaagugcuaaguguuuuuauacagcaaacaaaaagucaauuuugcuuuccaccagugcgagagaggauguauacuuuucaagagagaugauugccuauuuaccguuugacagagucccguagaugagcaauggggaacugguugccagggucuaaauuuggauugauuuaugcacuguuaucuguuuugacacagauuuccuuguaaaaugugccuaguuuaccaaaauuaacaaagggggggaaaggaccuuagaacuuuuuaagguaaaaucaaauauagcuacagcauaagagaaucgagaaauuugauagagguaacuuguuuaauguaaaucuaauaguacuuguaauuucuuucugcuuagaaucuaaagauguguuuagaaccucuuguuuaaaaauaauagacugcuuaucauaaaaucacaucucacacauuugaggcaguggucaaacagguaaagccuaugaugugugucauuuuaaagugucggaauuuagccucugaauaccuucuccauugggggaaagauauucuuggaaccacucaugacauaucuuagaaggucauugacaauguauaaacuaauuguugguuugauauuuauguaaauaucaguuuaccaugcuuuaauuuugcacauucguacuauagggagccuauugguucucuauuagucuuguggguuuucuguuugaaaaggagucauggcaucuguuuacauuuaccuuaucaaaccuagaauguguauauuuauaaauguaugucuucauugcuagguacuaauuugcagaugucuuuacauauuucaauacagaaacuauaacauucaauagugugcugucaaagugugcuuagcucaccuggauauaccuacauuguuaaaugucuaaacaguaaucauuaaaacauuuuugauuaccugugcc

SEQ ID NO: 16060 - RNA, 5347 nt, Homo sapiens
uggucucacaauucaucuauuuucagaggucacaggugcguugaccaaagaucacuguaaucacugcuuguauccuuacacauucuuaagccaguuccaaaauggaaacacacaaucaggccuucugcaagcuggagggugcucugaagaacagaggguccaaacacaaugacucaguuaugcuaagucuuagagaugucacccacuguggugggcaugaauaaaucuuuaauuaggcugaucauaagcaucuaaauguguccauaucagaaaucuuuucauucauuuuaaaggccauucuugacugauacugaaugcucuuugcauuuguugaguugacaaccucaaguuugguucuuauguauaauuuugguuuauuuuacuauuaaguucacuaggauauuucaaggaauuguaugaggaaggccauuagguguguaccaguacaauggcaggauaaagaaugagcaguggaauauauauucauaaauauuucacaauauacauacaaacccguguaugcaugugcuauaaaauagcaaacuugcugugccugucucugguuuaacccaugucaaacuuuuuugaucucaucaaugccuuggauuguggaaaauaaaagcaaccccguggugggaaggaaguacuuccuccucucacuuaugcccucuugaauguaucugaucacuucuauaccuucauccccuucuguauuuacuggguucuaggcucuguaauuacauucacuuuguccaucuaugccagcuacuucuccuacagauccgccauuaugccauaguauaauacuauccauuuggaacuugacccaguauuaaguacuguugucuuuagaaugaugaacagagaggauuguccuauuacuaaaauauuguuccuuuccaugauaauggcaauuaguguauuuucacauauaaccacaucacaaucacccucccuuugcucuagggcagugacagucuuuggaaaacaaccuugacuaauagauuuaguccuacuagaguuccugccuucauucauucauucaacuaauacaacucccucugucacaaggacaaccagcucugagcccucauuguccccugcacuacugggucauuguucucucucaguucucagugcugucucauggguuuccucccucccauccuccucacagcucugguuugcucucuaguugacccuggugcuuggcucagguagauguguuaacauuaagcuguuuaauguucccuacagacgaaaguccuuuguucaaucagcaagaguauauuaugagaccacagugcuccugccacugugccaggcauucauaagaaauauaaauguggccucugcccuuaaagugcuucugucuaauucauaaaaaaugguuagccaggugcgguggcuuacaccuguaaucccagcacuuugggaggcugagguggguggaucaugaggucaggggaucgagaccacccuggcuaauauggugaaaccccgccucuacuaaaaauacaaaaaauuagcagggugugguggcaggcgccuguaguccuagcuacucaggaggcugaggcaggagaauggcgugaacccaggaggcagagcuggcagugagcugagauugugccacugcacucuagccugggcaacagagcaagacuccgucucaaaaaaaaaaaaaaugguuaacauaccugaaguugauagagcucaacuggaguuagaggggagggccuauuauguccaugagggcaagagucauguccauugcauuguuucugaauccuuagaaccuaaucuguugccuggcauggagcagaugcucagugaaaauguguugguagaaugaaugaaugaaugaaugaaggcuaccauguuagaauggcauaauggaagaagcgaaacucaaaacagguguuggaggauggcaaaaguugggauugauguagacaaaaaggaguaaagggcacauuauuaauggaaauaaguacaguuacauaucacuugaugacuggauauguucugagaaauguguuguuagacaauuuuguuguugugcaaacaucauagaguacacuuacuuagacacaccuagaugguauagccuauuacauagcuggacuauaugguauagccuguuguuccuagacuguaagccucuacagcauguuacuguacugaauacuauaggcaauuguaacacaaugguaaguauuuguguaucuaaacauagaaaagguacaguaaaaauauaguauaaaaaauuuuuuuaaaaaugguacaccuguauagggcacuuacugugaauggagcuugcaggaaauggcucugggugaaucagugagugaguaugaaggucuaggacacuuuauaaacacuguacaccaaggauacacuaaauuuuuaaaauuucuuucuucaauaauuaaucuuagcuugcugaaacuuuuuauuucauaaacuuauacuuuuuuuaacuuuuugacucuuuuauaauaacauuuggcuuaacacauauggcuauacaaaaauauuuucuuuauaucccuauucuauaagcuuuuacuguucuuaaauuauuauuauuacuuuuuuaacuuuuuugcuaaaaacuaagacacaaauacacacauuagccuaggccuacacaggguuaggaucaugaguaucauugccuuccaccuccacaucuugucccacuggaagguuuugaggugcaauaauacgcagggagcugucaucucccaugauaacaaagccuucuagguaccuccugaaggaccugccucaggcuguuuuacaguuaacuuuuuuuuuuuuuuuaguaaguagaaggaguacaauucuaaaauaaugauuaaaaguauaguauagugaauacuagauaaggauuuuucagcuucauuauaauaagaccaccaucauauaugcaguccaucauuaauugaaacuucguuaugcagugcaugacuguacagugaacuuacaaagaaugaggaguugcaccugauuggagcacacuuuacauguauugauaaguguuggaaaauaaguuucucucuuuagguagagugaaaggaguucagcccuguuuaauauaaaaaggagucauggaugguuuuugugggugaaugagagagugacaagggaaagauaguguuuaaguggucaggauuauaggagagaagcuggagcaaggaaggucugcaagaaaguggcaaugcaggcauaggcagugagaaaguagaaagagacagauaugagauuuacccccccaacccccccgcgccgcuccaaaacgaagucuugcuuuguugccugggcuggagugcaguggugugaucucagcucacugcaaccuccaccucgcagguucaagcaauucucccaccucagccucccgaguagcuggaauuacaggcaugugccaccacgcccggcuaauuuuuaaaauauuuuuaguagagaugguguuucaccauauuggccaggcuggucucgaacuccugaccuucaagugauccgcccgccucggccucccaaaguguugggauuacaggcgugagccaccgcgccuagcugauaugagauguuuugauagaaaauacgacacaaucucauaacuggguaaggauggauccaacauaacugcaagguaccuagaaaucuuauccaaagguuaggaaggggagaugauuugggagaggacaaaagugguuuuggauaaguuaacauagggaugauagugacauccaguugcuguccaaauagagauuuaugucuucagaaggguagagaaggcacauuagaaauguagacuugagcguugucaacauacagguugucaaggaaucguguagaucuucagugauggcuauuaauuucucccauaaugugcuaguuagaauccagcuuucacaacauugauacagauugaguaucucuuacuugaaaugcuuggguccagcaguguuucugaauuuggauuuuuucagauuuuggaauauuuacauuauauuuuaccaguugaacaucccuaacccaaaaauccgaaauccaaaaugcugcaguaagcaauuucuuuaugugucagguuggugcucaaaaaguuucagguuuuggagcaucucagauuuugaauuuucagaguagggaauacucagccuguaaugauagcaaugauaauguguaacaaauaauagcaucagcagcagcugaguuguauuuccaguauuggugucccauugagauuuggagccacauuaaaugaugucuagguuggugauacucucaggaagugggagguuugggguuuucagagacauauauugcaauucacugggcguuugagugagcuuggaagauugccauguugacuaucuccugccuguaccuccagagcucugcuauagcugagacaggcuuccuacguaaugaguuaucuuugccuuucaugugagcugcaaauguaccauuguacuuccucacuaggcaaaguaauaaguacuuaacauuuaaacauauguugcaacauacaccacaaucucagauaugaguaggucauauucauaaauuauuucuuaaacaaaaauuauaauuguguuucugcugugguauaaacucucaauucccaucagacaguuaucugggccgggcaugguggcucacacuuauaaucccaauacuuugggaggcugaggcaggaggauagcuugaagccaagaguucaagacaagccugggcaacagagcaagacccuaucuuuacaaaaacaaaaaaaaaaaaaacaaaaaaacuagccaggcaccaugguuugugccaguagucccagcuacuuggaaggcugagacaggaggaucacuugagcccagacugcagcgaacuaugauugugccacugcacuccaaccuaggcaauagaaugagaugccgucagugauauuuuucccuugagugacaguuuauuuuugcaaaguuaucucagccuauaauccaguuugauauuuuaaaagaaauuuucucucuaguuaaaaaaaauuaugaagaacaccuuugaaugauuugcaaagggaaaugaauguaguaauccuaugagaaguucgaaggacucuacauuaucugugggaugaaugcauaaagccuuuggugccaugccagacuacuuuuuaaauuauaacuauuuugcagagagcaauacaauugcaaagaauaauacgaagcaaacuugcauuuggauuucuucuccucuacugucucuauaggcuucuuucaucgagacuuaaagccugagaaccuccucugcaugggaccagaacuugugaaaauugcagacuuugguuugg

SEQ ID NO: 16061 - RNA, 1065 nt, Homo sapiens
agcucuggccacaaccuaaucucugcaacccggcuucauugcauuggcuggaaacugguucacuucauccaagggccuaguucgagggcauucauggcuucggcaaguuugagcaucccugcaccagaaauagcaacagcggcgugagucugggggaaaauaguaagcgcccggacuguucuccgccucuuucaggguucguuucugggacuucugauccaggcguucugggccugagagucaggcccagaaccuuggaacccgagacuacucggcccauucgaacauucuccaagaaacugaagggggcggggagacgguugagauagcucagauaacccugcccaguggguccagcaccagccgccuuucaccauagucucaccccugggucuccaagaccgacggccggcauucuggggcccccauucccaaaggggucuugggaaggcccagaugccaagggcaccccuggugacgcccaaggugcuggcagcgagcaagagaggagaaagaggagagggcuggaggagaggcgcgaagcggcccccgcgagccuguguuccgcguacccagucucugggccucucaccucgcuccuggcgcuggcggugccacucagccauggacuggagcauccacuugguccggagcuuguacaaauaggagccguaaaccacgaccucggugaggucugaagacuccagagccuucagcucgagcauggccuugcucaccugcucgauguaagggauucgagauccguccgggccuguuggggaaaagagaugagauccccgggccggcugagacucccgagccggggcagcccgccaguacugggcacacucaccgaaaauggcuuucagcagccgcgucuggaccuggaacaccucuggaucuuucaggucuucgggaacuuucacccacggcgggauaugucuacgugccgggagaguucccaucuuaugacccucacaaccaagaccacucuccagcgcaaaccaggccuaaucacgccggccgaggcucaggggcgauaaagccucgcaccugguggccccg

SEQ ID NO: 16062 - RNA, 129057 nt, Homo sapiens
gccugaggaacccggugggccggggaagugggcgcgcucuguucuccgcggccagcugggacgccgggccagguggggccgccugcguuuagcaacugcuuucucacccccuggauuugcgauguuugccacagcagcgagaagcgccauuguaauggggaugggagggguggagccuccaaguccugucucaauuuagaucucucacucugcuguuaggcgcgcccauuucagauuacuaaacucgaauuaagagggaaaaaaaaucagggaggagguggcaagccacaccccacggugcccgcgaacuuccccggcagcggacuguagcccaggcagacgccgucgagaugcagggcccaccgcuccugaccgccgcccaccuccucugcgugugcaccgccgcgcuggccguggcucccggguaggaacgugggcgcgcggggggcgcgcgggcgcgcgggccugggccgcucugcggcucugggccagggcuucggggagguggcggcugcugugcagcagcgggugggaaaugcccucgcggcugcaguccccagccugguacuggccuggagguuugaccauauguagcuucagcguggcucuccaugggacaguuaacuuucuccacucaugaaguuguuuaagcgucuccccggccauaacaacuuucugaagagagucauuuuauuuuuaguccacauugccucugccuuuugcuucucaacuuuuugcucccagauugcgauucuucucucaaagacaugauauauuuuuucuaaccaagaugucucaaccuuagcauugccaaaguguggcggaggggacugauguauggguucaggggcagacauuauaggaagaaaacaacagcacccaauaauggcaagccccauucauuccuaaagauuucuguaguugagcccuaaccccuaguuauagcagagaaagugcugcuuuagugacuucuuuuaugauucgcuauaccuggaauuuucaccaguuguaguuuauuuucaaaugguauauuucaaucaaugguauugguuaaauaauuuuuuacccucguugggcagcuacucaaggauaaagguuugaauaagaaacaggcaaaaucuuaguuaaaaaauaacaacaacaacaagaaaauaaucacgcugggauaagguccucuguaaaggagaagcuuagagacuuuugcuuugccaauaacuccauuaugccccggugcaagccauuuacaucaugguuccuucugugcgguucgugguuuauaaaauggaaauaauaacacaggccuuccucuaguagugaugcaugaauuacugcauuaaaauugauuuaugggaauuauuguuguuucaguagcauuucaauucaguugccaaauagagcagugggcaauguuaacggaaacaacugcaauuggcgcaguauggagugccuaucgcacuaggaaaucugagggucacaaaagaaaggagaugugaggauaagaaacuuuguuuuucccuuguugggaacucuuuaggccucgguuucuggugacagccccagggaucaucaggcccggaggaaaugugacuauugggguggagcuucuggaacacugcccuucacaggugacugugaaggcggagcugcucaagacagcaucaaaccucacugucucuguccuggaagcagaaggagucuuugaaaaagguaagauaaacagcauaaagucuuacccuucugcaguaauaacuggaauauguuaauaaggucauguguuagguaguauagcagagaaaccccaaauuugcaguaucuuaccuaauauacuuuuaauucucacu[450 bp omitted]uuuguagcagaaccaaguuugguucuuguuucaaguuuggguucugacauggcccaagauuaaauugggccaaugaaugucuucuuuuucagugcuaagggaaaaauaauuuugggaggaagagguaaauacuuaaauacuuaaaacauuuuucauuaaaaugaacuuuuauugcauuuuuuucuuuuuuuagauucuuauaauuauuuuuagagacaagcucucaccauguugcccaggcuggucucgaacuccuaaguucaagugauccacccaccuuggccucccaaagugcugggauuacaguccuaagcuacugcuccuggccgagacauacauuuuuauaauguuaagaguuauuuaaaaaaaaaaauuuaaggcacguaaugaagggugguugguauucauuacauaaguguuuauucucuacaagcguagagaaaugaacaccaucaugaaaugaaauaaaaguaaaaguuuaucugcaucugugguucuuuccccacuggaaguucacuggguagguauauuuggaauaggagucaggaagagaugguguguguaggggcaagucacuuuugucccucauagaagcaaugucagggaagugggaggucuuauuucccuggaggggaaguauagguuagcccuuaagaucugaguuugaauccugguacuacuuugcuacuaguuguaugaucuuagguagguuacuuaacugcuuugagccacaguuuccuugucuauaaaauggaaauaaugaaacugauuucccagggcaguuauaaaguuaaaaucuguauauaguaccucuuaggcaugcaauaaacaacaauugcuaauauuauuaguguaauaauacugcagaagaggaugcagaaaguccauuuccuuuuuacaugggggcagacuucaacuuucguuauuggacuaucauuucugaaaaugaaugaccccugaucuuaugauagucgcuaaagaaaauauugaaauauuaaaucacaggacauaauacuuaagguaguuccacauucauuauuuauucauuaagaauuuaugagugggaagagggaggguauuaaaaaaccaccuauuggguaccacacuuaucaccuggaugaugaaauaacauguacacuaaagcccuaugacaggcauuuuaccuauauaacaaaccugcacguguaucccugaaacuaaaauaaaaguuaaaaaaaaaagaauuuauaauauuggcuccacuaguguggcaguuuuccugcaaugcagagauccagaauauauauggauguuuuugauaaauauuugagcuuugcuuggacauuuacauacucuaauucuagaauuucaccuguuaggucuuuucugugaucucuguuaucagucucucuuuuuuuuugcaacaaauaguaccuacauuggggugcauguuguuguggcuugguuuucagcuuuauucuuagaucuucuuuugggagaaggguuccuuguaugcccauaggaaaguucaaguacucaagacuggggcgggcaaagcuguccugggagcagaauggaucugugggaaggaaggagggaaaacgcugcuucuuucaugggcuguuuuugacucuauugacauagaguuucauugaaaaugccauugcuaggagcacucuccuguuucaaaggagaauguuacuguauuaucagaggcugggaguuauuguucucagagcagaugcuuccuguaaugugaggacuugaggaucaagacacuucucccugcuugucuucacauccuuugcuuuaucuggcuucuccaguuguaacaauauguagauaaaccaggacuucuaaaucaggggucuggaucuucaaguaucuggauguggauucauguuuuguuuuuucuccaucacauaaacaccaaacaccaacaaauaaauaccuuuuauuuuuaagggacagagucucacucuguugcccaggccagagugcaguggugaaaucauagcucacugcaacuuggaauucuugggcucaagugauccugcugucucagccuccugaaucagcugggacuacaggcaagugccagcaugcuagguuuaaaauuuuuuuuuuuuuuguagagauggggucuugcuauguugcccagacuggucuugaacuccugggcucaagcgaucuuccugccucagccucccgaagugcugggauuauggguaugagccugauuguuucauuuuccuaugagccacccccagccccccaacagaagguugguuuuaauaaagauuuaucuucuaguaaaguuggguaaggcaguagacugugucuuaguagcuuauuuccagcaguuuuggauuucuuagaaauccucaggauagggagguguuuuacccaaaccacaauagauuucuggcucaauuuguguuggaaauaguaauaacuaaauuguucaaauggagaauguauuuaauaaaggugaaaaaguauggcauuucuucagggaagaguucauuuguuuguuugacagauaugggggagauuuuauuuacauuuccacuuuuauggccaggaguguagguuauauuacuguuauucauuuaaaaauacauuaauucuacauuuauuggggauugauuguaguuuuuuuuuuuuuuuuuuuuuuuuuuuuugagacacagucucacucugucacccaggcuggagugcaguggugcgaucucggcucacugcaaccucugccucccugguucaagcgauucuccugccucagccuuccgaguaacugggacuacaggcaugugccaccaugccuggcuaauuuuuuguauuuuuaguagagacgagguuucacuguguuagccagguuggucuugaacuccugaccucgugaccugccugccucggccucccaaagugcuaggauuauaggcgugagccaccgugcccagcgauuaugggcuuuuuuuuuuuuuuuggugaauaauagaccuuuagaaaaaguauuucugcuacacuuugcagaguucugggaagguguaucaaugccuuucuaguagugagauucaaaagauugcuugucacuguuaccacugucacugccucuaccacuaucagcaucauugccaucagcuccauagugauuagaacuauguuccuaaucuuaucuuccuuugcauaaagaguuaguuaaauaaacauaacuggcaaaacguaguaaaaguucagcagguaauaauuaccagaggaaagaagauggcacagcuauuggcauuuaaaaucaagucagauuacuguuuuggguggagagugagucugucccuuugucucuucccauauuuuuuuucucuuuccuuacugugaaaggaguuccuugccaaaucaagaaaaaagaaauuaagaacauuuugagaacuguccucucaucuguuaaggcauauaaaauaauuuaauuuucgugauguccuugaaaccauaauuucuguuuuauuuucccuucucuugcuacaauuugacauuuucauuuguaaacuuucaguaguuuuccugaacaagagucacuucaaguaauaaagaauauaaccuuucucccucauuaaugaauucaucaucauuaguuucauguaaaccugauuuaagaaaaaaugcuagaggcugagugcaguggcucacaaccguaaucccagagcuugggaggcugaggugggaggauugcuugagcccaggaguuugagaccagccuggacaacacagugaaauucuaucucaaaaacaaaaacaaaagaacccuuaaaaccaaaaacucccaaaaaccuaaacugaaaaugccuacugaaauuuugggaacucugcaugggcgucuccaggugagugccugcugguuugggggcaccauuuuuuaaaugcugccaauccuacuuccaucuucccauugaguuacugggguggaaugugcucuauaaaugugucuguaacucgcuuuuucuuuuugcccuaaaauccuggagaguuaauggaguguuaaccuuuuuuuaaagauuuuuuaaaaaaucuauuuuuuccuuuguugucuuucucacauugacuaugauauauuuuauuuuccaucuuggcucaguaagggugggaaauuuuuaaaaauugagauauuagcugaaaaacuuaaaaaaucauccaauuugguuuggaugguuuucugguggaaacaaagcuccugaacaugcauuucaugccucguagauaaaaaucagucccauggucuuuaugaaaguagauuaauuaguguagugugugggcagaucucccagagcagguuuucacaggcagcuuugccaacauaacucagucugaaccugcaguuauguuagaauuauuuuuaaaggguguaggcuuuucauucacacaucgucuuuguucuugugugugauguauauuaacagguaggugguaccugagaauaaaggaccacagcauaaucacgaugugccugggcucuggagccuggcuaccugggcacaggugcuggccauuccacuuagugguuguguggcugugggcagucaugaucucacuaggcuucaguuucaucaucugaaaaauagugguuucugccuuauacaauuauauggauauugugaggauuaaaugagguaacauauucaaggcacuuaacacaaaggaauuauucaagaaaaugguagcuauuguuacuagaagagaguagcaacaguuuaugucaaaggcaauuauuaaucaccuauugugacaaucuugaaccgggaacucuauaaaagacacaucccuaggaggggauuggaagggauuuaacauauuaaauauccaguuuccucauagugccaaggacuuuaugcacuauauuuaauuuuaacaacuugaugaaguagauacucuugucuucauuuuggaggugaggaaauugaggcaaagagagaagaauuaguuuuucugaguuaacccaguuaguaaauggugaagccugaauuugaaguuaguuguaucugagguccagagaccauaagguuuucuauugcugggaagagagugaaguauuuuuauuuccuugauuuugggauauugaugcaauguugcaguugucuuccacuaaaaucauuuucacauuugcuugcaguagauagaccuggaucuaaugaaaucuaauuugaaucgaaagaauuacaaaaugaaaugccagcucuccucuuaauuuacuuucagccucauagaguuuuggagcuggaggggaccucaaagauaagcaaauucaauagccuaauauauggcugggagacugaggugaggcaugggaucuggggauuuucccaaggucaaaucacuuauugguggcagagcuggaaacagauugcaguuucccaaauuugcaguccagugcuauuuccaguauacucuacgaaaguuuccuaacauauggagagcugagcuuaagaccuaagauauauuuacaaaugcugauucuucugauauggaagaaaauaaggcuaacuaaggaguuuaaaaaugcuuacuugcauacugugaaaguuucuuauuuuagcucaagguggaguugcucuuuaugcacuauuuguucuguauaaggggugggggcuggguuagaagcuucauagaccuuuuaaaaacuaaauucuguugcuuuguuucucagaguccaaauuguauuuauuaaaaaggcugauucauggccucccucaagacauggguaagaaucaagaaucucagcugggugugguggcucacgccuauaaucccagcacuuugggaagccaagguagguggaucacuugaggccagaaguucgagaccagccuggccaacauggugaaaccccgucucuaccaaaaacacaaaaauuagccaggugugguggugggcgccuauagucccaguuacuugggaggcugaggcaggagaaucgcuugaacccaggaggcagaggcugcagugagauuguaccagugcacuccagccugggugacagagcaagacuccaucucaaaaaaaaaaaaaaaaagagaaucuaaccuuuauguuccaccaugaccacaggugauucuuagucacauuagaaugagaacaacugcccuuugguaucucacaaauuguacucgaccaaauacuggaaagcucgagggugaguagcaugccccugcaagccugugaugauucauggcggcggagggaaggcuccucguggacuuucauguuugcuuuuaagcaacccucaacccuaagcgcugguguucauuuucagccgcagagaaacaugacuugggguuugauugugaaucaacgauugggugaaguuaaaagugaacacacugauucuuuaaacuccaaguuaaacaugugcugcuccucuucuagcacuggaugagucacuguccuagugacucacugaaggauugugguggaaauagaaaacagaucccauaagaauuugggcuggguuacuguugauccuuuauguccugugaagagggcuuuauaaugcugaaacuaguuguuuccccacagacauuucuucucauuaauguauuauuuauugauuauuugcuguaugugaaacaugaaugaauggggaguggggaauaagagaaaggaaggcacuggaggacauucagaggucccagaaggauaauauaauauuaaaagugcagaaggcuagaggaguuuuuauuuuuuguauaaaaaauacaaugcgguuuguaaauagugcuucuuguaugugagccugugccugguacuauuaucuuuuacuuccagagcuauacagauguccauucauaaaugucccaccucugcugacauauuuggccuuuggagggaacaguuacuucacguacuagagacgggaagggugugccggaggaaagagcugcuggcugguguggcaguuaugaaaaggagauagggguuuguguauauauuuucuaaaaagauguuucauucugcuuuggauaugaguuuggggagacauccagguggagauguccagcagauaguuuugaaauugcagcuggggagagagauuuaggcauuauuuucauagaggcagacaauauuuugaaguccuggaaauacauaagaugcacaagagagacagagcucauggaaagaacaagucuuuugagagaagcuuggaaagaggaaaauaaguuaaugaagggaaaaagaccagacacaguggcucaugccuguaaucccagcaacuugggaggcugaggugagcagaucgcuugagcucaagaguuugaaaucagccuggacaacauauuggaaccucaucucuacuaaaaauaaaaaaaagguagcuggacguggugacaugugcuuguagucccagcuacucaggaggcucaggcaggaggauuucuugagcuacaguuauagugccguuguacucuagccuggguaacaaagcauggcccugucucaagaaaaagaaaagaaaagaaaagaaaagaaaagaauagaauagacaacgagcaaucagagaaggguaaauugaaaaugucucagaagccaagggaagaagaaguuccaagaaggaagguuuaauaguuaauaaucaauucucucaggucagagaagaggaggacagaggaaagaacauuggugacgcuuaaguaaauggcuuuaaguugaauguuggaagcaaaagcaaauuugagggaauaaauggauggugaaaaauauaaucaaaauuuauucuuuccagaaguuugguaguugaaaggagagagguggacggucucucaaaaggcacauuagaaaggugaaagugguuaaggcaaaggagaggguggauaauuccuggguuagaaguggugagaucaguauuggggcagaggcaaguggauuauccuuaaaaaacccucauacuuucuucuuugaagaaagaaagaaauagaagagaaucauuaaggaaagaaauauuuugagguaugaaauugagaugaagaauaaaauugaaauacaguuuuaggaaaacuuauuuaccgacuuguaaauugcacagaucuggccaccacuuuauaggaaauggggguaaaaguuaaaaguaguggcagaccagaaugagaaacacaggacuggagaucuucccugguggugcccuaaacugggucaccgcuggauuguaggaaauuagaauacaggggcaggaagucauauuuguaucugggagagcuaacacagggaggagagagaagaggaaagggcuguuuacgaugaagauaugccucaguugaagcucgagaggacuggguggaguuacuuuauuacugccaugguugucagugaauuuguaauucacucuuagugugggccaagaugaccaaggugcaaugauaaaacuugucuaggaggauuaaaguggaucuuggucuugcucuaucucuuucacucuucacuuaccucggagaauucuaugaggagacuuucuuccguugcaaggcucagggugaaauuggucaaagauuugguggaggggguagcaguagguagguagaugacaggucuauagguuguuaguucugaagaaacgauucauaaauuaaaauccgaaaaccagacugguaaagagcuuggaaauaaaugaagaggaaaauuuuuaaagaacaccuaguagcucccuuuuggcagggcuguguuaggaauuuacauuuaugaaaauauagcuggcagaaaugauuuaguauuacaaacuuaaguuucacugcaauauauguuaaagcuccucaggaauauagauaagacagggaauuuauuauucugagcaauucaaauuuauucagcaccaaauugccuauggcacaaugcugggugacauaaauauuuggugaccacaugagguuccugugccugugcucuucgcagggaagcagaguaggcuucauuugauguguccucccacguugauuauagaggcuuguucgggugccguguugacaguuucaaagucaagcguggguuuacuggacuagagaacuggaugaauuagcugugucugccauggccaugggaguuggggagugugguaugaaugcugcgaaggauucuguagcccauccauaaacuuuauuuauggaucaguugaagaggaauggucuaagaggaacgguuaucuacguagcuacauaggggcuugagguaguaacaacauggauaagagagaacagacgaaagaguggguguauccaaauaguaaaugagaguggaguaagcuacagaggaggaacaaggagggaagggauaugagguuauguuugcacuacuguuuuggaaggaauagcugggucuguccugcacuguuugggaggcacaguggguuagaaugggugcucaggaaccacacugaaauugaacccuagcaucaccuaauaguaguacccaccucguagcauuguugagaggauuaaaugagauaauacuuaagagcuguaucauccaauaugguagcuacuaaccacaugugguuuuugagcacuugaaauguggcucauacaaauugagaugugccaggaguauaaaauacauaauggauuuugaauacuuaguuccaagaaaugcaauaaaacuuaugauuuuaaaauaaugauuucauguucaauguuaauauuuuggacauauugaguuaaauaaaauauguuauuaaaaguaaugucacccaauuuuuucuuuuuuuggcacauaaaagacaccuaauuuaauaaauauuaguuauuauuuucucuuuuauuaugcaguuaagaacuuugauuuaaaauuguuaucuuuauauauauauauauauauauauauauauauauauauauauauauauuuauuauacuuuauguccuaggguacaugugcacaacaugcagguuuguuacauauguauacaugugccauguuggugugcugcacccauuaacgcgucacuuacauuagguguaucuccuaauacuaucccuucccccuucccccaucccacgacaggccccggugugugauguuccccguccuguguccaaguguucucauuguucaauucccaccuaugagugagaacaugcgguguuugguuuuuuguccuugcgauaguuugcugagaaugaugguuuccagcuucauccaugucccuacaaaggacaugaacucaucauuuuuuauggcugcauuguauuccaugguguauaugugccacaauuucuuaauccagucuguuguuguuggacauuuggguugguuccaagucuuugcuauugugaauaaugccucaauaaacauacgugugcaugugucuuuauagcagcaugauuuauaguccuuuggguauauacccaguaaugggauggcugggucaaaugguauuucuaguuauagaucccugaggaaucaccacccugucuuccacaaugguugaacuaguuuacagucccaccaacaguguaaaaguguuccuauuucuccacauccucuccaguaccuguuguuuccugacuuuuuaaugaucgccauucuaacuggugugagaugguaucucauugugguuuugauuugcauuucucugauggccagugaugaugagcauuuuuccauguguuuuuuggcugcacaaaugucuucuuuugagaaguguguguucauauccuuugcccacuuguugaugggguuguuuguuuuuuuucuuguaaauuuguuugacuucuuuguagauucuggauauuagcccuuugucagaugaguagguugcaaaaauguucucccauucuguaggcugccuguucacucugaugguaguuucuuuugcugugcagaagcucuuuaguuuaauuagaucccauuugucaauuuuggcuuuuguugcuauugcuuuugguguuuuagacaugaaguccuuccccaugccuguguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucuuguuugugucagguuugucaaagaucagauaguuguagauguguggcauuauuucugagggcucuauuguguuccauuggucuauaucucuguuuugguaccaguaccaugcuguuuugguuacuguagccucguaguauaguuugaagucagguagcaugaugccuccagcuuuguucuuuuggcuuaggauugacuuggcaaugugaguuguuuuuugguuccguaugaacuuuaaaguaguuuuuuccaguucugugaagaaagucauugguagcuugauggggauggcauugaaucuauaaauuaccuugggcaguauggccauuuuccugauaccaaagccuggcagagacacaacaaaaaaagagaauuuuaggccaauaucccugaugaacaucgaugcaaaaaucuucaauaaaauaccggcaaaccaaauccagcagcacaucaaaaagcuuauccaccaugaucaagugggcuucaucccugggaugcaaggcugguucaacauaugaaaaucaauaaacguaauccagcauauaaacagaaccaaagacaaaaaccacaugauuaucucaacagaugcagaaaaggccuuugacaaaauucaacagcgcuucaugcuaaaaacucucaauaaauuagguauugaugggacauaucuaaaaauaauaagagcuauucaugacaaacccacagccaauaucauacugaaugggcaaaaacuggaagcauucccuuugaaaacuggcacaagacagggauguccucucucaccacuccuauucaacauaguguuggagguucuggcuagggcaaucaggcaggagaaagaaauaaaagguauucaauuaggaaaagaggaagucaaauugucccuguuuguagaugacaugauuguauaucuagaaaaccccauugucucagcccaaaaucuccuuaagcugauaagcaacuucagcaaagucucaggauacaaaaucaaugugcaaaaaucaccagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaacgaaauaaaggaggacacaaacaaauggaagaacauuccaugcucauggguaggaagaaucaauaucuugaaaauggccauacugcccaauuuuuucuauuuuuuuuuuagugcacaucuuuaaaacauuuaucacaaugcuugguacauagaagacaccgagggaauguuaacuauguuguaccugguguuucucaguaucagauauuaauacugaugccugaccacaagccuguggcaugaguccaagucucccugcugaugacucauuuuggcuuagguagaucuucacccuuaucccuuaucccuugaggaagaagaaaaucucccuaaagagagccacaggggucggcaaaauuucuguaaagggccagauguuaagcauguagguuuugccaaccuucaggucuuuauuacagcugcucaacucugccuuuauagcucggaagcagcuguagacgguucauaaacaaaagagcaugguuguguaccagcagaacuuuauuuauggaugcugaaauuuugaguucauauaauuuuuacuuaucaugaaauauucuucuucuuuugauauuccccccagcuauuuagaaaugcaaacccauucuuaguucaugaacuguacaaaaaacaggcgugggccagacuggaucuguaggcuguggauugcugacccugccauuaaaaaugcccuguacauuuagcagccaagaaccuugcuugacucuggguuuuucauuuguacuuaaccuaacauuugcuuuauaguguaccauuuuauuuauuuuacuuuuaguagguuuguguuugaccugcuuuuuuuuuuacucaauguuuguguuuaaccugcuuuuuuuuagacaauggaacaaaacuuuguuuaugaaacucaaauuuauuaagauauuuguaagcaaagggaaauaagagagaaaaauauaaaaggaguauguaagggaccaaaggagauuuuuuguuugguuuuguucugcucagaauacuuguguuuucuguguagacugaauuuacccaauaguuuuuuugccuuaaagugacauuaaacugugaagcagaaacauuguauuuuuaaaaucguacuuuaaguuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuuuuguauuuuuaguagagacgggguuucaccguuuuagccgggauggucucgaucucuugaccucgugauccgcccgccucggccucccaaagugcugggauuacaggcgugagccaccgcgcccggccuaaguuuuuaaaauauuuuauuuuuauagauuuaggggguacaugugcaguuuucuuacauggauauuuuggguagugguggagucugggcuuuuaguauaaacaucagccaaauaguguauguuguauccauuaagucauuucuuaucccuuaccucccugccauaugaaucuccaaugucuauuauuucacucucuaaaaaauauuguauuuuauacaaaaauuagccggguaugguggcgcaugccucuaaucccagcuacuggggggcugaggcaggaggauugcuugaaccuggaaagcggagguuguagugagccgagaucaugccacugcacuccagccugggcaacgaagcgagacuccgucucaaaaaaaaaaaaauuguauuuuaaaguuuuguuuuccaugaauuuguggggggaaaacccuuauuucuuaccuuaucuguugaucaaagaaacugcugaagaaugaggaaaaaaauuuaguaacuugauaaagagaucaaaauuuucagcuaaaaaagugauaauaaauuuauuauugcauaagacugaguagcaaaaggcugccaaaaauaauuaagcagcaaacacuaagucaggcauauauauauaucuaguggaaaauccacuuuuuuuuucauagagaguauuucuguaccuaguuggauuuccgguuacacacuacuccuucccuucaaugauuuuccaaaguuauuuggugaggacagaugucagaagaggcagcauauaaugguauuacagaguauguuuaaaaaguuaaggaaagguuaguuuuuguguaugcuuauuacacaauuuaaaaauagcuuugacucuauuuguaaaucaaauggccaguucucaggcugugccaaaugcgaagccuucaaacaagguuucuucugaguugcuuaagcagcccugggaaggagaaagcaucugaaaggguuuucagauugauugucucugguuauacacagaaaugauuggaguuuuauaaaguuaucuauaaaaacacuaagaagaaccuuacauaacagagugugucuuuaguuagugauuuaaaagagugccauacuggguuucaagagguggugaccauuucccgugucugaauggagccucgccaaaagggagaaaaauguucacaacaguuugcaaauacuaucuauuuaauucucaaccuagcaacagcagagaaagagauuauuauuccucucucaucuaugcugcccccacucuccuccccgcugcccccgauuuuauguuuugguuguguaaauuauugcuaaaugaauagaacuuucaaauaaguccuaugcuaggacuucauaagugccuaggaaauuccaagcuguauuuguaaauuuaaagggaagaucagcagaaaaaaaugucaaguacuuaaaaucgacuuuuuauuaaggacgcaugagaccagugaguaggccuuagauuggauguguccacauauccucugagucgcucccuggauccagcaagaaauaggggugggugggacaucuuugucccuacaccauagcguuggggaagagucuuuguauuuuguauuuuuauuuuuuuuuuaauagagauggggucacacgauguugcccaggcuggucuugaacuccuugccucaagggauccuucugccucagcccucccaaagugcugguauuauaggcgugagcugccacaccuggccuggguaggacuucuguuucuagcucuguaucuuucuugcaucugugaacagauaaggucaugugucugagcaguaggacccaggcaugcaguugaacugcucguccaacuucucucuggugagagaauuccucaaagauuugacuucauucagagcugcauuaaaaacaaaagacaaaacaaaaaacacuucuacuaugaaaugagauuuccugcacuucaaaucuguuuagcuuguuuugaagugccagaaugcuuggccuccaauuagucaaucuccgagagccucauuuggauuguagacucccaacuguuuuuuuacuuucuccuugcugaugucauuggauaaaaauaaauuaccaccccucccccgucguucuucaucuuuguaaauuugcugccggugggugguagcugguaucagaccagggcaggaaggaagcacauugcuuccuccaguuauggagcuagcauaauagucaaccccugaugauuuaucuuaauacaaugaaaaauaaguaacucucaauaauggagggugcugguuuguuggggcgaagcucacugcaguuuguuucuauuuuauuccaaugugggacauugugguggaugcuguguuuuagggcccagaucgcucuuuagggaugaaggacuuuuucccgaaagcugcuaggaguguugugcccgacugccuucagagccaguugucucugaugaucguaucagcuagagaauugccuugcccaugguggccucccuccuggggauggccuguauuaugugacugauugacgugggguaugaaggucuggcccuuucgccccaguucaggacaacucucacuggcccugacugcuucugagcugcccugguggaugccucuuuggagccugcauugcagccccacugcucucuccccuagugcaguuucccccuuucccuucugcaggugcugauccaccgaauacuccuuaguaaaccuccugcauuguaauuaccgucucagaguuggcuacuguuuaacuuuccuuugaagaggaauguuucagaucuuggaaucaacuucaaacaugucaaaacuguguagugugaagaauugacaugaguugggaaagucuuucguuuuuauauccuuuucagaguucuuguaugacacaaaauauuuuagaguuagcuccgcuacugcagugcuuggaguauaacucuaaguuucuucuaagagaaacuucauggaagaagaauccacagguuuuggugagugauaaacuuagaguugaggagagaaaagaguucaagaugauugagauuuugaacauccaugauugaggaaguggugauagcaacauauacaaacaggcuauacaggcaguggaacuuuuacuauaaucaaagauauguauaaugaaaacaauggugaggcacaaggcuggguccaguggcucacgccuguaaucccagcacuuugggaggcugaggcgggcagaucacuugaggucaggaguucgagaccagccuggccaacauggcacaacccugucucuacuaaaaacacaaaaaauuagccagcugugauggugcuugccuguagucccagcuacaugggaggcugaggcaugagaaucucuugaacccgggagguggagguugcagugagcugagaucgugccacugcacuccagccugggugacagagcaagacucugucucaaaaacaaacaaaaaaccagugaugaggcacggugacucacaucuguaauccuagggccuugggaagucaaggugggaggaucacucgagccuaggaguuugagagcagccugggcaacauaaugagcccccauuucuacaaaaaaguaaaaaaaauuagccaggcaugguggccugugcuuguaguccuaguuacuggggaggcugaggcaggaagaucgcuugaguccaggaguuugggguggcagugagcuaugauugcaccacuguacuccagccugggugacagagugagacccugucuccaaaaaaaaaaaaaaaaaagguauguauaauaaaaccaacuauacaacugauucuuuuuuuaauuuuuaauuguuguggauacauagaagauguauauauuuacaggguacaugagauacuuugaaacaggcaugcaaugucaacaaccacaucauaguaacugggguauccguucccucaagcauuuguccuuuguguuacaaacaauccaguuauacuauuuuaguuauuuaaaaauguacaaucaaauuguuauugacuacaguccuccuguugugcuaucaaauacuaggucuuauucauuuuucuaacuauuuuuugugcccauuaaccauccucacuugcucccuaacccuucacuacucucccuagccucugguaaccauccuucuacacucuuaucuccauuauuaguuaaauuguuuuaauuuuuagcuaccacaaauaagugagaacaugcaaaguuugucuuucuguguuuggguuauuucacuuaacauaaugaccuucaguuccauccauguuguugcaaaugacaggaucucauucauuuuuauggcugaguaguacuuaauuguguacauguaccacauuuucuuuauccauucauuuguugauggacacuuagguugcuuccaaaucuuagcuauuaugaacagugguguaacaaacaugggagugcagauagcucuuugauauacugauuuccuuucuuuuggguauauacucagcagugggauugcuagauuguaugguagcucuauuuuuaguuuuaugaggaaccuccaaacuguucuccauagugguugugcuaauuuucauuuccaucaacaguguaugaggguucccuuuccuccacauccucaucagcauuuguuacugccugucuuuuggauaaaagccauuuuaacuggggcgagaugauaucucauuguaguuuugauuugcauuucucuaaugaucaaugguguugagagggccuuuucauauaccuguuugccauuuguaugucuucuuucgagaaaugucuauucagaucguuuucccauuuuuaauuggauuauuagauuuuuuccuguagaguuauuugaguuccuuauguguuuugguuauuaaucccuugugagaugaguaguuacaaagauuuucucucauucugaguuguaucuucauuuuguugauuguuuccuuuauugcgcagaagcuuuuuaacuugacgugaucccauuugucgauuuuugcuuugguugccugugcuugugggauauugcucaagaaaucuuugcccaguucaguguccuggagagucccuccaaaguuuucuuuuaguaguuucacaguuuuagguuuuagguuuaagucuuuaauccauuuugauuugauuuuaguguauggugagagacagggucuaguuucauucuucugcauauguacauccagauuuccuagcaccauuuauugaagagacuaucuuuuccucaauauauguucuuggcaccuuugucaaaaaugaguucacuguagguguauggauuuguuucuggcuucucuauuguguuccauuggucgugugucuguuuuuaugccaauaucauacuguuuugguuacuauagcucuguagcauaauuugaagucagguaaugugauuccuccuuuuuuuuuuucuuucucaguauggcuuuggcuauucugggucuuuggugguuccauaaaaauuuuaggauuuuuuuucuauuucugugaagaaugccauugguauuuugauagagauugcauuaaaucuauagauugcuuuaggcagcauggacauuuuaacaauauugauaauuucaauccgugaacauggaauaucuuuucauuuuuuuggugucaucuucaauuuuuuucaucaguguuuuauacuuuucauuguacagauuuuucacuucuuugaucaaguuaaugccuggguauuuaacuuuauuugcugcuauuguaaaugggauuacuuucuugauuucuuuuucagauuguucacugcuggcauauagaaauucuacugauucuuuuuuuuuuuuuuuuuuuuuuuuuugagauggagucucgcucugucacccaggcuggagugcaguggcgcaaucucggcucacugcaaacuccgccucccggguucagggcauucuccuaccucagacuuccaaguagcugggacuacaggcgccugcaaccacgcccggcuaauuuuuuguauuuuuaguagagacgggguuucaccguguuaaccaggacggucucgaucuccugaccucgugauccgcccaccucggccucccaaagugcugggauuacaggcgugagccaccgcgccuggcuucuacugauucuuguauguugauuuuguauccugcaacuagacugaguuuaucaguucuaaucguguuuugguggcaucuuuagguuuuuccaaauauaagaucauauuggcugggcguggugacucaugccuguaaucccagcacuuugggagguggaggagggccagaucacuugagccugggagucugagaccagccugggcaacauagggagacccugugucuauuuaucuuuaaaaaguaaauuaauuaaaaauauuauaucaucugcgaacaaaaauaauuugacuucuuccuuuccaauuugccugcccuucauuucuuucucuugucugauugcccuagcuaggacuuccaguacuauguugaguaacaguggugaaagugggcauucuugucgucuuccugaucuuagaggaaaggcuuucaguuuuuccccauuuaguaucauacuagcugugggucugucauauauggcuuuuuuuauguugagguguguuccuucuauaugcaguuuuuuugaggguuuuuaucaugaagaggugcugaauuuuaucaaauuuuuuuaaauuaucaauugaaaugaucauguaguuuuugcccuucauucuguugauaugauguaucacauugauugaugugcauacaacuuuuuuuuuuuuuauauucagagucagugcagagcagugguuuagagcucaggcccaugagucaggugguuagggucagaagcuuggccccacuacuuuuugucugugugacccugggaaagucauuucacaugucuaugucucaguguucucauuuguaaaauaaggguaauaauacuuaauaguauuguugugagcuuuaaacucaauguauguaaugcuuuagaacacucuguaagugguauguacuauuauuauuauuuuauucauauaacuaaaaaauuguauucugucugaucuguugguuguuucauuguugcuaaacacaaauuuaagucuucuauccccgugaccaguucuguccaauacaaguauaagucaacuacauaaguuauuggcaauuuucuaguagccgcacuaaaaaagaaagagaaacaggugaaauuaauuguaauaauauauuuuauuuaacccaauaauuuacaaguauuauuaguucagcauuuaaucacuauaaaauuauugacaugacauuuuacauuuuuuugguuguaagucucagaaauaugggguguauuuuacacuugcugcuuauuucaguggcucaauagccacauguauuuagaggcuccuguaugugacugagcagcuuuaaagaguugcuaguuaaucuugcucauuucugaaguguuccagucaacuguugcugugaaauaagccgcccccagauuuaguagauuaaaacaacaaugguuuauuauuucucacaauucucauuuagccuauacaugcuagauugaugauuauugccauuauuuuugugauaguugugaauuccaugauaguuuuugaauuccacgauuccuucuacauuuauuaguuggaauucugugguaaggaauaacucuuucuucucuuucacucagucauauauuuaauuguacaucagcaugaacucauagauucuuguuguauucaguagguuguaacccauuauuuauuuuauuauucaagugaucugaccauaauauuuuaaauuaagaaaacacccucuccacacaugcucagguaccugaugagaucagaacaaauucugcuacauggaugguauucucaauuccaucccccaacacccccguauugcaauguuuaaauguuucagcccaaauauuucacagggucugcuugcagagccccaugcuucucuucaacaaauguuuuuacaggacaaaauuuguccaguaaauugucucuauuuaugguuccuuugaaaguuuuaccaaguuuacuugcugaaauauccuagggcuuuucaauuucacuucaauucaguauagaauauaauaagucuuucccauuaaaaguaagcuuaaugaacagaaguuucuuccuacaagguaagauacucccaaaguauaacugguguauauccaaagauaugaaaucaguauguugaagagauagcugcacccccacauccacugcagcauuauucccaauaucuaagauauggaaucgaugucaguguccaucaauggauaaauggauaaagaaagugugguauauauacguaauggaacacuauucagccauuuuuuuuaacaaaaaaaauguaaaaagaaggaggucuugucauuuucagugacauggaugaacuuggaggacauuauguuaagugaaauaagccaagcacagaaaaacaaauauugcaugaucucacuuauauguggaagguaaaaaaagaugaacucauagaaacaaaggguaaaauggcaguuaccagaagugaaaggaauggggagauguuggucaauagacacaaaauuucaguuauacgggaggaauaauuucaagagaucuaguguacagcauggugacuaugguuaauaucaacauauuguauacuuaaaaauugcuuagaguagauuuuaauuguuccuuuccacaaguaguuaugugagguaaggcacauguuaaauagugugguuuagccauuccauaaguuauaccucauuccauaagguauacaucuaucaucuauaugucgcauaccauaaauauauucaauuauuacuugucaauuaaaaaaagaauaaaacauuuucagaguuaauuuaugugcacauuaaacccauccuagaauaauauuuugcuaaccaaaaaaagauccaggacaaaugcuaaaucaggaugcuggaauaacagcgucaacugggauaauccuggugaggccucaucuuguccaaagacccccuuuugauugggccaggccuccuggcuacugcugucuuucuggcuguggucuuugcucacccagcucuuugguuugguagacucagguugaucuccacugcuuugcauuugcugcucuuuugccuguaacauuguaccccuccuugcucauauggcuaauuucuccauauccuacaaccuuagacacuggcaucguuuucucuaggugccuucccuucaucccuccaaugugcuccuuguccuaccuguacuauguauaucuguuccacgauacuuccuucuucaccuuuuugaaacaccauguucaauauccuguuauuuaagagucuugcucuuugcuuccuaugauaacaguuauuagaggaacugaucugugcuaggugguaagugauggugaugaauuacuuaucuguuccugaaaacauacuuguauuucauggaggcccacuggggugguagucuucaaagugagugugcacacgucuaagaguauaugagaccauuuauaaggauggaaguagaaaauguaguaauuuuuauuucuuuuuuuuuuuuuuuugagacaguaucucccucuguagcccaggcuggagugcaguggcacgaucuuggcucgcugcaagcucugccuccuggguucacaccauucuccugccucagccucccgaguagcuaggacuacaggcgccugccaccacacccggcuaauuuuugguauuuuuaguagagaugggguuucaccauguuagccaggauggucucaaucuccugaccucaugauccacccgccucggccucccaaagugcugggauuacaggcaugagccacccacgcccggccaguaauuuuuauuucuauuauuuuauuaagcaaagcuaagaaguuaaaguguuucucuuuuucuuuuuauugauuuauuuauuuauuuuugagacagagucuugcucuguugcccaggcuguagugcagugaugugaucucagcucacugcaaccuccaccuccuggguucaagcaauccuccuuccucagcuucccaaguagcugggacuacaggcgugccacuaugccuggcuaauuuuuguaguuuuuaguggagaugggguuuugccauguuggccaggcuggucucuaacuccugacuucagguguucugucugccucagucucccaaagugcugggauuauaggugugagccacugugccuggcuauaaaguuuuucuaauguuuaauauuuugguugagaaaauacauguauauaauuuuauaaaucuaauuugacauugguaagguauacuaaguauuuuuauugauggaguacucuaucauaaaaauuugaagacuacgucuauaggggcauaugacauccucaauggaaaacucuucaagcuuuuugacacuauaauagcuaacauauuucaaguguuuucuaugugucacgcacuguucuauaugcuuuacagguaucaacauacguauuccuuauaaccaccucaugagauugauaugauuauuagcauccucaucuuauggaugaaaaaaauugagcuagagaaucagguaauuuguucaaggacagggccaguacauaucaaauucuugauguggucugauuccagaugcugcuagcuuaaccccugcuguguacugugcugugcucuggugccucugcucucacaugauagacccauuuggcuuccuggaggagagggaccacaucugucuugcacauugugcuaguuuuuacggggccuauuauuuccuucucucucuuuaaaaucaucuuuugcuccauuuuauuucccaagggccugccaucuucgauaggaacuuuggacaaguucucuuuuauuuuuaacaugaaaccauuuuuccccuugaaauaaauggaucugaugagaaauuggcaugaguuuaauuagcaguccuauguauagaaacuuuacacgaaaaaagucugcaucaccccaguacucacgagucaguuaugagucccagcucaccccugacaugacuaaugccuuccuuucuuccuuuaucacgaggguaugaggacaagaaauaaaccucagacuacuucuguacagcgugugaagugucccgcaagcacguauaaccuuaaaauagcaacaagggcagcagcaacaacgacaacaaaaaugauaauggcaaagagaagcagaaccuaauguuuuuuggguuugcccacugauacccuuuuaauccugauuuuuaauuguuuggcacaaagauauguaauaauuucuugggucuucugggcauuuaaaugucauuuugguuucaccaaauguauuuaugauuccaccuacacauguaagaguauugggagaguuuuggaagguuuguauucuaucaucauauucaaauugugcuaacucuguuuucuuuccuguuuuccuuguaggcucuuuuaagacacuuacucuuccaucaguaaguauccauuuaaaaaauuugguuucagaaauauauuguaucagugaacuaaauaaauuaauauuuuauuggauuuuaugucaauucacacauuucacguuucauguaaguuuggcuugaguuuaguucagccuucagauuauuuaugaauaauauuauuucaaggagauugauuaugaggcucuucaaacucuuggcagagauuuuccucuuguaaaauagaagacuucacugaaggaaacuggccuggacuauuagcacagaaaucuggacuggucauaaaaaggaacgagaccauguccuuugcaggaacauggauggagcuggaggccauuaucuuuagcaaacuaaaauaggaacagaaaacuaaacaccacauguucucacuuauaagugggagcugaaugaugagaacacauggacacauagaggggaacaacacacacuggggccuacuggaggguagagggagggaggagggagaggagcaggaaaaauagcuaauggguucuagguuuagcaacugggugaugaaauaaucugugcgacaacccccaugacacaaguuuaccuauguaacaaaccugcacuuguaccccugaacuuaaaauaaaaguuaaaaaaaaacaaggcaucugggcugguuugcuccugcuucugucguaaugagccuucuaguguggaacucugcuccucaguuuccuugugcuugaaaagagcagugccaugcugagacauacuagaacuugaggcaaaaggaaaaaucaguaauauugacccugucuuuguuuaaaacuucgacuucuuuguuuauaauuuuuugcauuaauuuugauauuuuaaaauauuguauuaaaauauuauuuucuugauugcuaaauuuuuugguacccccuuaaauuuugcaccuuagacaagugccucacucaccucaccauagcccuggccuuggaaaagagaaugaagauaccaucuuuaucucacagcauguccuggagugaaaugagauguggaaguguuguagcacuugcuauagaaauggaaaggaguuauuauuuuguugagagauucauaaaaccuuauuauuaaauguuuguggaugaaucuuccuauagcuuugauuuggaaguuuauacuuucauuacuaugcuuuguuuuggggcuuuacaugcuuaauguacaguauaguaaaccacagcauccaacaucaggugcaguuugauauauguacuuuucugagaacagaggacuaaugacuuaggcccugacacacuguauaccugauuaguaucagcauuaccucauaagccagguucgcucauuaccuuaaauuuuuuuuuuuuuuuuuuugagacaggucuuggucuguugcccgggcuggaguucaguggcacaaucauggcucacugcagccucaaucucccagguucaagcaaucuucucaccucagccucccgacuacuggcaugugccaccaugccuggcugauuuuuuauuuuuuguagaaacagguuucccuauguugcccaggcuugucucaaacuccugggcccaagcaucccuccugccuuggucccccaaagugcugggauuacaggagugaaccaccaugccuggcccacuuaguaccuuuugaaaguuacuugucaaguacauucagaaaccacauuuauuuugggggguucauagagaauauuauacucucaaacaauacuuuauaaaaauuacuuaguaugcuauaucuauucuguuuguuacauauuauauuuguacuuucuuuccuaagaaauauacugcugcuaauaauagaaaguggaagaaaaaaggcauaagcaggcagaagugggggaaaaaaacccugcaaucuuuguggcaauaaaacauuagauugcauuaaaauaaccuaaaacauuagauacuggccccagugccugggcgcagaacuuuguugaaaggguauuccagugguaagaugaaaauaaauccugugucguauauuugcccuauagcagaaggagggugggguuuaagcucaggaaucacagccuaaagcacaauaauugucugguuuccucaaaggaguuugcaguuucacauaccggaaguguagaaaggcugaaaggagaaggcggggcaagggcaugagaguuucuuucaaugauacuaguauaaacuguacgugucugagcuaauauuaacuagaaauuugucuacuacacuucuuuuuuuuuuuuuuuuuuuuugagacagaguuucucucuuguugcccaggcuggagagcaguggcgcgaucucggcucacugcaaccuccguuucccggauucaagagauucuccugccucagccucccgaguagcugggauuacaggcaugcaccaccaugcccagcuaauuuuuuuuuguauuuuuaguagggacagaguuucgccauguuggucuggcuggucuugaacuuccaaccucaaguaauccgccugccucggccucccaaaguccugggauuacaggcgcaagccacugcgcccagccuacuauacuucuuuuaagucuuaaguauaugaaauacuaacucugacauccaguauuugucuuuaauauuaugucauuucaauuguauauaaauauagcuauuaucuauugaaagcuuuauuagagauuauauuuuggaguguaucucuuuuuaguaaagcacaguaugaaagacuuagaaauaaaguguauggacaaauuugauaaugcuugacaaaaaaagaaggcucugcauuuuaaugaguuuucaauuaaagcagaaccaacuuucuuuuuccccagugagaacauaccugugaauagaaccaccuuuuaaagugcacuugcauucugacacuuguaaguguaauauuuuaaauuauuuuucaggucuuuauggcuuuuuaguguaaaauauaaauauuucaagaauguguuaacacaaauguguuuuuuauuucugauuuacucauuguacuucaagacacuaaaauaacccccaauaugaaguaaauaaaaaacauaaauugagacaauauaaauauuguuuuguacacaauauggcagaaaaacuucuuuuguucucuuugucaaaugaaggagugguuuuauuugauuagaaauguuuuuaauguguaaguauaauuacuaauauauuuuuaauggaaacuaucaucuuagauuucucaauuuuauuuugaaaaauugucuccguuauguuugguaacuggcauuauuccugaaguauaugaggauaaauacuauuguguugucucaguuuccuuacagcagugaaucuuucagagaaggugaaauggcuuuagacagcccagauuagaauaaguaauccuuauuuauugucuagcaagaauguuuuugaaugugcuuaccuuauguauccuaggcagagagcuaucaucuccucagagaguuugcauuuauguauacacgaaauagaugugccuaagugagagucaacauagccaauccagaggcugauugauauucuguuggucaaagcuuugggauauugucaauucccagacucuuguccugcuuucagacagccucucacugugggaacugcaccuuccuccagcccugugcccucuggucaaggaguccaaaaucucuguggguaaauaauugacuccuguuuaagagccauggaagucacuuaucaaggaacagcuuuuuuucccccuuucccccaccaauuucgggaaccuuuuucaguaacuguggccccaagacggcagaaggcaauuuaccaguaaagaugcaggagcuucuguuaccucauaguguccacucugcugugggcagguuauaacccacuccagaucuggcacagagagagaaacuuuuauaaaaauugcuuaaagucaauaaucuuuucuucagucucauuaugcgcccccauuguuaaccauggagcaccgaggucugcauugacaccacaagacucuggagcaccacccagaguacguggugacaccccgagacauguggugaugccccaugcuucauacaggcacccaggucuaaugauucaccaaggcccauauugucaucucuggguggcuugcccugggacuaacacugagucuuugaggaucccaaauuaccuaaauuuuauauauggcaaggugggguuuuuaacggggaaaaguuaaaaaagcaaauuaguuaagguaacccaaaggaacaggaagauagucaguaauguuuccccugagucagugucagcucccugaaggaggauagaguaggagguagaauaaaauguuuucgggcauauuugcauuuauuuuaauucucugacccuuuaggcugcuugugguuaauaggcuucuuuagcucuaggccucugugucauuaauuugacaucagucuucaaucuagcaucuguucuggggccucugugccacuaaaaaugauaaacauaucaaaucaggaagagcaaucccaucaaauauauuuuuaaacaugaaauauuuagaaaucgaugccauuuauaagcauauaauauucugguuccugguguauauauuuucuuguuuauaguauuaggaaaucugauucaaagagucugaggacugaaguaucacuugagaaaauagaauuuaagauugcaaguuccaggcuagacucugcucuaccagggcacaggucuuugguucauguuguaucccaaguaccuagggcguccugguacacaaagggugcucaauaaauacuucuuuaggcugggcgcaguggcucacauguauaaucccaucacuuugggaggccgagguggguggaucacuugaguucaggaauucgaaaccagccuggccaacaugguaaaaccuuuucucuacuaaaaauacaaaaauuagcuaggcaugguggcgcacaccuguagucccagcuacuugggaggcugaggcaggagaaucgcuugaacccaagaggugggguugagauugggccacugcacuccagccugggcaacagagcaagaguucgucucaaaacaaaacaaaacaaaacaaaacacuucuuuauugaauaaaagcaaaaauugacaccagaagucauuugaaggugacauacugauuguuuuuccuaacauuuuauuauuaacuuuucaaauauacaaaaaacuugaaaauguuucauaaugaacacuccuauacuugccacuuagggucuaccauuaacauuuuacuauacuugcucuaucauacaucuauccaucuacccaucuuucuauccauccauuaguucaucuuauuuuuaaauguauuuccaaguaaauugcagacaucaauacucuucucccuaaauauugcugcugaccauuuuauuguugacagugguuucuugcacuuucuucauauucuuaaccacauugauagcauucugaugucugcuauuauuggaaaauccccuuugagcuaucuguagacaaaacuuauuugcaaaaaugagucaggauauaguuucgggaccucaguuuuaauaugaaaaucaacuaaaagucaagcaugcuaguuaucuauugcuaaguaacucuaaaacuuugcuucaaacaauaauaaauuaaacuuuuauuacuucucacagucuuugugggugaagaauugggaacaauaugguugggcauuucugauuuggagucucacgagguugcaaucaagauaucagcuagggcugcagucaucugaaggcuucaucagggcuaacacauucugugaggcagcucauucacuaggcugacacgugguuguuggugguuggugggaggcccugguuccucccaaugugggccucuccacagacuucuuuaguguccuuaccacaccacucuggcuuccuccagagugagugauccaagcgagaaagagagacaacagggaagaagguauucuuuuucugacauagccuaauucuaggauuuggaaggaaaucacuaagucuggggaauuaggcuucaccuuuugaagggacuaaagucagagaauuuuuggacauauuuuaaaauuaccacaucaaaguguguguguguguguguguguguagugugugugucugaaaugauuuuaauaagaauauccaccugagggauuguugugaauuaaaaugauauagugcagguaaacugcucaguauggcucuggucugcuaaugcuagaagguaggacuucuauuguuauuauuauuauuauuauuauuauuauuauuauuauuauuauuuugagacaaauucucgcucuguugcccaggcuggagugcaguggcacgaucucggcucacugcaaccuccauguucaagcgauucuccugccucagccucccggaguagcugggacuacaggcgcaugccaccacaccugggugauuuuuguaguuuuaguagagaugggguuucaccauguuggccaggcuggucucaaacuccugaccucaggugaucugccugccuuggucucccaaagugcugggauuacaggugugaguuaacgugccugggaaggauuucuguuauuaauaguaguaguagaaguagcagcaucaucaucccuaccaagacuaugacacauaugcgcaagaugcauuaggagaaugcaucucagaaaacagguugagagaauauagcaagaaacaaauuuugugcagaagagccuuucaucagcugacugccucaaauagggugagcguggaaaagaagguugaaggauguuagauauucugaccugcaauaacuguuagggaggaugaauuugcacuuggaauaggaaauggcaaggugacuccugcugagggagagcagugggcuaugugucccccauuccaggagcccugugauguaacuggagagcaaacugcaggaaguuaaaagagggaaaacaaauuaacucugaugccugggaggggcaaauuuucaacaucgcaguuacuuuugauaauacuguguauuuacuuuuuuuauucuaacuugcaauuaaaacauuuuugagguaaaauaaugagaccuugaugugugaucucuuuuuccccccagcuaccucugaacagugcagaugagauuuaugagcuacguguaaccggacguacccaggaugagauuuuauucucuaauaguacccgcuuaucauuugagaccaagagaauaucugucuucauucaaacagacaaggccuuauacaagccaaagcaagaagugaaguuucgcauuguuacacucuucucagauuuuaagccuuacaaaaccucuuuaaacauucucauuaagguaagugccagacagaaaugaagcaaggaauucuagccaucuuacuaaaccccucugggaaguucugcuuguguuacugacacuggaauauuuuagaauucaccuaagauaagcuucccucccaacauggaacuccucuaauaggaaagaagguggugcaugcacuggguuaagagcucagccucuagagucaaccugcuugaguuccaggccuggggucuucauugauuuauacaguugucaaacauuuauuaaacuucuguguuccaggcacagcgauagggcagugaacagaagagauuaagucccugcugacacugaguuuauuuuucaguggguaguaggagacagacauaauaaauaaacauacaaauauauauuuauaaagggacagauauguauguauuuguguguguguaugagagagaaaaagggagugagagacagagaguuuguguuugcuauuuucuuucuuucuuuuuuuuuuuugagauggaguuucacucuuguugcccaggcuggagugcaauggcacgaucuuggcucacugcaaccuccgccuccuugguucaagcgauucuccugccucagccuccugaguagcugggauuauaggcaugugccaccacgucugccuaaauuugaauuuuuaguagagacgggguuucaccauguuggucaggcugaccucgugauccacccaccucagccucccaaagaugcugggauuauaggcgugagccacugcgcccagcauguuuguugcuuucucuaggguugucugggaagacugauuugagcagagagccaaaggcaguaaaagaaaauaagcccauacagagggggaagcacauggaaaggcccugagggggagcuuguuuggcgcauuggaggaacaacaagcuggcagugugcuggagccccggggcgaggggacaggugcuaggacaugagguccuauacaaguagguggguuaggguggggcucaugcagggccuuauuggccaugauagggacuuugaaacuuaugcuaagugaagugagaauucacuggagaauucugaggcaagacuugauguaaucuaacuuaacaucuuaaaaggaucacugucagcucuaagaagaauagaugcuagaugcuagcugugugauccuggguaaauuuauuaaccuucuagaaccucaguuuccuuaucuagaaaauauguaauaauaaaaccucaaaagguuuuuaugaggcuuaagugagauaauucaaguaaaccauuuagaacugugucuggcacauaguacaugcucacuaaacguuagccauuauuauuauuuuaggaaccccuuuugaaagguaguaguuuugucucugcugcuuaauacucugaugauuuggaggcacugugguuagcacacugagugcuuuccugugagaaucaaguugaagacaacugagauccagcugggccugguuuucuguauuuaaacggagaagaacacuggacauuugaucauuacuuggaaauagggugacuaacaucccagucugccugggaugccucugauuuuaaaacugaaaagucucugguccugggaaccuccuuagucucaggacauugguuacuccagauauucuaaugaauaacauaguguggaagguaaaguaggccuuuuaguuugguaucuuccuauucuuaguuuauuuguuguuauaaauuaaaacaacaaaacccaaucaaauaaacauguauacauuuaacuuugagccaagauauauuuguagccaguaucacauuuguugccaugguguucaaugcauauugcuugaauugaacuagcauuauuucagaguuugccuuugguauguaauggaauguuuauaaagcagguugacauagugaauaguauuucuaaauucaugucaccccccugagcagaguugaacugacuccauucauaccaucuuucaucauuuauccacauauauggagagcuuacuguaugucagaaaggauguguacaauagaugguuuaauaaaugucuggcuaucucuggguguuuacauucaaugcuuccuucuacugcaggcaaauaaaaguuagcacugcauaaauugccuguucuagacaucaacccagaacuaacccugcugguucuggauaauuagucugugcauuuucauaguucugccugucuacucugcucuaguaucuuccuuugaaucuuugauuugcagauucuuugggcucuucugugcaguuugggacuuagcagaccacguuuggcuuucuggaaagggcucagagagacuuuccucuuauuagcucugguacugauaugacucucuuggccaggggaggggaguuuaaacuaaaauucuaccuggaacccaaaguguuuuggaacuaugagugagggguggccaugcuccugucucuguaccugggaagugaugcucaaauguggacuuaggucuagcugccuuccuccuuguaacuugcagaggccaggugggagcaguaaugugaacucuuucagcugaaaacagacauuugggccagguuuacaagucuaugauauuuucuacaucuuucaguguggaauaauuggugucuuggcaaaacuuuucagaacaaauugggacuuagccugaacuggagccccugacugagacaguuguacuccuuggcacagcaccaccugcaggcugauguggagaagugcaccugagaguuaacggggcccaucuugcccagcuagaaauggcugcaggauguagcuaagauacugacugucacagcaccuucaggguguucauuguuguucuuggggacugcaggccaucuuuggguguuauucauuuugcaugccccaauaacuggucuucucaggagggaaaggagcuucgaggccuuuuggcaguagaaaaaacauaaccuaugucucccacgcuucuggccuccucuagccaauuuggccugacacaauggaauugagugccucugacacugcgauggcagcuggcauggcuggcuucugcucugaccucuccauccagaaguuguuggugcuaguacgggugaaugaucuuguaggggaacagguguuauuggcuuggggguauauccuguuauugugcccugacacucaguuuuggagcagugguggcuaacucagaaccugaccgcuggccaggugaagaagcuaccuuauuugagugauuugaauucucuaauucuacaggcuggacagacauguuauucacacauaauccagaaauaguccucacagacauauucuccagccagggagcuuacugcuugagacaaucagguacugugugcuguguugaggcaucucagagauccagagcgaucuaaaggugacucgaagggcauguggggccacuauuccaggaucucuggccugcagcuuuucuggcugugacggggguauugcucauacuguacauggcugugucguagcagcagauggccgcaugcaaaugcugggcuccgcugugacaucaccaugcuuggcugguucaaauccugaugugucuuguagacuucugguguuucugcauucucucccucugccuuauugguaacaguuagaccuagguccaagacaggcuugggaaagcagaggaauuaucucauucucccccaacccuccagaucccccagguacaaagccaucaaugaggucaguucagacuucauuguccaggagaaauguaugcccucacuaccauaauguuucaguagaauauggacauuccauuuuccuacacuucagguaacaccaagaauuauuguuauuauuauuuuuaucuuugucagacugacagaagaaacacaauauuguuuucauuuguauuuccuuaauuacuagacagcauauauuuauuggcuauuuguauuucuuccuuuguuccugagccuuugaacuucauagcccucccaugcgucaugcuguggcaggcacaguagggccaacugcccauuacaaugccuggcccaggaguuuaccaaggauacagugaccugcuuguucuugacuugcuuuuggucucugguuuucacaauugguuucuggcuuauuagacugcuuucugcacaguucucagcauuguacuuaccccuaacugucauaucuccacucugggagagagguuucuucuguucuaauaacuggccccacucacuacuucuaggcaaaguuuagaggauaagucuaagggaaaauauucaaccccugcucucagucacagucuaguugggaauaauaaaauauagauuuuuggcaaaauaaaauauguaaaauaaacauauuuuacugccuuuaacaaaaauauguauucaagagagauaaacuccagauauacuagggacuuuccaggaagaagucaccucugccuauuggaggcauguauaggaggcaagaaacugaaacugauuucaccaguggacaaggaagggagggauuuccaugcagcaguugcagagaccuacaugcaugggcuuuuugggaauaaacugcaaacaaauccguauguuuggaggaagaugagccuagaaauguagauggaguaguauuaguaagggccuuguaaacuaggcaaaggaguguagacuuccuguaggcaaacaaaagccauggguaccuaguggucuaguauaaucaucauauacuauaauuagggacuauaaaaaguguauagccacugcuuuuuauaugccagggacugugccaaguauuucaaccacuguaacucauucucagauuugcguuucagauggaucacacuguuggcaguggggaagauguauuguagagggcaagacuagagggggaagauuaguugcauuaguuagaaaauaggacaugguggcuggaugugaggauggaaagaaggagacaaauuagagauauauuaaccuaacaaaguuaaaaugucaggaaaugugagagaggaaucuaggaugacugcuggaauggcuuggauaaauguugcaugaagggauuguuguuugggagguuauaggaagaaugaaguguuuuccauguauauccgugauuaaacaucucucuaauaugcuuuuguugaguuaaaaggcagacaugaguuuggauucugaauuucaucaugcacuggugcuguaauauugagucaugccagucacuugaaugcguaccucccucuccaggcaucaguuuucucaacuauaaagugaggauaaccauguccuaaaggagaauuguaaugauuagagauaaggcagagugccugacacauauugggccuuuaauaaauggggccuguuaucucuacaguuaaauuuucuuuuaacacuacuaccaccaccgccgccaccagggguuuggugacguacauguuguaguguuucauguagaaggaaauagggugccaggaauuaaaagguggagcagaaucaagaugaacuugggagaaauaugagaaaagaauaaacuuugauuugucuucuuuagaaauauagagccuacguuuuccaaaauguucaugcagcauucauccaagccauuccagcagucauccuagauuccucucucacauuuccagaccuuuuaacuuuguuagguuaauauaucucuaaugugucuccuucuuuccauccucacauccugccauccagccauauuugugccguauuuuggaguaaaguucuggaccugggugggaaugcugcaaggcauuauuccuaaccugauaggauacacaugcacaugggcagccucuacauacuuacaugucugguuuucauuuuaggaccccaaaucaaauuugauccaacagugguugucacaacaaagugaucuuggagucauuuccaaaacuuuucagcuaucuucccauccaauacuuggugacuggucuauucaaguucaagugaaugugaguauaaauauauuuuuuggggggaauguuaaagugauuuaauuaggucaggugggggaaaaucuccaaagucauuuauacaaugaagagaaaaaaauuaaugugaacauuuagacaauuuaaacgguuuauuuuuaauuuaugauguuuaucaaggguuuauuuagcuuucauucuaacauauuagaauuuucauaacuguugucuuuuucuaugauaugauguuuaaagguuaaaacauuuugacauuuuaguacacaauguuuacuuauuuguuucaugcauuauuuuaaaacuaaguaaugaacacauagcuauuauuuggcaaauuuuaugccuuagaauaaugacuccuaaugagugauuagauuaaccuacuuuuaucuuuguuuuaagaaacagugacuuaaauagcuacaccgacugcuauuccccaauccuuuuucccuagcuucuacaccuauugccuuuacuugcugccaacuuguauagcucugaaaucuaaauggagggcauuaaauggcauauaaaucuaaauggggggcauucauuggaaugaaugagacauaaacacaaugggauggaaacaauuuuaaaaagcaaugagacuuaacuguuuuaugugauauaaauuggucauuuaguauauaacauguaaaccuuuauauuuuucuauauuuaugugacauauaaacauauaagauauaaucaacuuuuucuguaucuaaaggggaagauauguaauaugaaaugcaugaaauuguagcuuauucuaagcauuguugcugagccuugaguaggugggacucgugugugaauugaccuguaugaaugagaacagugcuggaggcacaauggacucucaauauuugcuucauggccacccugcaucuuuauggguguuuguaugauguguuuaccaauauuauucuuuuuaagguagcagaagcucuaccgaaugaauguaugaugugguuuuaaagaacauuugaggcaauauuaugaaaggggcucauacuguuagagaacaauguaaugcauaaccauuaaagucauggacaauuuucagugaggucuuugcuuauuuccuuacuuauaacaguguaauaauaaccacuguuauaaauggcagccuagagcaggaugugaugaguucuaggggaaguggaauucuuuauaucugagcuuguagagaaaguggaaagaguaggcauuugugaaacuuagaaaauagggaaaaauuugugugggaguagggaaaauggaagagaacguuaugugucuggggauuugggagaaguugauguuacuggagcauguggagaaugauggcgguguagauuaggaagcacguugugaguuuaaaguaguuugaauauuauuuucaguucccacuuaaauucuuaagaaucacuuuuuuugguccauccauccaucgauccuucuauccacccacccacccaccaacccaguauguguuaaggacuuuauggcugugaugaauacaaagaagguaaacauaugaccuccauuuucaaaggucauugucauggugacaugaacaauaugauaaaaauuaaaugacauaagggggacagacaaacacagggcagugcaauagcagaggaauuguaagguguucaguccagcuuggugauaaagaggguuuauuguuagcacaagcacugauguuuuggggccagcugcuccuucugucucccauggucugcucuguucuccuuucacucuucugccaaccuuugagguguucuucaguucuucugauuccauuagcuuagcuaaauaaccaucaugcccagaaucuuuaaagcaagccucugcacagguggcuggcagccugugggugggccgcccugggucaagguguccauuuuugguccauucagaugccaccuaugcacaaugaccagcaagagcaguuuuagcuggauaacaggcgcugagggauuaauuuguucauugaaugguggacagaauaaguaccagaagagagggggauagaauagcagagggagacuuugcagaagaugugagauuauacuuugaaagauuuauaggauuuaucauguugugguuuguggacuuggcuugucauauugcuuuuauagaaaacaaaugcucuuaaggaaauuuaggugcuuaaaaaaugaaaagcauuugcaggaucuggcccuugcccaacuuuucagucuuguaaagugccgcccuuccucuugaacucuaugcuuuagacaucuuaugucccuuaaguuucuuaaacucaccgaucugucucauucuagagccuuucaucaugcuguucccucugcugagaauguuuuuucuuccuuauucucgcuacuugcuuuuaaccugcagccauucucuaaaguggccuggcuguuccagacauucccauaguacugugugcuucccuuaauucauucaucucacuuuuaauuagugguccaugauagacaguagccuuuguaaagcuggugaccuucuggucuugcucaccucucuauuccugggaccaaguucagugcuuuugcauguaaguagaaagcaguauuuucuuaaaacgaaugugugaaaacuauauagcaauaauuugucuugaaccaaaugcaauuuucccuuuuguauauucuauaaagcaucuuuaucuuuuugaagacaaguauacugaucagguacuugucauuugagguauguuaauuugaggcauucagcuaagaaaaaauaagccccuuaaaaaaaagagcccuuuuagaaccaccaggggucaguauaaccaaggaaauguuaugagaagcaacuguggccuuggucucuggcuuuuguuuuucuuugacuacugcgcagcauuaaaggacuguauauuucuuguuauuaaaccccuuuucuuuuaguagugaauaauaacauagaggaaauguauuuauuauuuaaauagcccaccauuagagacuauauuuuuacuuuucgguggcagucaccauucucaauauaaaacucagggaaggaaaauauuuauuuucaagaaaguauuggcugggcgugguggcucacaccuguaaucccagcacuuugggaagccgaggcgggcggaucacgaggucaggagaccgagaccaucuuggcuaauacagugaaaccccgucucuacuaaaaauacgaaaaauuagcugggugugguggcgggcgccuguagucccagcuacucgggaggcugaggcaggagaauggcgugaaccugggaggcggagcuugcagugagccaagaucaugccaccgcucuccagccugggcgacagagugauacucuggcuaaaaaaaaaggaaguauuuuuuaaauuuuuuaauuuguaagagacaggguugucgucugucacucaggcuagagugaaguggcacaaucauaguucacugcagccucgaacuccugggcucaagugauccuccugccucagccuccugaguagcagggacuacagguaugugccacuacgccugccuaguuaaaaaauuuuuuuuuccuuuucauagagacagggucuuguuauguugcccaggcugaucuugagcuccuggacucaagcaauccuucugccuuggccucacaaagugcugggauuacaugugugagccaucauacacagccuuugggagaguuuugaaauuccauuuugucuguagaaaaaauauggaaugauaugaguauucccacugauggacaaucucuuuaagaauuaccggaguuaucagagcuuugauuuguaaugacuauacagguaaucagaaagugguauucuucaguuacccuuuguccuaggucaggaaaaggauccuuuaaguaaaacauacuugacggcuccuuggcauuucuccacuuguauuaauaacauguuuguuuguagaguaagagugaauaaguccuuuaugauaccguguuaaccuuucuggauuaaucuaaauuguuugcccuucaaguauuguauugcuuuucaccuucaagguuuuuuaugauaguaauggugaguaauuauuuuggucuaguaugauuucuaguuuucuuuucuuucuuucuuuuuuuuuuuuuucgagacagagucucgcucuuuugcccaggccguggugugaucucggcucacugaaaccuccacaucccagguucaagcgauucuccugccucagccuccugaguagcugggauuacaggcaugcaccaccaugcccagcuaauuuuuguauuuuuaguagagacgguuucaucauguuggccaggguggucuugaacuccagaccucaagugaugcacccuacucggccucccaaagugcugggauuacaggcaugagccacugugccuggccaagaaaggaaacaaauguuuugggggauuaguuaagugauuugcccaaugucccacaacuuaccaaacuaggauuagaacucaggccuuuugacaccaaauccaagguucucucuacccugccaccuugguuuuccaucuuauguuuuaucucugucauuguucagcauaugauggugggacaucauaaguucucaauauauacauagacuuuuuuuuuuuuuacaaugcuaguuuaaucaaauugcaaagaaacucuugaugauuauaauguuuaagaccucuuaaaaucaguaaaguuuaguaagagcccuggcucuuuuugugcuacuuauacgugugcuuaauugacacacauauucuagugugaauaguucuuugcuacuuuggggauuguacuucuucucuugagaaugugaccaagucuucuacuucugccauacuuugauugcccugcucuuuuucaucauuucuuugucuagagcaccaagcccuccucucagagggcagagguauauuuuagcuguaacaucuuuucauagaaguguguuuuauagggccguuauacuuuagguacauuauaaguugagugugggaauauguucugauuuaauaauugacuugaaaauacaccuuaggaagauaauguguuuuaaaaguuagacauuccuuuauuuucauuucuuugcaauauaguucucuagguaccuuaucucuagguauguuaucucuugauugguguugacaguuuucucaaauaauugcacaugguuuuuuuguuuuguuuuguuuuguuuuuugagaaagagucucacucuguugaccagucuggagugcagugugcaaucucagcucauugcaaccuccaccucccagguugaagugauuuuccugccucagccuccugaguagcugggauuacaggugugcaccaucauguucagcuaauuuuuguauuuuuaguagagaugggguuucaccauguuggucaggcugggcucgaacuccugaccucaggugauucacuugccuuggguuuccaaagugcuaggauuacaggcaugagccacugugccuggccugcaaaugguuuuucccuccauuuuuuauuuucuguaguaaaauacacauaacguaaaauuugccauuguaaccauuuuuaaguguacaguucagugguauuaaguacauuaauauuguugugcauucaucaccaccauccaucucuguaacucuuuucaucuugcaaaacugaaaaucuacaccuauuaaacaauaacucuccauucccucccaccccccagccccuggcagccacuguacauucuaucucugugguguugauuagucuuauaucagcagaaucauacaggaucucuuuuugagacuggcuuuuuucucuuagcauaauguuauuauggcucacccauguuguagcauauaucagaauuuucucucuuuuaaaggcugaauaauauuccauugugugaauauaccacauuugguugcgaauguuuuugcaucuaugauuuaaaaauuauauucgagguuauuagaaggugauuuuagggguucuuuaaaagaaaggcuaauguuggugucugagaaccaggcuucugggagccaggaggcaucuggccagagcagugcagccugcagcccagagcuccaggucuuugcgugacccacgcacuggugcucauguuccuccaagagcccgaaagaagagccugagucacugagagauuccuggucauuugaugacggcagcccugugcugucuuuccucauugucagauggaagucucuucuucuuucuagaguggcuuaggcauuugaguuuaccauaauggccaccugaggcugcagcugguucugaaacaucagugugccacagaaucaauggacugggagcuuguuuaaagaugcauaguccaggucccacccccagaucacaauuuacuaauuuuggcaugggagcuaggaguuugaauuuuaaauaagcacucaaggaaauucuacuaguuuuuugaaccacauuuugagaagugcucauaaaugcccgcagcuaggcaucuuuagaauccaucuuuuccauugagaggcaguguugggcaguguugggcagucaacaagguauggaacuggggacaggccaucugauuuauucuuugaauuccucagcagugcuacuuucugcuauuuacuuuaccuuuuuagguaaucagcucaguagagcuccccagcaccuuagacauacuaagucagaauuucugggacaauguauauccuuuacaacagcuucucugaugcuucagaugcacagccagcuugggaaccacugaacuugauaaucaucuuuucuaucugucacuaacuacaauuucguaaccguugucucaaucuuaagccauuguuagagguggggaacaagaaauagcaagcagaaaacucaacaggguuaaggcuugaagucacucuucuggagcccuguauaaugaaacggguuaucaaauuauuauguaacucagaagcaaucugcauugaguuauuucuuugcaucuaacaguuauaucuaguuucucuugaguuacuuguuuuuucuagauuaggugaggguugccaacaccuuacugcuuuuuauaaccuuucaggauauuccuuauuuuuucuggacuuguuguccagccucugccugggucagcuugcugcuucuguuaaguaucucuggagccguuuuucuuuugcaaaagagcacaucuuuguuuggacaguucuugucccuaaagcacucuaccaggagcaucugcuuaacccgccuggcuugugacgacaacuuaacagaaagcauggagcaaaacuuugacaggucagaaaacaguggcauucucucugaaaugugguuguggcuuccaaaauacuuucacuagucuuugcuuauaagaagaaugcuuuguuugggaaggaucucaaacucuuacuuccuuguucagugagaaagggagggaggagaugguuuuagaauauugauuucuuagagcauuaucuggcagagcucagcacuuucuccuccauucuuccaaaggccccgauaaacaccucuagaauagcauuuauuaaucaguguagcguuauuuucguuuuuuaaaaacugugguaagauauauauguaaaauuuaccauuuuaacaauuuaaaaguuaaguagcaucaggugcauucacauuguggugcaaccaucugccaccauccaucuccagaaccuauuauuaucuucagauauuuaaaaaaaugucugccucauuucuuaaacugugaacuccuugaagacaggaauucuauuuuauuaauuuucauauuuguucugucuaauauaauaucugaccuguuaugggaacucauucaugcuugugggaugaaagaaugagugaauagagcuucuucuagaugauugcuguuauuauccuuugugauguucuuugacuucuagucucacucugcuauaucaucuugcaacuuaguagaaauaucuuuguauauuuucauuuugagaauauauaugguugcuguauuugaugaaccugugagcuaauggaaaacaggacuuuuggauuaaugcccuggacuuucucauuuugaaaauuaaaaaaaaucucaggcaagagcugaauauucuaguuuguuauaaagucuaaaauagacuuauaauuuuggugccauauuauucuugugucuuuauucagccauuugaucugcuagugccaguccuuuggcagugugcauuuuaauuucuaggccccauaugcaaauuuucaugaggaguucuuuguuuuguucuuucucuacagaagccacccuaggaggaccccuccuuucaaaugugucuucuguaccccucucugaagagacauguuuuuggcaucaguuagaaaacuuuggggccagacuuuaggauguuguguucaucaaugaaauggagggucugaguauguagcaucaucaguacauaggauagggacucagugcuauagaugaucuuagaggucgccuagauccaucuccccacuuuauggaggaagaaucugagauaagugacgugaccugguuaggcucacacaguguguugugggagggucaggacuagcaacuaguuuacucauacuuucaguucuguaaaauuaaauuauuuaauaugugcagcaauugcuguuuuauuuauuuauuuauuuuugagacagagucuugcucugucacccaggcuggagugcaguggugcugucucagcuuacugcaacuucugccucccagguucaagugauucuccugccuuagccuccugaguagcugggauuuacaggcaugugccaccaugggccuggcuaauuuuuguauuuuuaguagagacaggguuucaccauguuggccaggcuggucuugaacucuugaccucaggugauccgcccgcccuggccucccaaagugcugggauuacaggcaugagucaucaugccuggccagcaauugcuguuuuaauauggccuccuuuuaagguugaauuuagaugucaacagggcuugcuguaugcauugguggagaagauaccuacuucuuuuauaugacuuguggaugccacgggaucaccuuguuugcacguuggauuguucccaacgugucccagauucugaccacagcagccauguguuuagauugaagauuugaguccagcauguagguuacuugguucaucuauuuaauauccauuaauauacuauuaaggauuaggcugcugucaccucacagccucuauaaccuuggucauaugaggcuuacaaagauuaauuuuuuguuguuuguuuuugagacagagucucgcugugucacccaggcuggagugcaguggcacaaucuuggcuuacuguaaccuccgccucccagguucaagcgauucaccugccucagccucccgaguaacugggauuacaggcauccaccaccacgccuggcuaaauuuuuguauuuuuaguagagacaagguuucgccacauuggccaggcuggucuugaacuucugaccucaagugauccgccugccucugccuuccaaagggcugggauuauaggcauaagccacugugcucagccaagaagauuaauuuuaaaaauaacuguuuaccuuuagguagauucacagaaaguugcgaagauagcacaaagcggcccuauauuaucuuaacgcagugcacccagugguuauaucuuauguuauuauaguacaauauaaaaagcaagaauuugacguuugugugguauguguguaugguucuguaugaugcuuuauuuucaguggcauagagggaguuuuggaaaaugauaacucacugggcucugaccagugguggcagcccugggugagggggaagggggcacugaaaugaguaccaagucccuggguggagugaggaaagggagaaagagcaagaaauggaguuauuuucccucaaggguaacuuuccuauucaguacaaaccuguagcuaugcugcugcuuuugcucccuugcuugagauaggugcccaagaaagguggucauguuacaugucuuuaaaaaccauaguuccuucuacuuugaguaggaacagagaggguuaaaugggugauuuuuguuuauuguuuguuuuuaaagagaauauguuucuaguuaguacuuuuuuuuuuucaacaccaaggaaacaaguuugucccuuguacugcauaauguauuuguacugcagaugguaacacuguuuuaggaguaugaaugugcuugugaucccuggauaccuggccacuauucugcuaacuggaggcuuguauggucuaugucuuggucauugguuagauccauuauucccaaguccugucacuaugagugacugucagguauagaccagcuucaguucuucagguguuuaguuccagccuugauaagaaccagaauauuuguaauccuuucuaaugagagaagggauccaggaacaaaacugucuccuggggagguucugauuccucccuccucacacucaguagauuaucuuccuuuccacuucacagagaacacagucaucagaugggaauuucuuucacuuuuucugccagauuugcauguguugccugugcccaucucaugcuuauucucuucuuuuuagaggaaagguccuauucuucacaucuaagaccaauaucccgauuucugccuuggcuucuuucuuccucuacuuugucagaaaacuugcaguguugacagucucuuucuucucagucuucaaacuggaucucuuucugucuuagaucuuuuuauaaaaucuaauauguuuaauucuuucucauugaaaaaacaaaaaauauagagaaguacuguacuuuaacucuacuuccucuucagugacuucacauucccauucuagccagucuucuaaaaaaaaaugucugaucucucugccuccauuuucccaacucacuccaguuugacugagauuucuuucuacuuguuuggauucuucuucuuggucacuuucgucauuuacucucuauuacauauuggcacauugcaaguuugguuuuaaguuucuuucauuucucacucuagggaaguucacccgaaggcaugguuucaguuuccaucuauacaccaaugacucucaaauuggccucucugagagaaccuauaccucugaguucuagaccuuuaaaacuaucuaccuuuaaaacuaucaacaucuguauuuggauguuucaaagcaccccaaacucuucauguccaguaucauucuuaacaaucuuuccccaccacaccuggcuccucugcagcauuuccuaccuuauuuaauucucuauccauucggcugugcaggcugguaaccuuagaguucuugacaccucaugcugccugaccacccauauucaggccuucaucaauucccacagcuuuuucccuuaaauaaauauauuucuuucuuucuuuuuuuuuuuuccuacccugagacagagucuugcucugucacccaggcaaucucagcucacugcaaccuccaccucccgaguucaagugaucuuccugccuccaucucccgaguagcugggaguacaggcgugugccaccaugcccggcuaauuuuuguauuuuuuguagagaugggguuucaccauguugcccaggcuggucucuaacuccuuagcucaagugaucugccugccucaaccuuaaauauauuucaaauccaccuacuucucuauuuccaccucucccuccuuuguccaagccacuauuauauuguuccuagauauuacagugucucuuaaucucucugcauuugguuuuuuuccccuuugcaaccaauuaucuacacagcaguaaaaauaaucucaacauuagcuggaucauguuauuccccagcuuaaaacuguccaaagacuuuccacuggccucagaacaaaauucagauguuuuaccauggccuacacagggucuuaccugaucugacucuguuuuucccaucucaucuccagauuucauaacucucuguaaauguuaauucacagcuuuuaucauaauuuguaauacauacucacauaugugguuauuugauaaauauccuucuuuccacuagaucagaagguccaugcgggguuguauucccauuacaccugccacucaggcgcaaugaauaucucuugaaggaauggaugaaugaaugcauuuguuguguuugggccucagcccugguaauucugauucaguagcucugggguaggaacuggacaccucuauuuauuaaacccaccacagcugauucugaugcugaguuuggguugaaccccauagagaaauauguugcaacuacaguuuagaccacagguguuuagacucuaaacaggaaagggaaggaaaggaugauguaaauguuaauaaacauuuucucucauuuugcaaacccuauugacucugucauuccucuaaguaggacaguguacaucagcugacacuuuuacaggaugauauuuccauugugauuucuuuuuuauuuuuaagcucucccaauuuuaugguaaaaauaaaagaggggaaaaauaggguauuacaugauugcuauuacguaggcaauagguuuaggcauagucagguuaguagggaucggaauaaagcuaaaaauaugaagcuuuuguguuguaugcgagggugggaagaaacaccagucaguacacaucuaaaggugacaagacacagaccuggcuuucaaggagcuuacaaucagaaaagcuucguguaacaaaugcaaagagcauuagauuaggaguccuaagaccuggguacugugcucuaguuaagugauggugggcauggcauuucagcugugggucuccguuuccucagcuguaaaauaagggguuuggaucaagggauuuuuaaggaucuucacaacuuuacaaguccaagauagggcuggaggggacuguaggauuuggaugggaaguggugggcucugagcuggcugacagggcuguggggcugggagcaggcacuggcuggcauggagggcuuguagagaguaguaguugaagagaaagguggggaaguuugugggccgagcuguggaggauauuggcuaucaggcugaaauuuuguauuucauuuuguagacaacaggcagcucuaaaaacuuuuguguauuuuacuuugaauuucaaucagugaugcaaauuucaauauaggacuucugaggacaaaggaaacaaaaugugugugaaugggucucucaaauuauaaaaguuauaggaucauaccuucauaauuuuccucugguuauaaaaguaaugcaugaguaagguaaaaacauccaaacaugauaguguagaaaguaugacacccuuaugguaaacuuccaaacaaacaaaaaucaucaguauguguugucuucuuauugcuuuaguagaaaguuucuauguaaaaguaugacaugauuaaaguuguauuuuaggaagaucacuuugguggcagcauguagggugauuagagggagagaaacuaaaguccaggagacuaccaggggguuaguauuauuguuuaacaaauauacgaauaccuucaauguuagcuuauaaucgaauaccuucaguguuaguaaguucaaagguaaugggggacugcgguaagagagcagaaaaaauuaaagaggaauggaugaauucaagagacacuuaaaggcagaaucauuaggauuagugacuggauuucgauuggagcagagaagaaagaggagcaaaagguaccugggaauuucaaguugggucuuugggagaaucacccauaucaguucuagggaaguuagggauggaagcucaguuugggugagugguaugagcuagauguauuuggacugagccaucagaaaucacauuuaggagcaaagcagagaagccauccaaagcaauagagaaagaacagccaguuuugggaagagaaaagcaagcaaguucaggcacagagcagagggcaagagauucagagagaguggcuuuccaggugcugcagaggccucaaagggagugaggccugagaaaggugacaggcgguuagaggaaagcaaccuggcauaccgagcaucuucuggggucagugaaaugggagaggcagaaucgagauuucaagagcaauaaagcgcauaaauagcuauacauaacauagcuauguaauguaggguaauguauauaauagucuacaacuucuguuccuaagaaggagagaauuaauaugauuaucugguggaggcagcagcaauauaauuucauuuauguuaugguauuccuauucuuacuuaacauauucaugcccaguuauuuauguguaacugugagguugaacauuuauuacuugacaggugaaguaaaaaagcacauuauuuuugugccauuuuguccuguucuuugggacgaauucuucccuacuccuuggauaaaauguagggaaaaucucaucauuuuuaugguuacucuuugguaacaaaagguccugucauguucgguuacuuucauauacacagucuacauucaguaauuaauauguccagucuaauaaaauaaaaugcucccuucuccagcucgggucuucuuuggucuggaugccugccuccaacucacuaggcugccuuugacuccuccagacugaauuggguggaggaaagagaagugagggguaacaaaauucucaucugauguauaaggaugagucaugugaacuugcuaauauuuguccugcaaaaaugucaauuuaauaugguucaauguaauacuguugucaucugcaugagaccugucugggcuaagacggcauuuaaaacuacauuuuuccuuuuuagaacuccuuucuguauuccuaggaggacccuuaagauuguggggaggucuuucauccaaaguacccuggaugcuuuugaaucugucuccuccaaauggcagcucauaacuccaucuuuagcugcugggcaucuagaucacacaccucagcuucccucuucugagggcuugccuuauuccuacuaaggcuguuuugaucaggauagaaaacaguuccaugcugacuugcucuuuuggcauaucuaguugagggaaaaugcucaugcuuucucugauccugaacauucaggagaugcagaccacuccuagcauagcacacucuuagcuccacugccagcacaaauauuauacccuuuagaguuuucaggugugucaacagccugcucacugacagcuugaggaugcucccagggacacauaccuaguugucugcauugucuauggaagcccguuucccuaggcuugaaaugagggccaagcaacucuaccugaugccccaggguggggugagugccacuccuagcucaucgaaagcucucuccugaaauucccuucuaguuuuauuuuuaucuugaccuuuccaccuuggugauggguuaagaguuacaaaaccaguuuuuggaaaccuccuuuacagguccugcauccuucaccuguggaagguggacauaguugacaucuauugucuugggggcuaaacgcaaaacugagucugaaauaguucccuuuuaaccucccguuaugugcagauuuaacaaauucagugccuuucuuaaaguaaaagguacauccagacacuggagaguagugcuaaaacaaacuauuagggaauugaaaugaccauaaaagaacauaaugaacaaacagaaauaauccaaccagcaccuuaguuuugauucuggcauugcuuuuuacuccagaagcaagaguugaaagaaacugaccugcauuuuaaaauauauuuuuuaauggucauguaauaugcuauauuucuucaaaucuguuaaaaauagaaacucaagaguuggauggcaucaugguuagggaagaaaaauucuguaacuggaauagaugguuguaguaauucacaugucucaauuuguauucuagucauaacauacuucuuaaaagggugguaaaaauaauguguuuucucuuucccacuucauuugucuaauuucuguaacauacacccucacaaugaauuauugacucagggacaagagguagagaaauuacagagguugcuaagaauaccugcugacucuuauuuucuacuucugcuuuagaaguuguuuagaaaaucuaaucaaggccgucuuacauccaguagaaacagagaguuucuacuggaugugcuuuggagcagguuuuuaagagagagcuuuccccauggaagagugaccauauuggggaaagaagagcucaggagacaugaguuaugcuucucuugccuggggagguguuugcuuaaaagacaugcugcccaaguauuuaagccuucagguuagggucuuuuuuccaguuguuggcagagugaaugagcaugaacuguauuugaugaacuacaguuaacacaaauacucauuuugaagcagauaaaauuauuuugaaagugaaggaaaauuguuucauaagagaaacuuguacuuccuacgaaaagacuguguuuuuuugcuccauguuuuuaguaaaguuuagucaaauuuaguuuaguucaccuagaacgaacacugaacaauuuggaaauacauuuuauuccuuuuuuuaaacuagagguuagcaaacccuggcagaaaaaccaaauguagccugacaccuguuuuugugaauaaagauuuauuggaacauagucgugcucguuuguuuacaaauugugucuggcuacauuugcauugcaacagcauuguuaaguaguugggacagagaccauauggccugcaaagccuaaaauauuuacuaucccacucuuuacaggaaaaguuugcagaucccuguucuagauuaaugaaaguacucaguaucaguguuuuugugguuauauauggcauaaauggcuauuaauucucugaauuauuauuaauuuuaaauauuucaguaucuuuuguacuugauuauauaucucauuaaaauaauugaauuaauucugaaaauugguauggucuguuugccuaauggacaauacacuggacauuacaaaacuaauuucugcuuuucaaaucccuuggacaguaaaauaauuuauuucuugauuugcauuuuaccacauaugagcaccuugggaagacauuguguaguagaaagcauacugucagcacccacuuccaaaauguuuucuagauuuauuggaacaauuuaaaaugucagugaaaagaaguacuuuucuuccuuuguguucuucauuuuucuaugauggcuggaugcauucacuccuuggggcauucauguuccuuccuuaaagggcagaguuaagguuacucugugggucauuugccucuucaggguuguuugauccuucucaagagaagauuauuuuaauguauugcaggagaugcugccugauaacugaggcugaucuguugagcacuguaggaaccagacuggggacaagaauugacucauuuauucauuuauacuuauguuuauucaacaaacguugaaggcaugcuuuacuagguucugugcucucaaggauuucauagucucuuacaggagauggacacaaagcaaaugauuaucauauacuguguuaggcaagaugauugaguuauagucaggauauuauaggagagaaggggcaucuaauccaccauggggagagggcaaucaagaaaagcuauuugaaagaggcuaaauccagaucaauaaauccaggacauucugucagaaauucagauggagaugucuggcagguggauuugagucucaaucugggauagagauaaggauuuaggugucuuuauucuaggaauggcaguuaaaacccugagagcugaugagagccugaagagugggaagagggcucagcaugggaaaggccaacauuuaaggaucagaaagagaugcauaaaggaaacaaggaaggggucagagagauaauuaggaauaccaagagaacaaaagacaaugguguuuagagacugagugaggggaaggagacggucaauggaaagauggaaaauccaggauugaucagggacuggcaauguaggaggcagaggggagauggaauucauuucaaauauucuaauguaaacuacuuauguguuaaacaaaugaugaccuaaaacuuaguuucaggcuguuguuuaaaguaggcucaaauaaguaaguugauuuccuauauuuguaaaagcuaauaauuuuuauuuaaucaaacacacauuuauugagcacuuauuuuguacuaggugcuauaacagguuggcacccuaagggauaaacuaugcgggauauaaaaaugaucaaaaagugaaguaguaauauuuaagcuaagcccuggaaaauggggagggauggaaguacauauaagucaagaauaggcaagaguuagagcaaaaacacagugcaugaaaccccaggacacugucagucuugaauuauuguucuugacuaugucugucuccaccacuagacucucuaaugcugaggacugugauuuauagagccucacaugguguuuugcauguuguauuuacucaauuaauguuugcuauaugaaugaaacuugagaaacagaaacaucauaauuguuacuuauuccauagucuugucugugcuggccucaguaauaaagcaaaaacuaacuuaaagacuagcauucuuauguucauuaguaaaacagguaauagauaaauuaccuucuugauuugacuuuugagaaugacguguuagaacuuauaaaugaaucaaauacguguaauuuauaauguuacuauaugauaugaaaacaauuugagauagaagucauaaauaugaaguuucuuaagacuuugaucaaaacaacaaaauuucuuugagauuuucuuuuuuuaaaacuuuuauuuuucaacaacagcuaaccaaagaugggaucuucuuuacaugacaauguugaagccaauugauacacaauuuauuuguuagcguguuagugguucuauuuguuuuauauuuugaagugaacuauggccuucuuuuaggacugaaaaauaacuucgugguguacagauauuuuagauuaaccaaggguacuuguuaacaaaagcuauuauuuuauagcugcaucuccguguuugauuugauaaauuugggaauuaaauuuacaaugcaaauuucauuaguggaauuacauagccaauuuggagagguucuauuuaaugugcuaccuugauuuagaaugagcgauuuagaaauaugaagaguugacugggcauggugucucaugccuguaauccuaggacuuugggaggcugaggugugauugcuugagcucaggaguuugagaccagccugggcaacauggcaaaauccuguucuacuuaaaaaaaaaaaaaauuagcugggcauagugacuugccccuguggucccagcuaguuggugggcugaggcaggagaaucgcuugaguccaggagguugaggcuucagugagcuguguuugugccacuauacuccagccugggugacaaagugagacccugucugaaaaaacaaaaacaaaaacaaaagcaacaaaaaaaggagaaauaugaagaguuagauaaaugauacgauaauagcccacguuuucuuguugauuguggaaaaggaaauaauuaacaguaucuauuauaaccacauaggauguauugauuuaagaauuacaguagaaaauaauucaaggaauuggaaaagugaggcauguuguucuaugaagauuuugcauccuuaauuauuuauaaguauuugaguuauguguaacuucauuuucuccauuaauuuuugauaaugauauccaaaacaaaucugcaguuauuuguuaguuugaccuguguuaucuuugcuucauaaauuccucaauuaucuaguuuaaucuaguucuuauuucacaaaugauggaagucagauuaagcaguuuguuuaaaugacccgcaaugaauuauagagauaggucaccauuuuaugcuaacggguuggcaagaaaaauucaugaaauuuuacaggcuucauguugcaguugucuacaaauacacuuccauaaaugaaaauaaacaaguuuguucauugcaucauuauaaauguaauuuaaaaauuaauuuucuaaauuguuuuaugcaaguaaguaagcaagcaaaauaaauaagaacucauauacuuuccugucuuuuuuuucuccccugcccaauaggaccagacauacuaucaaucauuucagguuucagaauaugguaagaguuccucaaucuauuuuggaagaaaaaaacauuuguuacuuucagcagagauuagagaaauuuuuaagagauguauuauuugaaguaaaaaucucaauggaguuaaaauucugguguuuuuuaaaggccuaaccauauuuuuuuuccuuuguaaaaauucuaaaaucucauuauacagaaaaaaguagaaaaaaaucaccuauaguugcauugugcuagucuuuuucuuauccacaacaugauuuuucuauuuuucuacuuuguugugauaaaaaaauauuuaaaguguugcacuuaaaaauacuuaacaaauucucuuccauauuuuucauuugauugacauugguaaagauggucuguuucucagguaaauccucuucuugcaggugccauacuuacaauaucuguuagaaacccauagauaaaaacagugggacccaucuauuuuguuggugaauggagaggaaugagagaugagacugaaagcauaggaucuuaguauuaguuauaauuugaauaguuauuuugagguugcacaugcaguuuuucauuugauuugagcuucuuuuuugagauuggguuuuauuuaggcaguagaaauuauaauauacagguaguaauaccucaggcucugugggccauaugucucuguuguuacuacucaauuuugccgugguagcaugagagcagccaaagauaauauguacaugaauguugcugugguucaauaaacuuuauuuuaugggcaugaaaauuugaauuucauauaauuuucauaugucaugaaauauucuucuucuuuugauuuuuuucaaccaguuaaaaauuguaaaaaauguucuugguucaugcuggucauaguuugcugaacucugaucuguaacugugcucuccaguagcggggccacuugccauguguggcuguugagcacuucaaauguggcuaguccagauggagacagcagaugucaaagacuuaguacaagaaaaaugaaagaaagaaaaauaguucauuaauaaccauuuuuaaauuuuuauuauuuguugaaaagauacuauuuuagauauauaggguuaaguaaaauauaaaaauuaauuucaccugcuuauuuuuacuuuaaaaauuugacuacuagaaaugaaaaauuacacauauggcucccauuuuaugucuuuuagacagcccugaucuagaagaauaagucauaggggaccaacauuuuuauaggcuaucuuuauaucccauugugaugguaugcugggugguuguauguuguugaaugagguauaguggagguggggaauugauugcaaaccuaugauguuugaggaagaggcauuuggauuuucuuggugguggggguugcgggggcggggucauaguugacucacgugacuuuuuggucucccuguccuagacugaucuagagucuaggagugucuugguacauucagggccauuagccuugauuggagcugaaggucugcccuauauuguugacuauuuggcuuuuuugauacuucucuuauguuaauugaauggugaggugccuuguuaugagaguggccuguuucuuuggucagagaacuauagaaaaaaaguuuuaucgacuguaaagaaacacacauuuuuuacucugguggagugcuuuauaucaauuauaguauuaguacuuauaaaauaguuuauaccuuaauuauuauuauuauuuuucgagacggagucucacugugucacucaggcuggagugcaguggcaugaucucgggucacugcaaccacugccuccuggguucaagcgauucuccugccucagccuccugaguagcugggauuacaggcaugcaccaccaugcccaacaauuuuuguauuuuuaguagagauaggauucaccaugcuggccaggcuggucuugaacuccugaccucaggugauccaccugccucugccucccgaguucuagaauuacaggcgugagccacuacucccagccucauaccuuaauuauauaaagcugaccaaauuagggauuucuaguuuugggugaaacaaagggcuuuucaucugucuuaauauguauuuggauucuaauaaauuuaaguucaaauaguacaaauuauuaacuccuucacaacaauuuuauuuuucauuuuauucaguggaagaugauagugaaguagauucuuuaaaagauuuacccuugcuucuucgucucaaaaagaaaaaaagauuuacccuugcuuuucuuuuccaguauuaccaaaauuugaagugacuuugcagacaccauuauauuguucuaugaauucuaagcauuuaaaugguaccaucacggcaaaguaagugucauuuuucuuuugauaugacucaaaaccauuauaaaacugugugaccaaaagcugauuguauacuucagaauauuagggcaauuuuugcuuauuaaaauaccuuaguggacaguaaaugacuauuuauaauaaauaauuaagcaugggacagagcuccacauuucacugcaucuaucacucugcuugcaagccgacccagucuuaaaauauuucccauauuucuuagacuuauuaagggauuuauauuauagauagcacuguuuuuuuuucagaugacauggacuugaagccaccacgccuggcuaauuuuuuuuccuuuauagagauggggucuugccauuuucuccaggcuggucuugaacuccuggccucacaugauacuccugccuuggucuccuaaagugcugagacuacaggcauguuccaccacuccugggcugauuugcuuuuuaaaaauuagucaagcuuuuauuuucugagugauuaacuuaucccaaaugcuucccgguucuauuugggacaauaauuguaucuuuguuucacaauuauuauaaccagcuugguguuuggaaaacuaaaucugcuucacauuaaagucaaaauuaaaaauuuuuaugucugagaguacuuuaaauuauauuuggauuuuaaagauccuuuuacuaccaugugauauaacucuguuaaaauacaauauccuggcauucuaguuuugcuuuuauuuaaucuuuagcacgauacaaguagagucagguuucgaagacucuugaaugagugaauuugaugcucagguugcuaaccaggguuuccacugacuuuacuguuuuuguuuggaaguguggugcauuugaacuuggauuuuuuuuuuuuucuucuuaguuuggaauaugcuauauuuuaagauuugcuuuugaguugaguugauccagaugaggggcuguuucuguguucaguuaauggauucaggaagccgccguuuacugcugugauuuauagacugcaaagcaaaauugacuuccaugucuggcucagcauuucacaauagagauagaagcaacccaggaaauguacuuaaaaaaggcuuucugggccgggcgcaguggcucacgccuguaaucccagcacuuugggaggccgaggcgggcgggucacaaggucaggagaucgagaccaucuuggcuaacacggugaaaccccgucucuacugaaaauacaaaaaauuagccgggcgcgguggcgggcgccuguagucccagcuacucgggaggcugaggcaggagaauggcgugaaccugggaggcggagcuugcagugagccgagauugugccacugcaguccggccugggcuaaagagcgggaccccgucucaaaaaaaaaaaaaaaaaaaaaaaaaaaaaagccuuucuggcaguaaaauguauugccucuucuucacaugaagagacuuuccuauaaugagagaggauaaaauuaauacauagaaagaaaaguagcagagaauauuugacuuacgaagcuaaguuugggccaggugagguggcucgugccuauaaucccagcacuuuggggggccaaacuggguggaucacuugaggucaggaguuugagaccagccuggccaauauggugaaacuccauuucuacugaaaauacaaaaauuagcuggguguaguggcagacgccuauaaucccagcuauucgggaggcugaagcagagaauugauugaaccugggaggcagagguugcagugacccuagaucgcaccacugcacuccagccugggugacagagcgagacucugucucaaaaaauaaaauaaaauaaaauucgcuggacgugguggugugcgcuugucaucccagcuacucaggaggcugaggcaggagaaucucuugaaccccugagguggagguugcagugagccgagaucaugccacugcauccagccugggugacagagugagacugugucuaaacacacacacacacacacacacacacacacacacacacacacacacacacacacacaaacccagaaacuaaguuugguacuacagauuuuaaaaauuauucuuauuuuaaauuuuuuggcaaaaaaucaauuuuugacagccaugagcacauuuggugcuucagaaucuaugguguaauaaaccuuccucgcuaauauuggaacauguagcaauagaccauggugauugcacuaucagcugacauuuaaaaaucuucuaaagcugcgaaguuucgugggcauucaguuaaugggccaguccagauuucuaggagugaaagauuuauguaaucuuuaaaaaaucuuuggacaggaaacugucacuuccaauuaugaucagguauuuucuggagucuuucagauggucagagguugggcagaguguguguuaagaacuguuuuaagcuacuauaguuaaaagucuucccauuuuggaaacuuaauuucaaggaucaccauuuauuuuuuauuuauuuauuuauuuuuugaguuggagucucacucuguugcccaggcuggagugcaguggcacgaucuuggcucacugcagccuccaccuccuggguucaaacaguucucugccucagccuccaaguagcugggauuacaggcacccaccaccacgccuggcuaauuuuuuugcauuuuuaguagagaugggguuucaccaucuuggccaggcuggucuugaacuccugaccucgugauccaccagccucggccucccaaagugcugggauuacaggcaugagccaccgugcccauccaggaucaccguuuauuaaagacauuuuuguuggguuuaguuuaaaaaauuauaguaggaguauguuuuuaauguaacuuuuuucuuuuuaaaauuuucucuuuuuaguguuuugccaucccauaauguauuuuuuuuuaauuuauuuauuuugagacagagucuugcugucuugcuguguuguccaggcuggagugcagugaugcgaucucggcucacugcaaccuccacuuccuggguucaagcaguucuccugccucagccuccaaaguagcugggaguacaggugccugccaccaugcccagcugauuuuuguauuuuuaguagagacaggguuucacuauguuggccaggcuggucuugcacuccugaccucgugauccacccgccucggccucccaaagugcugggauuacaggcgugagccaccgcucccagcccaauguaauuuuuuaaaauguuagauugcuaauugcuaauguaugcuauugaaaguaguauuuuuauuguguucugacaauaucaaguugauacauaaaaagacuauguuuauaauuauucagguauacauaugggaagccagugaaaggagacguaacgcuuacauuuuuaccuuuauccuuuuggggaaagaagaaaaauauuacaaaaacauuuaagguaacuuuugcagacacuuuauaacuugugauggguaaaauauguguauuuuucuagaaauaagauuuaguacugaauuaacaaaaaguuaaguguaagaaaaucaagagcuuuccagcauugaacaaaugagaauuuaugcaauuauagcgauuaaaaugguaccagagcuaucauauuguugugacuuaguuugaguuuuauuucuaaaauuugaauugcuaaaaugguaaauaauacugaacuuuuaaacaaaacagauaaauggaucugcaaacuucucuuuuaaugaugaagagaugaaaaauguaauggauucuucaaauggacuuucugaauaccuggaucuaucuuccccuggaccaguagaaauuuuaaccacagugacagaaucaguuacagguuuguagacuuuaaaguggagguaaaacuauucaugugacacugcuuuaucaucuuucuuauuauaacuggcacuuucauuugggagcaucauugacuuucuaaagaugcuauuuaauguugaaauuguuaugacuguuagucuaaguugcaggaugauuuuauaagggggaccuuauuuucuaugaaagucacuacuucaaccacaugugauagcucuucuuaauuuuuuuuuccauuucuacucuuucccccugaaaacuacauggaaaggcuuacauuuucagcugguaaccuucuucuuuuuaaaaucacugaaaucucagcuguuccuagacaguuuucacuuuuaauaagaaaauaaaguugaguuucuuggaccuuucuguuacuauuucaacaacuuuagccaaucccugaaagagcaaaagacuauucuuucauuggccuuaauuugcugcuguuguacaugucacugcgguagaauggcagcaauggugcuuagaggggauccauagagaacauaauagaacuguguggugcuuguagugucaaagucaauaugggaaugaggcuuaugugcccugauauuuuuaacccuuuuugcaauagguuagauggagagauuugguggauagaagcuuugggugaaacauuacuuuugcuuucuaaauugugcaauuuccaaaaaagguauuucaagaaauguaagcacuaauguguucuucaagcaacaugauuacaucauugaguuuuuugauuauacuacugucuugaagccaucucucaacuucacagccacuguaaguugguauauuuauuuccaguccauagcaguaaguucagcuuaaugaaauagaaugggaaauaauauuuucaaugcuuuucuaaaaauuuaagccaaaaaguauauaacuuugucucuuuagacauguggggcauguagauuuguuuccaaaugaccuuugucuauuuuuucuaaaaaaguaguuuucaacaacaguaaaaauauuuuuugaaaauguauuuuuuuuuacaagcaauuuaaguuagauguggauugcuacacugaagcuuuuauuaauuaauugaaauaauuacaugguagucaaaaauuucaauuucaauuugguuuuuauaaugauuaauuguaguucuaacaaagauguuacauuaaaaaauuaucaacaaaucucauuuuuuggagauaauguugaauuaacacauuaauugugugaauguugacaaugagcaaggcaugguguugggcagggcuauagagccaagaagggcucagucccuacccucagguucacaguuuuugugauggugacaggaaaauauauacuuaacuauaacucauggcagauuaagauuaguguuacaaauuaauuucuguagggauuuaaagcagggguugccaaacuuuuucugcaaagggcuagagaguaaauauuuucagcuuuguggccauguggucuuugucacagcuacucagcccugccauuguagugugaaagcagccauagccaauuuauaaauaagugagaguggaauguguuccaguaaaacuuuguuuacaaacauacuggauuggccuaucagcuugcaguaguuggcugaucucugauuuaaagaaaggaggagucaggccuggcgugguggcucaugccuguaaucccagcacuuugggaggccgaggcaggcggaucaccugagguuaggaguucgagaccagccugaccaacauggagaaaccccaucuccacuaaaaacacaaaaaauuaggcgggcgugguggcacaugccuguaauuccaacuacucgggaggcugaggcagaagaaucgcuugaacccgggaggcggagguuguggugaguggagauugcgccauugcacuccagccugggcaacaaaaguggaacuccauuucaaaaaaaaaaaaaaaaacaacuaaaacgacaaagaaagaauggaggggucacuuguugaaugggucgguagacguuucagguaguuucugauuucaaugaucuuaauuuaggcaguuugaaaaggucaguuuaaaaaauugaggcugcaaaugguaauuucugaaugaguagagugaaaccaugggcguucagagggggagaguuggcugugggauaggcauggggguuacuaugggaugcuuuauggaagaggauggucuaaacuguuuuuuaaaagauuaguuguguuuuaaaugcuugggcaugggagugggagguggggagcaagauaagaagugagacaagaaggagaggucuggcuggcaauuucggggugcacucagguaguguuugagggagacugcucaggcugugugcaggaggauggcuguagcccaggagugaggggaugggcagccuuguggugguagcugugggaguggagaggauggaagagagaagcauaggacuuugguguucauuggauuugggggguggggagagggagggaaaauucagaaauguaaagucuugcaaaauccugauguuagcgaaaauaggaaaaugacaugguugcucauuuuagauaugugaauucaagguguccaggauauccaaguagaaauuuccugcagguaacuggagguguugggcaugaacuccagagaagggcaaggaugggaauuuuggcuuuaggguacaaucacagagaugacaagcuaagcaauaggauugcugagaccuuggaggaagggagaagaacagauguccaaaauucccacauuuagggagaggaaagaggaacugaaaaggacacugagaggaugcagaaagagagguaggaagugaaggggguuauuuuggagccgcggaaguuaagggaauccauaauauuaacaagggaguaaucagugauguuggaugccuccuagagagaggccacugaaucuggauauuauagugcuaccaauaauuuuugagaguucaauuucaugagaauacuacagacggaaacuguauuuaaucguacuuaaauccuuuguguuuuuaagauguuuuguuuugaccauuaggugaagguaacucgugcugauggcaaccaacugacucuugaagaaagaagaaauaauguagucauaacagugacacagagaaacuauacugaguacuggagcggaucuaacaguggaaaucagaaaauggaagcuguucagaaaauaaauuauacugucccccaaaguggaacuuuuaagauugaauucccaauccuggaggauuccagugagcuacaguugaaggugccgucuguuucccaucauugugucacugcaacaacaccauuacaguuguaaucuugugguaggcacucaaccugucagaacugaaaguacauaggaaguggacacauguuucuguuucacaaaauggaggagagugguaaaaguaauuuaaugacaguggcugaagguuagacuaaauuuuuccuuguaaguucauuuugaagagcacaguaaaauauagcaaugugaagauaugauggagaauuuccucaaauccccagucuaguguuugaggucagucauuugaaauuuuauuuuggcaggaauugaaaugaaagauaaauauauauacauauauauauauacacacauauauauguauauguauauguguguguguauauauauauauauauauuccuuuccuguguuuuaaagcuaucaguuucuuuacaguauaagcuauaaaaugaugaaaauccaaugucuggugaauguauuuuucuugcauuaaaaaaaagugaagaugaauuuggucuuuaauaauuguucagcagguaacaucuuuucucaagguguuacuaaagaugaacauuuacagcuccuuuuucuuuuauuauaggccuauuuccuugguaguaaaaguagcauggcaguucauagucuguuuaagucuccuaguaagacauacauccaacuaaaaacaagagaugaaaauauaaagguaaugcuuacaauucacuugagaauuacaauauaauuggacuaucuugcuuuugauauguacauauuaauuaagguuuuuuucuaggugggaucgccuuuugaguuggugguuaguggcaacaaacgauugaaggaguuaagcuauaugguaaucucuuauagaaucuaaauuuaugaucuauuauagaaucaucuuuuuauucacuuuuaaguucugggguacaugugcagguuuguuauauagcuaaacucaugucauggggguuuguuguacagauuauuucaucacccagguauuaauccuaguacccauuaguuauuuuuccugauccucucccuccuccuacccuccacccucccauaggacccagugucgguuguuccccucuauguguccauguguucucaucauuuagugugcacuuauaagugagaauaugugguauuugguuuucuguuccugcauuaguuugcuaaggauaguggccuccagcuccauccaucuuccugcaaaggacaugauuuuauucuuuuuuauagcugcauaguauuccguaguauaugugcaccacguuuucuuuauccaguccaccuuugaugggcauuuagguugagaaucaucuuaaauggugucuaccuuauaucuacacuaaacuuauuaauuuuuauaacucagccucauaccuuuuuagccugucguuuuaacauugcaaucaaauaaaaaaccuuuuuuauuucuucaccuauguuugcauuuccaauuuaaaauagauaacuaaaccuuguuuuauguuuaaaauuuaaauuucuauuugauaagcaauauauauucauuauagaaaauuauacaauguaagaaaaaugaaaaagaaaauaaaaagugcuauccaugaccauguaauuuugcuaauucagcuuucccaauggugcccuguauuccuugcaaucaaaaauagauucuugacuaugaagcuacuguugcuccaaucaguauuacuuuaaucuuaccauuuucuuuuucucaguguaugcucucuguguuugucagagagguuuuccugcauuccaaaagacuuugaagcugguuuaauucaagaauuuguguguaugcauacaauuaugauuaauguagcuucagaugagauccuacuagguuuggcaauaaauuaaacccaucuacuguucuuuucagguaguauccaggggacaguugguggcuguaggaaaacaaaauucaacaauguucucuuuaacaccagaaaauucuuggacuccaaaagccuguguaauuguguauuauauugaagaugauggggaaauuauaagugauguucuaaaaauuccuguucagcuuguuuuuaaaaauaagguaagauuuaagguaaugauguuuaaaagaaaacuuuauauuagugaagucugagaaauguaauauuucuuuagaaaaguaucauuaagccaaacugguuagaaauuuauauuauucuauuucuagaacuaugguuaaacuuuucaauauuuagcauuacauauauauuuucacuuguggaguuauuggggauugauagucuauuuguaaacuaugguucuggucuuuaagacuuuaacucagaucaugaagcuguuucagaauuuuucaaaugguugaauuaauauugcucaggagugaaauuccagugguaacauagaauucgugugguguugauauugcagugauauaaagggugugggaaggagugaggccaucuaggauaauacguagaagcagagcugggcuuucauuaaucuauuuaauuagcuggaaacuagcccagggcaacuuuucaaugagcuugauuacccugcaugugaggaucuguguggagucuggucuccaagugcaccagugccuuuuauagccuaaugugaccagcuugaguaggaaaucccuuuggaccccagcucugaaaagaaaccugauugcaucaucucauguauauaagaaugagccauugcugucacuaacaacugcugcccucuccauccucuuauguaaaaaauuauuccuuuaaauagugauuugcagaguaugguucuucuauuucuuuuuccuuuauuuguuaaaauauuugagaaguaacaguagugaucuguacuuucuuuuuuaaaauuuguauuuauuuauuuuuugagacuagguuauaagacuggcuaauuuuuguauuuucgguagagagaggguuuugccauguugcucagguuggucucuaacuccugggcucaggagauccaccugccucagccucucaaggugccgggauuacagacaugagccacugcgccaggccuguacuuuaguuuuguugagaauuauuacucucacuuugauuguuaaaauauaauacaaacuucuauuuuuuuagcuuaugaaaagaguucuuaaaaagauaacacuguguuuuguuagugguagagcacaauuuuugacuucuagugauccuaguaauugccugacaaaggugaauuuuaaaguagaaguuauggaggcuuaaacaucucagaaagcaagaccagguucuaaagcugguuacaguguaaaagaucacggacuuugaggaagcagaguauaugaauagcauacuuucaaguaauuucuuagcuauaagagaaaggaauuaguuucaguuccauuugcaacuauauaucuuucucuuauuuuuaugugauaaucaucacauuuauaaagaaacaacauaauuagaaauggaauaugucuaagcaagagaaaguuagugaauguuuauuaauguucaguaaugacuauggaauaaauaaaugagcuguaggagcggcaagagauuuagguuuagaaaucauccacacagaagugcaaguugaagccauggggcucugagguacagaguauagagugagaaguacaaggucuaagacugagucuugaacaugcugcucccucucccccaugcuuuaguguguagguggagaaaguaaccuacauacagugguuugagaggcaugucagaaaaaaauugcacuggacaaguuaaacagguaaggaaggcuuuauucaagacuauugcaauggaagagagagaugauaaacucaacucugcugaaacaaaaggcagaagaguuuuuaagcacuggggugaacucauaugaaagugcuggaggacauuguugggagguuggucaaugugauuagguagucuguguuugcuaauuaguacuuacugaaguuagguuuccacccucccacagagaaugagaucaauugggacucugucuuucuugaugauuauacuucaaagggauggcucugaggaccuugagaaagacaugccuggguuguaaaacuggccagaggcugggaaaagauuuacaucucagagaguuggagaaagaauuuauaauugcauguuuucuaaaauaaaugcucuaagaaaagggagcucaggggcuuauaguuaggaagaagccugucuuuguaaagucgagucaacuugaggggaauguuaaggcccucuuugucaggcauuauaaucauuggcacagcagaauguugagauagagcuagaugaaaugaaaauucccagcaggggccaggcacuguggcucacgccuguaaucccagcacuuugggaggccgaggcaggcggaucaccuguggucaggaguuggagaccagccuggccaacauggugaaacccugucucuacuaaaaaaguuacaaaaauuagccgggcaugguggugggcgccuguaaucccagcuacuugggaggcugaggcaggagaaucacuugaacccaggaggcaaagguugcagugagccgagauugugccauuguacucuagccugggcaacaagagggaaacuccaucucaaaaacaaaaaaagaaaaugcccaguaggcaggggccucaugacaaggccauuugguucagcggugaugcgaugacugaugcucuuuauaaaguauuaguagguccaggaccaugcuuuccugaggguaauggugaggaaguuuagaaggccauggagacagagcaugagggccuggacuaguguuugcucuaaccacccacucccuuggaaaggccaccccucacccucaguccaggugguucuaugaguccccgaggagcucuccuugccuucacuucugagcucacgucaccaacauguaggcaucugcaguuucuuuccucuuucguguuucuccuuuguauacuggccuuccccagguaugcuagacacugcugucuucuacucagcacuggcugggaucugaggggugggagauggagaaagggaagaaaaaagauacagaauuaaagaauaauucagauuuauaccacugugagaaguucuaugacuugcaaacacucugggcguaguuuuuuuauuccuuucccuagagaaggguuaugcaugguuuuagaauuaucccugagccaaggcaaauguagaaucuuugcuauauuuugggccaguggucugcuauuggcaagaauaugcuuuaaaaaagugaaauaaguuaauccuccuuucucucuuuuuuagauaaagcuauauuggaguaaagugaaagcugaaccaucugagaaagucucucuuaggaucucugugacacagccugacuccauaguugggauuguagcuguugacaaaagugugaaucugaugaaugccucuaaugauauuacaauggaaaaugugaguuuagcuauuuuuucauuaugaaaauauguauuacaagagaaagaggaaacuuuauuguacuacuuuaaauauuuaaagaaaauuucauuaguuccuuugcauguguaagucaauaauuaguaaagcuuccaaauaaaaaguaaucuguaucguaaugguuauguuggaaagaagcuuaugugguuaaguguccuugcucucuuucaucagaauuaucaccuaaaguuagaugggaggaauaaauucuggaggucugugguacaacauggugacuguaguuaaugauaauguaccauauacuugaaaauugcuaaaagaguagauuugaaauguucucaccacaaaaaaugaucaguauguaguaugcaaggugauagauauguuaauuagcuuaaucauuccacaguauauacaaauaucaauauaucacauuguacuccauaaauauauacaauaaaaaaugccaccuauaguuuuccuucauuuucauacuacauuuuaagacacucaagaaaguacuaggaaauugacuugcauuauucuggguuacguuggauaagagagcuuuagauaauuuuugaaguguguucuauuuugguuauacguaaugguuauaaauaauuacagcacccauugugccgggcaugguggcucaugccuguaaucucagcacuuugggaggccgagguggguggaucacgaggucaggagaucgagaccaucuuggcuaacauggugaaaccccaucucuacuaaaaauacaaaaaauuagccgggcgcgguggcgggcgccuguagucccagcuacucgggaggcugaggcaggagaauggcaugaaucccaggaggcggagcuugcagcgagcagaaaucgugccacugcacuccagccugggugacagagcaagacucugucucaaaaaaaaaaaaaaaaaaaaaaaaaauuacaguucccauugaaucaggaauuugcaguauauugagggggugaaaucauguuacucugcagaaaacuuacaaaccaagaaguauaugaacaucuagcauugcauaaaugaaucccauauucauuagucauuugauuuuuauuuauauguccuugauauauucuuguguaccauugucaguuguaaacuagauuguauaauuuuugucuauuaauggauucaguagagugauuaacaauacaucagaaagaaaacuauauauaguuggguugauuuggucauuauauuguaaaauuuaguuuacuucagaaaaauuguacauuuucuucagucuacacaacuauuuuuuucaaucuuuucuuuuuuuugaaaacuuuuuuuuuuuuuacaaccaguuggucauuuuucucucuuugacuuuuccugaguucacauuaguuuuaugucuguagaucuugcauuugauuuaacugaauauaauaguaucuguuauuuuauagcuuucuaaauaucuugguaaauauauuauuucauuuuuucuucccuacauauguguauguuuguguguguguacguguguguauacauacacauacacacacaccccaucugaugugcugcgcacucugucucuauuuacauuuauauauguguguuauauauauauuuacaaguauauuuauauauacauauaauauaugcauauuuacauuaaauuuuuucagauauuaagauugcuuucucagcuuucuuuugguucauauuuuccugguguauuuuuacauuucuuauuuucaaccuuuuguaaauuuuuaaguguaucuuuuaaauagcauauuauuauauuuugcuuuuguuuuucaaucuaaucuaauagucaacaucuuuuaauaagcuuuuauuuaauccacuuauaaguaugguaauucuuuuucuaauggggacuuuuucugcuuuucuauauuuuaaaauuuagauucuuuuucugugggcuagauuaaauuuguuuuggugauuuagaaguuaugcguucuauuuuuguuacucuguuaguuacaaacuguacccauauuaauuuauccuuguugguuucuaaagguuaucaguauuugaaucuucuaguaugcuccuauuccuuuuggucucuaccucugucuccuccuucuccuccuacccuggccagaucauuuugcucguguacagauuuuaguuccauguuaccauagauugccuuucaaucuaugcuguucuuucauuuuuuaauuguggaaaucuguguugauuauuucuuccuccccauuuuauuuuuucucuccuucugggacuuuuguuuuucagaaauuggcacuuuuacuuccuccuucacaucucuuaguuuuuuguuuuauguuuucuaucucuuugucuuuucuguguuucucugggagaguucuucagucaacucagcuuagugaucauucauuagcuguauuuuaaucuacuuuaaucucucauauugugucuuuuaugucagcuauuauguuuuuaauaucuauuauuuuuccuuuguuucuuguuuuuguuuuauauucugauauuucccauuaucuccuuguguauauuugcuaugcguauuuuaaauuauugaauugaacuuuucaguaauuuugugucacaugcuauauguuguuuaguuggaugucuuacuucuacaguauuuauacucuuuggaagucuagcugauuuggcagauucucugauaauaucuauuggugaaggcugagcauaagguuccaaucuguguaaguccuaugaccccuuccugaggggagaggacuagccucauggacuagagaauuacucuugauccuuucugcugcuugccucuauucaguguuucacucuuaaacccuuggggaaaagagcaccaguaagagaaggucuccugagguuaugauucaccagcccugaggguuuggaggaggaggagaggaagagugaaugcuugagggacaugggucugucugcauguuuucuucacuuucccacacuagaaaggcagaggugcugaccugguauuaucuuuuggauacuugcacaggccgucugagcugcuacugcuguugauuuuggcagugaaguugccaggacuguguguccugaggcuacccccuggagggaaauaagagcaaaguuuaaaaaccucuccuccagccuguuuucugacuaugucugcugcugugucuagcugccuucugccuuagacugaagcgaugcacuuucucccaagaccaauucaagauguccaccacucuuccugggguuuucucacugugcacguuaaaguuuucugcuugcuuuuauuguuucuccaguugguucuggaggagggagugaggauccugucauaguagacuguuuuggcuucuuuuuuuuuuuuguuaaauuuauauguguugucaauagccucuugaaugccuuggaauaauuucaguauguggaucuuccaggaauaauuuuuagacauuagccuucuuuucguuagccuaugcugcagcuuugacagugcuuuguuuauugagccagugagaacaggaagauuucuuuaugagauagaugcugcuuuugcuuuuuuuaaaauaaauuuuauuguguauauuugagguuauguguauauauauauauguauauauguauauaugagguuauuguguauacaugagguuauggaauacauauaggcaguauagugguuacuguagugaagcaaauuuacauauuuaucauuuugcauagcuacauuuuugugacaaaagcaguuaaaaucgauuuaaugaaaacuccaaauaucauacaauucuauuaacuauaucucucauguuguagauuauauaacugcauuuuuucaucccacauaucugcuauuuuguaucccuugaccucuauauucccauuuucuucuuccuuucccccucgccccuguaaccaucauuuguuuaucuauuuauuuauuuaaacuuuuaaguucagggauacaugugcagguuuguuacauaggcaaccuugugucauagggguuuguuguacagauuauuucauuacucagguaugaaguccaguacccauuaguuauuuuucaugauccucucccugcucccacccuccacccucugacaaucucuacuguguguuguuccucucuauguguccauguguucucaucauuuaacucccacuuauaagugagaacaugugguauuugguuuucuguuccugaguuaguuugcuaaggauaaugaccuccagcuccauccauguaccugcaaaggagaugaucuuguucuuuauggcugccuaguauuccaugguguacauguaccacauuuucuuuauccagucuaucauugacggacauuuaguuugauuccaugucuuugcuuuugugaauagugcugcaaugaacauaugcaugcauacaucuuuauaauagaauuauuuauauuccuuuggauauauacccaauaaugggauugcuaguauugaaaugguguuucugucuuaagucuuugaggaauugucacauugucuuguacaauggcugaauuaauuaacacuccuaccgacaguguauaaguguuccuuuucucuacaaccucuccagcaucuguuauuuuuuugacuuuuaaaugauagcuauccauucugacuggugugagaugguaucucauuguguguuuuuauuuuauuuuauuuuuuugagacaaagucucacucuguugcucaggcuggagugcgguggugugaucucggcucacugcaaccucugccucccagguucaaguaauucuccugccucagccucccgaguagcugggacuacaggugucgccuccacgccuggcuaauuuuuaaacuuuuuuaguagagaagggguuucaccauauuggccuggcuggucucaaacuccugaccuugugauccaucucccuuggccuccuaaagugcugggauugcaggcgugagccaccacgcaaguggccuuuuuuuuuuuuuuuuuuuuuuuugacagagccuugaucugucacccaggcuggagugcagugaugugaucuuggcucacugcaaccuucaccuucuggguucaagcgauucuccugccucagccucccaaguagcugggauuacaggcgugagccaccauacccagcugauuuuuguauuuuaauagagacaggguuucaccauguuggacaggcugguuucaaacuccugaucucaagugauccuccugcuuuggccucccaaagugcugggguuacagaugugagcacugugccugguggccuccuuaugguucugauuugcauuucucuaaugaucagugauguugagcuuuuucucauaugauuguaggccucauguaugcauguaugacuucuuuugaaaagugucuguucauauccuuugcccauuuuuuuuuuuuuuuuuuuugagauggaguuucccccuuguugcccacgcugcaaccuccaccucccggguucaagugauucuccugccucagccucccaaguagcuggaauuacaggcaugugccaccaugcuugcuaauuuuguauuuuuuaguagagaugggguuucuucauguuggucagccuggucuugaaaacucuugaucucaggugaucugccuaccuuggccucccaaagugcugggauuagaggcaugagccacugugccuggccccuuugcuggcuuaaaaaaauuuuuuuuuucuuguaaauuuguuuaaguuccuuauagaugcuggauauuagaucuuugucagaugcacaguuugcaaaaauuuucucccauuuuguagguuguuuacuguguugauaguuucuuucacugugcagaucucuuucauuuaauuugaucccauuugucaauuuuugcuuuuguugcaauugcuuuugaaaucuuuggcuguuccuauguccugaaugguauugccuagguugucuuccaggguuuuuauaguuuuggguuuuacauuuaaguuuuuaauccaucuugcguuaauuuuuguauaugauguaaggaagggguccaguuucagucuucugcauauggcuagccagcucucccagcaccauuuauugaauaggaaauccuuuccccauugcuuguuuuugucagauuuguugaagaucagauaguuguagaugugcagucuuauuucuggguucucuauucuguuccauuggucuaugugucuguuuuugugugaguaccaugcuguuuugguuacuauagccuuguaguacaguuugaacucugguagcaugaugccuccagcuuuguucuuuuugcuuaggauugucuuggcuauacgagcucuuuuuugguuccauaugaauuuuaaaauaguuuucucucguucugugaagaauguaguaguuuaauaggaauagcauugaauacauaaauugcuuugggcaguauggccauuuuaacaauauugauucuuccuauccaugagcaugggauguuuucccauugguuuguucaucuaugauuucuuugagcagugguuuguaguucuccuuguagagaucuuuuaccucccuaguuagcuguguucuuaaguauuuuaucuuucuguggcaguugugaaugggaguuuauuucugauuuggcucucugcuguguguuguugguguauaggaaugcuagugauuuucacacaucgaggcuuuccugaaguuguuuaucgguuuaagaaacuuuugggcugagacuaugggguuuucuagauauaggauuaugucaucugcaaacagggauaguuugacuuccucucuuccuauuuggaugcccuuuguuucauuuuuucuuucuuucuuuugccugauugcccuggccagaacuucuaguacuauguugaauaggagcggugagagagggcauucuugucuugugcugauaaccacuguuuagaugcugcuucuugaauuggugucugagcaagagcggaagcaaaucuucauguauuuguauuuugugacagaguuggagucauggaacucuagccuuuucucuccaauaugccuggcucuggcucccuugucuacuugccagcuucuugacacauuaugaauuuuuuuucuuauuuuauuguuuucuuauuggugccuguucuaguugcuuacuguggaugcagccaugguuguuguuagcauugcagaaauagugguugcagguguuuaauuuuaugcuggaauguguuuuuuucaacuuaguuuuuuuugugauuuuuaauucugacuuugucuuaauuugucugguuaauguaaauuuuuagggagaaguaucaaaauuauuaccuaaaaagguauaauacuugauuuuuauugaaguuaaauauauauaaaauaaaauuugcuauuuuuaccauuuuaaguguuuaauucagugacauuaauuacuucacaauguuauaugaccaucaccaauauuuccaaaacauuuucauggcuccagacagagacucuguaaucauuaagcaauaacuacucauuuccccuuccccacagcccuugggaaccucuagucuacuucugucuuuaugaauuuaccuauucuagauauuucacauuuauauaauauuugcccuuuugugucuggcuuauuucacuuagcacaguguuuucaagauuauuccauguuguagcauguaucagagcuucauuucuuuuuuuuuuuuugagacggagucuugcucuguuacccaggcuggagugcaauagcgcgaucuuggcucacugcaaccuccgccucccggguucaaaccauucuccuuccucagccucccgaguaguugggacuacaggcgcccaccacuacgcccagcuaauuuuuuguauuuuuaguagagacgggguuucacuauguuggccaggcuggucucaaacuccugaccucaugauccgcccgccucggccucccaaagugcugggauuacaggugugagccaccgcaccuagccucagagcuucauuucuuuuuacggcugaauaauauuguguuguguauauauaccacauuuuguuuauccauuuuucugcugauggacacagguuguuuccaccuuuuuggcuacuguaacuauugcugcaaugaacgguggcauacaaguaucucuuggaguuacuguuuucaguccuuuuguguauauaccuaggaguggaauuacugggucauauucuaauucuauguuaauuuuuugaggaucugacaguuuuacucuuuuagccuguuuuacccacucuugcuagcaaugaguacuauucuuaaaaaaaaaagcauugcuaaugggguacaugcaaauaucucauuuuugaaaaaaccguaucucauggauguugucauuugcauugcuuugauuaucagugaggcugaauauuuuucugcuuauuaauaacuuauauuucuacuuuuguaaauugccucuucaguuuuuuuuuuuuuuuguaaauuuaggucacugacauuuugcagaguuuauauuaaucuccaacaaaguuaaccuguuuaucucugccaaaagugugggucauuuuuaaugcugaccucugccuguuggucuugucaaacaguaacaucuaaguucucccuggcagaacucaaguccagacuucuuaggaacucuggauugcugaacagaguaaaaguaaguauaaguaagaaauguaauuuuggcugacugacugaugaacaaagcaauuacauauucauuacuccucaauuugugucauuuucaaaguugauaaacaugaaggcuaagucuuaucuaaguuacuuggaagaaguguggaaaguuguuaugaauccauucauuccguauauuuuaucuucuccuuaggugguccaugaguuggaacuuuauaacacaggauauuauuuaggcauguucaugaauucuuuugcagucuuucagguauguuuugcuugcuauauugaaaagauauuaauauuuuuuacuauugcaaacccuuucagaauuagugaucauuuugagauguuaaccuuuuauuaaaugugucacugaagcgcagucuuauguaaguauaauuugaaaugaaaagauaaucaucuuuccaguuuuaaaagcaaauggaacaauucaccauuggaaaaguuaauggaauugacauuaaacaaauaauuuuuccuuuauguauauguauuuccauauaaauauauuuuauguauauauauaauauauaaauauauuuuauguauauauauaauauauaaauauauuuuauguauauauauaauauauaaauauauuuuauauauauuuccuugacuuugaaauggcucuuaugcaugaguguguguguguauguguguguguguaagacugauguguguauguguguuugagaaagaucaauguguaugugcguguguguguuugagagagaucgauauguguaugcguguguguguguguuugagugagaaagaucgaugggcaugugcguguguguguuugagugagaaagguugaugugugugugcguguguguguguguuugagugagagacagaaagguugaauguaugugcauguguauaccuaagcucucaaaaaugagcacaagugagucaggaguuugggagacugccuugauaauuuagugagcauuuaaacuuguguuuuaaaagaaaauaaaaauuauucuuuuuaggaauguggacucuggguauugacagaugcaaaccucacgaaggauuauauugaugguguuuguaaguaauacauggcgacaugcuuguauuugucuuucacaugauauucaacauuacuuauauagguauggauauuuuuuagaugaacauagagauugugauuuucauuuuuuuguucucuucucccaaaauguuuggaguuuaauguacuuagaaguacaucugggccaugacauggaacguucaucugagcuccugucuagauauuugaagugaaugcuuuccuuuuucucuagguaauucuuugagguaguuauauuuuuggacauacuggaagcugcuuuucuucugauuuguaucacaaacuguccuauucuuuuggaauuauuuaaaaggagcaacauauuuuugaaauauuuuuguacuccagcuuuuugauguucaccuagaaaauagcccagaugccaucaugccauaaaguauucugguacacacacacacacacacacacagacacagacacacacacacacacagagacauagacacacacgcagacacacacacacacacacaccccucaucaaucugaguucuuccugggcaggauuauaucuguacauccuaguuucuugaauugccaaauagaguuggcugccaaguaauaauaagugugcuuuuagaaagacgucauaaaauguuuugacugaaggaaauguauaaauguauaaauuagaaugguuaaccuuagaagggauucucuuuucuuucagguuaaguuauacuaacaucaucuugaaaggcuucuagaacugucacaguuucuaucccugaauucccuguuucugucagguauucuguuauuccaugcuaagcccccgggucucuuugggcugguucuugccccaacaggacaccugauccucuguccugaaacuuaaaagauaauuuuauagucuugaagauguuaugaagucauuaugaucucucuacauuaaagacaugugguacauuuagcuuuccucauauaacccucuauccuagacaaucuuccaagcauguuuuuccauuuuucagucucaguuuuuacccaucuuuguucuuuuuuacauauugaauccuucuugaugcccacuguaauacccauucuauugccaguaauacuuacuguauccuuuaccuuuucugaaaaccuucuucuaccuuuucacuguaacagaaggaaccugauacucucacuggcacauuaugucucuggacaccucaagugauugacauucauuuuguauguggaguuuacaauucauucucuccagugacuguuuuucuaacuacugucaauguuuauuuauagaugacaaugcagaauaugcugagagguuuauggaggaaaaugaaggacauauuguagauauucaugacuuuucuuuggguagcaguccacauguccgaaagcauuuuccagagacuuggauuuggcuagacaccaacaugggguaaaaauuuauaaaguucuuugcccauacauauuuuguuuaguguuuguuuuaaauaagcuuugcccgcuuucuaauguuuaaguacaaacauaguguaacuaagaacuaaguagaccaaaaggauuuuuuaggaaaugauauuuauugaaucuaaauacaguuuuugauaaagccacacauaaauuauggcaggaaggucucaucaaugagaagauaggccuuuuuuuuuuuuuuuaacugaagggugauuuugacuuccuugaagucucaugauucuuguugaagaaaaauugcugggaguacauuuguugucacaggaugggaagcacucaugauuaccuccugugaccccuggcagugcugcuaacugaacccugcuccucacaaagcauucccaggagucacagggagaaggggcaugggugguggaaagaauucagcuuggcugauaaaccccguaccaccuggccugauaauugagcagguaaaucaugaaauccacauaguauuuuauagucagcuguuuaaagauacuugaguuaacacaugagugaaaucucaaggaaacaaauaacagcauugacagggauacagagaaaaacuucugcaaauuuagagaaaaaauuggaguuaaguuugaaaauguguauuuauuaucuauaaaaaauuugugaaaaaauaauguuuauucugaagauguaaauuuugcaggaagauuuuauuagaauauggaucaauaugcaguauuaugaccuuaugaugaccuauucuuugaaaaguugggauuuacuguuuuauacuuaaaccuuuuaaaugguuuuaaauucagauauguaaacaauaggaaaaauugaaauucuuccaaaaauaguuuagauuauuuuggcuuauuucaaaauguaucaguucuugguuuugugauguuuauauuuauuaucuugacuucaguuacaggauuuaccaagaauuugaaguaacuguaccugauucuaucacuucuuggguggcuacugguuuugugaucucugaggaccugggucuuggacuaacaacuacuccaguggagguauuguauuaaagagcugcuuaucaguauuacggugacauuaagcuaauacagcgucagcuccucaauuuuuuuuuuaaaugacugcuuauaauguuuaucacaguuuagagauuccuuggcuuugucuuuugguuuuuaucuguuuuauauuuaagaaugugagcuauauauagcuauauaaacugcuaaaugugcaaaguccguauuaagauuuggguagaaaaguuuauuauugaccugaacuaaccaucuccaaaggccagaagagagagaaagaaaaagagagagagagaaagaggagaggagagagagagugagucuuucuauuuguccucuucaagaaugaacagaacuucucaagauguucccuagccaauauuccaucaugucuuuuggucaaauugcaucauauauuguuuccuaagccagucacuggcaggaggaauauaaugaccaugaguggccugaauuuucucauuugaaauugaaauguaauuuugauuuacaaaauaaucguauucaugaaaaauacaguguagauugaaaaaugcuuuggguuuauauagaaauuggaauuagauuguaagcucaggccacuauaaacagacaauucagcaacaugaaugucugaagggacauucaagaaucauuaggaacauggggcaauuuuucauugucuggggcuguccugaguauugcagacugucacccacuaacuaccuauagcaccuucgagucauggugacaaucuaagacaccuucacaaaugugcagauaaacucuagagggaguuacugcugccagcaaaaccacuggccuaaacuaacccagguuuagcuuuagaugcagguguggggcuuggccuuuucuguaggacuuggccaacaauaucagaauugggucacugaggaggaagcacauguauucagaugucccacacauuuucucaucuguauguaaaaauaaaucauauauauguuuuagaaauaauuuccaauuuccucuuuaaauuuagucaggaagcacauguauucagaugucccacacuagaacaggggcuguuggauuuggcagggcuuuuaaagcagauugguggagucaauacagcaugaaagaagagcaaauugcuucgggauuagacaggcuggguucuaguucuggcuccucuacuugccagcaauaugaauuuguacuaguuacaaaaaucucaaaaauuuaauuuucuuuucuauaaacuaggagacuaacaguaaccuuaugggguuguaauaaccaaacaaaauaauuuaugugaaguguuugguugcuauaaggcacuuaauaaaguauagcaauuauuauguuaaguaacauaaaucaagucaauuugccgucauucauuugugauaaguugcuguuugcuuucuguugauagcaaguugacauuucuagcugaaguuaaaagcuucacagguuuuauaaagauugcauuuaauugcauaaaaugugaagaauuuugaccugaauaaaaauauguacucguuguguucuuuccagcuccaagccuuccaaccauuuuucauuuuuuugaaucuucccuacucuguuaucagaggugaagaauuugcuuuggaaauaacuauauucaauuauuugaaagaugccacugagguaauguauucaagcuuuuguugaucauuuacacuacaggagaaaaucgagguagcaugaagggauuggguuguguaguaucugggcauuugggauucuaagcacuuuauacauuucugggaggcugaaaauagacaugucuugucagugauuucuucugcuaauuaaugucuaaggauaucauuagcaugucuacacauuaccuccuugaauuuucagcauagguuuuccucuuuugccauguaaguuccuuauugucucugaagcaugccuuucucuuuccugccucccugcauuuuccccugguuuuccccacaucuagaauguguggccacuucucacugccacucugugcccacugcaguuuuguuuuuuuuuuuuuuuugagacauggucuugcucuguugcccaggcuggagugcaguggcgugaucucggcucacugcaacuuccaccucacagguucaagugauucuccugccucagccuccgaguagcugggauuacaagggugcaccaccacgcccagcuaauuuuuguguuuuucauagagacagaguguugccauguuggccaggcgggucuugaucaagugaucugccugccuuggccucccaaaguacuggcauuacaggcaugagccacugcacccgacugccauucuguuauguuuguagcccccauguuuauauuuucaaggauucacuauuggauucacguaccuuguaucuccuuagcuagucauuucccugggaggcaggaauuagguucacuguuuguguugugcccacaguauguuaaccaagugacugauuuuucuucccccagaauaaguagagauacguaauuaacuuuauuacauggaugaaaaugacaugauaucuuuaggcacuuuauauauaauuuuuuuuaauuuaaauuuuaauuuuuuaagcuuuuuauuggcauauuuggcugacaaagugggaaguaaauuuuuuuaauuuuuuaauuuuacuuuuuaacccaguuaucaugguaccauguaacaagcaaaagaucuagagucuaaaggccuggauucaauguuuaaucuaccacuuaccagcaaaugacuuaauuguaguuuccucaucuguaaaauggaaaugauaauuauuacacccacaaaagauaccuugagaagcagaugaaaacaucaaugggaaaauaauucguaaaauuuaaggccuagauaaaugcuauuauugaugagacuugcaacuuugggauaauuuacaaaaguuuacaaccaagauaugcuucaggacuaauaucugaguuguacuuuccuuggaauaauuuuuuacagagacuucaauaaauucaauaacauuucaugcuguuuucuucaaauuuuucuaaugagaccaguauguuccaggaugacauaguuaaaucaagcuaguaguaauaucaauauaugaaauagccuuucugugcacauccuuaccaucuaauggcuucagauagugagagaauuuaaaguuagugggaggacuagaaauggggcugaagaucgcccuuuccccauguaucuugagguugaggggaaagcauagaaaagaaaugaaguuuuuccugauacucuuugauacucuccuuggucgaaucuuugucucaucuuuucgcuagucuugagccucacagauuugacaguacuuaaacuggugauaaaagagcacuuuacugaagagcaucuauuauacaaaagcuuugauuuauuuuuuucuuucagguuaagguaaucauugagaaaagugacaaauuugauauucuaaugacuucaaaugaaauaaaugccacaggccaccagcagacccuucugguucccagugaggauggggcaacuguucuuuuucccaucaggccaacacaucugggagaaauuccuaucacagucacagcucuuucacccacugcuucugaugcugucacccagaugauuuuaguaaagguaaauauuugaugucugaaagaagugaaauggaaauacguaauuaaaaaggaagcagaagguuuuuucucuugguuaaauuuguuggcauaucuaguaggucaucuucuuuacccuucugguaaugccuaaucacuuucuaaucuguauguaaaaauaaaucauuuagaaauaauugccaauuuccucuuuaaauuuagucaggaaugugacuauaaagacuaacgucucuuuugcagucauuuacaucuacagacuguguuacguugggauccuauuaaaacacggccaagucgauuuguagauuuggaauuuuggaauuuuucagugaagguaaaagagauuuuguagauuuuuuucagagaagacauucuagacagaaagauaaugagcauaguggauaaacacuuguauucuggggugaggcaacccuguguuugaaucucagcucugccaagugugauuuugaacaaggcauuuaaucucccccucuuuggauaauaauaggaacuaccucaaaggguuuuuuuccuuacauuuucaucuucuucuuugucauuuucaaggccaguccaugagaugccuuaucuaauuuaacuagaacuuacuaacagauuugaaguaagaauaacaaaaugguacgcgcugugucaucagauuuaauucauuuccauggaaauggugccuauuaaguguaaauccugugaaaaacacguuucaguuaaugaaggguacuguacuuagugagaaaaucuaaaaggaaaaauuaaucaaaguuaugguaauuuuuuguaauacagacuaacaagaaaaacucauucugugaaaugaauguauuacuuguuuaaauaaaauaucuaauuuaaagaaaacaaaauaagaaaugauaggugccuauuuagccacacacaaaccucagacacaacaggucagauguuugugcucauaucugcguauaguucucuguaaacaugugaguagagaccauguuaauuguguucauuuuuuucaacaggcugaaggaauagaaaaaucauauucacaauccaucuuauuagacuugacugacaauaggcuacagaguacccugaaaacuuugaguuucucauuuccuccuaauacagugacuggcagugaaagaguucagaucacugcaauugguaagaauagaguauaucaccaucuauugguuuaauuguauaugaucauauauguuguucuuguaauuauagauguauuuucuuauugaguccuaauaagaagagauggcaaaaguuuuuaauugggcccaacaacucauuauaauaugaaggcuagcaaauuauguauccuaaaacuguucucaaucuucaaugugcauaagaaucaccugggagucuuguuuaaaagcaaauucugguuuaguaggucuggaguggggccugggaaucugcuuuucuaacaagcuccuagguguuggugauacucuggcuuguagaccacacuuugaguagcaaggccucacuauacuguggcuggagggaggguucauuccuaagagcagagcuucuggcuucuguggcucuccaccacuggugaauaucagaaucuucuaaggagcucuguaaauacagaaacaucuggguucuacucuaaaccuacuaagucagaaucacuugggcuauggcuuggucauguauaucuuaaaaaacuuucacaagugauucugauaaccaaagguugaguacuccucccuagggcaguucucugugcaggauaugaguaaccuuuacaguaggaaguuacucacugacuucggucgccucuccuaguuacuuuccauaacauaauaguacuuuucaaaaauuggcaauuuauaauuguauaaauuuaugggauacaaagugauauuauggcuuaugaaugcaauguggaauaacuaaaucaagcugguugacguagucaucaccucaaauacuuaacuguuuuuuuuugugggaagaacauuugaaauuugcugucugagcauuuuuuuuuuuugaggcggagucucgcucugucgcccaggcuggagugcaguggcgcgaacuuggcucacugcaagcucugcuucccagguucacgccauucuccugccacagccucccgaguaguugggacuacaggcacccgccaccaugccuggcuaauuuuuuuuuuuuguauuuuuuaguagagaugggguuucaccauguuagccaggauggucuccaucuccugacuucaugauccacccgccucggccucccaaagugcugggauuacaggcgugagccaccgcgcccggccuuuuuuuuuuuuuuuuccuuugauggagucuugcucugucucccaggcuagagugcaguggcaggaucuuggcucacugcaaccucugccucuugggguucaagcgagucuccugccucagccuccugaguagcuggaauuacaggcacgugccaccacacccagcuaguuuuuguaguuuuaguagagaugggcuuuugcaguguuggccaggcuggucucgaaccccugacccaaagugcugggauuacaggugugagccauggcacucagccuuucuuagcaauuuggaaauuuacaauacucuuguuauuaacuauauuuaccaugcuaaaaguccuuuuuuuuuuuuugagauggagucuuucucuguagcccaggcuggagugcaguggugugaucucgguuuacugcaaccaccgccuacuggguuuaagcaguucuuauaccuuggccuccuaugaagaugggacuacaggugugugccaccaugcccggcuaauuuuuuauauuuucauuagagacgggauuucaccauguuggccaggcuggucucaaaccccucaccucaggugauccacccaccucagccucccaaagugccaggauuacaggcaugagccauugcgcccagccuaaaaguacuuuuuaauuagacauagugucuacacaaaugguguuauuaaucaggguucuccagagaaacagaaccaauaggagauacuuacauauaaaaggagguuuauuaugaggaauuggcucaugcaauuauggaggcugagaagucccaugaucugcuuuugcaagcuggagacccaggaaggcugguaguacucacucugaguccaaaggccugugaagcagaggagcugaugauguaaaucccaguccuaggagaagaugagaugagaugucugagcucaaguagugaggcaggaaaaaaagggugaauuccuccuuccucaagcuuuugucuauucaggcugucaguggauuggauggugcccacacacacuggggaggacaaucugcuggacccaguccaccaauucaaaugcuaaugucaucuagaaacacccucacagacacucagaagcaaugcuuaaucuaggcaccccuuggcucacuuaaguugacacacaaaauuaacccucacaaaugguuuguuuauauaguugugcuuuacaaauaacugaagaaaacauuuuaauuaaugacgucuaauaguuuguuaggucuuuaagguguuaggaccuaaaacacuuuuuuacaguucuuuuauauuucacuggcagauguaaugcuuuuuuauuauaacccaaacaaccaauccauaggcagaggacuuuauuuggaggcauauauauacauacauacauauauauauauauauauauauauauauauauauauauauacacacacacacauacauauauauauauauauauauauauauauaauuuuuuuuuggaagaggcaggguuuagcuauguuugccccaggcuggacuugaacuucuugaacuucugagcucauguaguccuccugcaucagccccuugcauaacugggacuacaggcaugcaccacugugccuggccaauucuuaaaaggaauuaaauaagcucucuauuuaggggaauaaauucugcuuaagcaucucccacaguguugggaugcugggacaugcacuacacauacauacacacacacacacgcacacauauacacagagggaaggagccuggcuuuuuaaauauguaccaucacuccuuacacaggaacgauucugucugucgucauggaaauaccccgaggcuuaauuuuuaugcuugauguaaagaacggauuuucaaguuuuauuuuuacauguuguuuuaaagaccuauuuuguaucccagaauguacgaauuuuagcuugcuucuuugaacuuugauagucuauguucacuuugaauauuaaacacauagccugcagugguaauaauauaaccucuauuuuuuucuuuguauucacaucuaaaauuuaagcuauacuggcacagcuucagucuauucauaugaaacagguucuuuucccuuuuuuuucauauucauuuuuuaggaucacauuuucacuagguauuuggacuuggcuugguauaaguuuucaaaauaaacuacauagaaagauacucuuaucuauacagcuuaacaauggcagggccaaaauuagaacucagccuucauauuucugaauuuuugcuacuuucccugaguugugguguuaggauguggguagaggguuuuuaaagcauguguuuuguuuaauuuuagauuacuaacuuugaauccuuuuccgaauccuuuugauccugagauuaauugaaauacuuauauuuguuguuacuaaacagaacacauuggaaaacacuacaauccucauuguuuuuuuaaaaaauuauuucucaaguucuugugguguauuaguaagaaauaagaauaaaauuuuguuugcgugaagaauacuacuaauaaaauguuucuuuccuguaugagugauggugucuuacugaucaauucuguacauuuuuuuaaagauuuuuaaaaaaauuauuuuuugccuaauuuaugccacaugcuuaacugagcuaaaaauguccucuuucaucacaugaccuacaaguucaguaccagagcauuguuauuuuuuugaccagucuuccuaaaagcuugguguaaaguuccaacucuguuccaagcaguggaauaaugauauugcuucaaugacagaggucuucuguacucaguggaagucucuuugccaccagcaggucguuguuacugaguauuuacugaaugaacugcaugucuugugcuuccaggagauguucuugguccuuccaucaauggcuuagccucauugauucggaugccuuauggcuguggugaacagaacaugauaaauuuugcuccaaauauuuacauuuuggauuaucugacuaaaaagaaacaacugacagauaauuugaaagaaaaagcucuuucauuuaugaggcaagguaagcauuuuagagaccuacauuuguucguagaaaaaaauuuguuuuuuucagguaggguucauucuagaccauauuucaaaauagauggauuuugucuuagguaagugaugggcuacacgguguugacaugugcaggaagugcaaacaauggaaagcuguuacaauucuuccuuuagcuaacuauucacucacugcugcuaagauguuuguuaguaauggcuuaagaguuaguuucuggugggagggcuuguauuauacuaagggaucugaaauuuaaaacucuuuaaaaaucuagaggaauacucauucauuuuauuacacauuuguggaguguuucuuagugccaggaucaguuuucgugccaagaaaacagagggagccagggccucucuucuuaaagaauucgcugcucaauggagaagaugguuuguauguaaacagacgcagugccgugugguggggaccuucucagugcauuuaaaaugaugaggaggaccugcuggacccugaggaaaugucaugcuagugaagacuguaucuugacaccuugaaagguggaaacuguucacaggcaccagauccuuuguuuuggcaacuuguuaauaacagcagcuaacaugaguugagugugcacuguguggcaggcaguguucuaaacacuuuacaucucauaccucauuggaggcucaccauuaguauuagcaugauccuguuuuuuugcagaugaggaagcugaggugcagaaaaguuagcuaacuugcccagggucauauagucauacagagcuuggauuuggacucugagccuaugcucuugacauccauaccuaggaggaaacaaagagaugugagacacguuugauguuaauaguaaaguaaauuugauuuucugaaauacuccaaaagcuuaccaaaguuacagucucaguuuuguauuuccuuauuaguggaccucuagcacaaacucucuguggcugaguuuuucucucugcacaauuuguaugauauaucccguccaucaaauucaugaggauuagaaggguucacacaaacugauuaaaaaugaggauucacuauaaucuaagagaaauauaguucaacgcuuuccaacuccuaauuuuuuuaguuuuuguuuuuuuauaacaaauggauuaaaugaaaaguaggggcaagcuauuaauugauugcuaauuucuccauaggagaauuagaaaacucaguaaagacgccauuguaaugugagcuuuucuuccagguuccauuauuguguagagaccuuuuuauucuaaaauaauucuauguaaugacaguaauaacaacuaaaucuguuuaaauguuuuaugcauguuucauuuaauucucacaaaaacucuaggagcagguguccuauuauuauuuccauuuuauagaugaggaaauugaggcacagagagguuaaagaauuuacccaugguggucugguuccaccguccaccuuguuccucagaacacuaugggauaauucugauuugcaguguucucugguuuuuagaagcaaugggauaugauggaaaggaccaggaaucgggacgggaugcuugaguaucaccaccguguaagaagucucacuggagguuuugauaaaauauuaagggaggaacaugggguccuguagagaaggaggcaccaaagguuagaauauggggugucagauuagacugaaguaagcuguaagguguuggguuuaaguagaugagcuggagucagugucugaagaucucccugggauaggauggcacagacaaaggcugaaugggagucaagggguugcgggucaggaacaaugcaguguaugagaucacaaaccaagggagaccagcguuuagaaucagggcugaguguggccugaguucugauguggggaaggacauagugguauauuuucccuuagauuagggccagaccaugcagacacuaugaccggcccugaaaugcaccaggugguuagguccucugggauauuuguagagauccagcaguuggaauuuccuguauagaguugcccauguaaaauuaucccuguuuauacacauuuguggauuggucguguuuuaaauauauacguacaagaauaaccuuugucaaauuuuauuauaauuaaauuuaagugguaccaaguggucucugugguauauugugugccaugcuaaacacaaaugagaucuuuacacauuggcauaauggcuguaauuaaggagauaaguaaaaauuauuugggauugucaugaaugaacguuguaccuuuugaaaacaagauuccaauuuguauucaagauuuaguuuuucugguuugaaguagaaacuacauaggaauuagacuggugcuuuauaauuuggcauacauucuuugggauaguuuaauacaauaagguaaaauauuucagaaaaugccacauauaacuccauauuuacauaugcuuuaugaacuguaacucuggcuaaucaaauauuaaugcuuuaaacagaaagcauaaauuuuacauagcuugaaacauguaagcagugaaaacucauuccuuaaaaauaauuucaguguguguccuagauacuuuugcuguggaucagcagccauccuacaaaaugaaugguccaaauccucaguaucuguuguuuucccaaagcagugcuagucccucaggucaguccuggccagguagguggccaaacuguaguuuuucaaaguaacccagaaagggucucuacugauugccugagaucccuccucacaucuguugguuguuagaagguacaguggccagagugcaaaaaaagcaucguucucuaaaugccaagcaguccucccaaguguuaagaaugccgagcgcuacagcuguaaguaggcgaguuuccccuugggaggaaguagaucaggggcauagcacuggcuguggaggcagucacaccugggcuugaguccuggcucccaccuuggaacagguucuuagugucuccaaggcuugguuuuuuuaccuggaagacagggauaauaaaagaacccacuuaguaggguuguuuuuaggagucagugagaauaaaagaacccacgugguaggguuguuuugaggagucagugagauaugucagcauuuuauucaacacguaguaagugcacaacaaauaucagcuauaguagaauuaguugccucuaacuagggaguuagagguuaaugucagugaauaaauccuguccauucucccucuaaaaaccuguaugaaauucuucuauuucucuccaucccacugcuaauuguuccauucaagcaugauugcucacuggacuacuccaauggcuuccugacuagucuuuuucuguguucccuccccuucaguacauucuccauauaauguaaaagggaucuuagaaaaugucaagauccugucacuugcuugcuuaugauccugcagugggcucccggcuucagccuacaggguccugggugaucuggcuuggccucccuccuuagccucaucuggagcuggcuguaucuggaacacucugagcuccaugcugcuucagggacaugaugcuuucccuuccuucuccuggcaugcuuucucccuaggucuuuccauggcugcuccuuuucaucauucaguugauguuugccucagaguggccuucccugaccacuuaguaacuccaauuuguacuacuccauuuuauuucuucacuuaacauuauuuaaaauuauccuguccaucaucuguccuggcauuuagagggggagcucugugacaguggggaccauguuugaccuucauuguauagcuaugugggcaucucaauaaauccagaaugggcgaauaacuuauuaccaauauuaacuuuuuuggacuuuagguccaucauccuaauguggauauuggguccagaagaucucugaagcgcccccacaguguagcaugaugaucucugggcacuaaugggucgaccuggccuuggcauucucuuagcagcuaagaaaugugaccagugauuuccaugugcuacucuuuuugcuggugaaguggcuggugaaagucagcacaguggagcuccccaaaaauacaucaucucacaugcugaacuaaauuauauuucaaaguaguggacgaaagcuucuugguauaaugcuuuucauuaugaaaucagugucucauuucagagacucucuuuuuucuuuugccaucacauuugccaaaguccuuuaaauauacuguaguuguuuuuauuuuuuaagaaauuaaaguggcuucagcgugagucaugauuauauuauuuaaaugucauuuaugaacagcgcauuguuuuacuuaaaucaugcuuggcccaggaguucuguaaccuaacccauuauuuuguuggucgaaacaacagcuacaucauugaaugaagugucuuugcugucaaaaaggaaaauggaaccauaacaugaaaacuguuuuugauaaggacuggaaauccagaaccuguuaauugaagauuuaaaccauuuguuuuccucagauauuuaaaucacagugccugcaguucaacuuuuuaaagugagacucaaaccaagucuaauugaaaacacuauauuuccuccauugaaauaaaaauaagagaaagaaagcuucagaauucggauguugccauuggucacaaguauggcuaguggccauagcuuaaaaaacugugauguucucacuuuccauuucaugucauagaaaguaaacaaauucauaaugauuucuuuuaauacagagaauuuuuuuuaucagcuuauuaccagagaaaauucuugaaauagucacaaauagccgacuuuacuuccuuuauuuacauguaauuuugacacgagguaaaucaagucaaacuauguuuagaauguuacuuuuucauuguuugugagcaguauuuuuaucuuuauuauaauaaauuuugaaauuuuacauucaugguuaucccaaagaaaauucauaacccagaacaggaugugucuuaucuggcccuuuaugaagggcucauggguuuuuaucuuaagagccucuggacuucuucugcauuucaauuuucagaagucuaugaaaguucugagcauaugauuacuuuucaaacucaagagccauuccuaaaaugauuaacuuaaaggugauacucuuauuucuucauaaacuuuuggagagagcuauguuuuugcuuuucucgucuguugugaugcagagucuccaacuuagaugacugcacuggaaggcugaguuguuguauuaacaacaaacauuauagacgagucaucaguguccuguuuuuuuuuuuuucuuuuuuuugugauggagucuugcucugucauccagucuggaguacagugguacgaucuuggcucacugcaaccuccgccucccagguucaagcgauucuccugcuucagccucccgaguagcugggacuacaggugugugccaccacaccuggcuaauuuuuguauuuuuaguagagacgggacuuugccguauuagccaggcugguuucaaacuccuguccucagguaauccacccgccuuggccucccaaagugcugggauuauaggcaugagccacugugccuggaccuguuuuguuuaugggauggaaauuaggccugauacacugggacgauuuggaggacagucgagggauccacaaugaugcaugcugguuuaagaugaggaaggaaaccucacaggacacucccacaaggagacauacaaguucucuccagguugugaauuucucccuuacuuuuccaugggagcagagcuggugguuuggauucucgguguuaucuaagccugcucaagaaauucacugcaaaacuggugauugucuguggccucuucucugggcuggcugccucuaguggaagaauggugcuaguuguugauauuaauggggaauguuggaggucagccaccugagggguaauuuccauaagcacugaucucaucuccaugaucucaucucugaccaguuucacaauaucucauacuuggaacugccguuguugaugugaucuggggguguggaggcacaugguccucuccuugagguuggucuuucugucacaaaaguaccucaaacuuuuguguagggauugagggccucaaaccuauuuucuuuuuucuucuucccucuccucuccuucuccucucuucuuuccuuuuccucuuuuuucuuagguugaauucauaguuaaacucuggcuaucuggagaauuuaguccuuaauuaaaaauugagggagaauguccuggacucucuugcugauuucuuuugugaacauuaauuauuuugcuucucugugaucccuggcugccucugaaaaaugagauaauauacugcauuuuuaaagguuaugugaaaacuaaaacaugauaaaaugaacuagaguagugauaaugccuaucauuuaauuuuuuccacuuuuguuuauguuuugaacauguagaacauuaacaugcuuccaaaagacaaacuuauuuugagacauauauucaaaagagugucucuucuuccccuuuucuuucucccuaccucucauugguaacuauaucaggcgguucuugcauuacuauaaagaaauacccgagucuggguaauuuauaaggaaagagguuuaauuggcucaugauucugcaggcugugcaggaagcauagcgccggcauuucccccuaggaaggucucaggaagcuuacaguuguggcagaaggugaacugggaacaggcacaucacauggugaaaacaaggacaagagagacaguguuguggggaggugccacacacuuuuaaaugaccagaucuuacaguaacucacucacuaucucaaggacagcaccaagauccagucaccucccacugggccuuaccuccaacauugaggauuauaauugaacaugagauuuguguggggacaaauauaccaguaaccuacuucauuaguuucuagacuaucuuuucucucucuccuuuugcgaaaauaaauguauacauauauguuuucucauuuccccccgcaauuuuuuuuuuuuuuuuaaagacagggugucucccuuugcccaggcugaagugcaguggcacaaucaugguucacugcagccuugacuuacugggcucaggugauucucccacuucagccuucugaacaggugggacuacaggcacaugccaccaugcuaauuuuuuuuuuguauuuuuguagagacaggcuuuugucauauugcccaggcuggucucaaacuccuaggcucaagugauccacucgccuuggccucccaaagugcugaaccuuggcaauaggugaaccuuggcgccucgccucauuuccccuuuuuauuacacagaagauaguauaucuauauguacuauuuuacacuuugccuuuuucacuuaacaguguauccaggaaauuacucugcaucaguugaccgagauauuccucauucuuuuuuucacagcugcauaguacucugucauguguguguaccauaguuuauucaaucagucuccaguuuuggggcacuaagauuguuuccauuauguuacaauuacagaugaugcuguaaugaauaaucuucugcguauauauuuuuguauuguuggaggugugucuucaggguagauuccuagaacugggauuacugggucagaggguaaagacauuccccuacaugguaguuguaaccuucugaauucccucuagcaguggaucagugcugguuuccauacagcucacccaacagaaggaguggucagacuuuugaaucuuaaugcuaaucugaugggagagaaaugguaucucaguguagguuuaauuugaguuucuccuguuaugaaguugaauguguuuucuauauuaagauuuguuuuuauauuuuugucuuuugugacuuaucuguuuugccuuuuauucacuuauuuuuauagggcuuuuuauccuuuacccuaauuuuuaaaaaguucuuuauauauguauauacauguaaguaauaacauauaaacauacauaaaaauuacauaauauugauauuagcuauuuauccaucuuauauguugcaaauauggucuuaauuuauuuguuaagccuugcuuauaguguguuuugccuuggaauaguuuaaaaacuuuaaaaaaauagucaaaugcaucaauuuuuuuauuuuauugcaucuggugcuuagagagccuuccucuacaccuauauuagagaguaaugccuauuguuuguugagagcuuuccauguaaaagguacuuacugaagucuuuucuucuuuuaucauguuuaauaauuggaagagcucugugauuuacuaggagacaguggccuuggagccagugagaaguuggcuaaugcccaacuucacucccuguuagcugugugaccaugcacaugguaucuguauccgcugaguuucagucucauuaucugugaaaaagggaauaauaauagcaucuaugucagaggguccuugugagaauuaccugaguuaauccugcaaaggacuuugaacaguuccugacaucuaaugagugcugaaugaaaguuggcuaauuacugcaccguaauaauucaauuagaaacauaaagguauaaucuaauguucccuucuucaaauuaagcaaaguuuugucaucacuuuaaauguuuauauuucuuuuaccauaagucuuaaauaucaccaugaaacagaguaucuuguuuucuuuuuuucuuuaugcauuuuguuuuauuguaacuuaaaucagauacuuaaaucuaggguuucuuuuggaaagacucagggagaaguuugggacuugaaggugagaacacauuaacuguaauuucaaaccauuaaugcuuauguuuaguuagucaaauaugaauuuuacuuauaguucuggaugcuucuaaaauaugguauuuauaaagucaaauuuguuuauuacugcaguuuacuggggaaggauuucaacauuucacaaaugaguaugguugccaagcuuugccaugucugugcugcaaagcucaggcugugugcccuuaccugcuaauaguggaauuguguaauuuuuagaaggauuuuuggcuaucagagagucauugauaaugccuugagcuggaaauguuccugcuaaugguugcuuuuuuagugauaaguuauugcuaucuuaacuuuauuuuuagcaaguuaguuuauuguggguuguuuggugaauccuuuagaguuuggccuauguuuucucacacuggacuuugagaucuguaugcauugcuuugcaaauaugaaacaucugcuuuuuauuugcaaucauuuauuuguaacuauuugcaaauaugacacauuugcuuuuauuaaugcagauacgugagccuuaacccccuaccuaauuuacuucuguaaugauacuucauugccaccacugagcauguguauauguguguguguguguguguguguguguguguguauauauauauauauauuuuuuuuuuuuuuuuuuuuuuuaguggaaacauggaauugguggguaggcaggcaaguugguuuuuugguuuaccucaguuggccauggccccaaaauuuaagagccaccguuuuagauuauuuugcauuuccuccucuguauugcuggucuaagaauagaaaauacuuuuauuuucuacuuuggccuuaaacuuaaauuaaugauacccuacauaguauuuuucuucuguagcaaacagugcuagaugacuaagcauugaaacaauuuugaugaacacuagacaguuaaauaaaagucugccuuuaauuugcuugcuuuugaauggcuagaagcaucaucuaugccauagugaucuuuuaauuuacuuuaauuugggauaucacaggcuuuuuuuuuuuuuuuugagauggaauuuuauuugcucuuguugccuaggcuggagugcaaugacgcaaaucucggcucacugcaaccucugcuuccuggguucaagcgauucuccugccucagccucccgaguagcugggauuacaggcaugugccaccaugcccggcuacuuuuuguauuuuuaauagagaugggguuucaccauguuggucaagcuggucucgaaguccugacuucaggcaauccaccugcuucggccucccaaagcgcugggauuauaggugugagccacugcacccggcugggauaucacaguuuuuauuuuaugcauucugcuugaaaaguccuggcauuuuaaauuuccaacagcacuuaaaauagaaaguacucaauauuagcucuugguuugauuucuucuuucccccucucugcccauauuuccucaauaugaagucauaauuagaaacuuucauccauugcaaguuaaugauuacuuugacuaucugucuauuuuugugucuagguuaccagagagaacuucucuaucagagggaagauggcucuuucagugcuuuugggaauuaugacccuucugggagcacuugguaaguguuuuugccaacugaacaaauccgugucauggaaugggcuuucacuaggucacaauagccacgaaauugacagauauaucucuauauauuauagacugggagguugcuuuuuccuuagucuggcuuuaaaaagagauuuucuuuuuaaaguauuauuuucaaacauuaacaaaucaaauguuuuuauuuagaaaagauaaguuauaaauccucuuuuuuguguguguguguguguggaagaaacagaaauaaaaauacuuuaugaugauggugcagcugauaaaaucaguuagaaaugccgggugauugugacacagcuuuuuucuuaaucuuccaugacuaauacaaguguuguguuacugcggucaauguaguuuaaguuuguguguguguguguguguguguaaaaaacaaacacugauggaauuaaguaugaacagccaguuuccuccagacuggaaucucuauguggcugauuuuggaugauuaaucucucuucuuguacuuaucuucaauuuccuauuuuacucagaaaaagauugacucacuguaucaaucaggauagacuaggagugcugugguaacaaccaaccuacucaaucuaagcaauuaacaaugaagggauuucuuguucaugcugccuuuccauuguggucagcagggggcucugcagcugccaacguguccacgucuccaaaaggaggcuccagguuugccacagcccggaaagaggaggcuggagucuauagcacuggcaauuagagacuucauccugaguguaucauuucuacucauuuuauccuucucagagcuggucacauggcuaugccuaaccucacuggggcaggaaagugaauuccucuguguaaccaaaguaaaagagaacuguauauuauugaauaucaguaauguuuaccacaugaaacuuuauauaacaugaaacagaucugcuucaaauuuucucuuggccuuggccugacucaggauauagaaccauaaauagaaagcuuucaguguuguauugcuugauguucuuuuuaccucaguauaguguuuuguagcagggacuggcaaacuuuucuguaaagggucagauuguaaguauuucaggcauuuugggccacguagagucuccguugcaugcucuucccucuuccucccucuccucccucuuucuuuccugucuuugucuuuuucuuuuccuucuuuuaaaacccgcucuuagguggugguguuggcaggugggggcuggguuggugcacacauaaacaggcccugggcuguauuuggcuugagggccagauuugggccaggcagauuuggcccacaggcugcaguuggcuaacucccauucuauaggagagaaaaauaucauuuuccccaccugaaguacuacaguuugcuugugaacuauguaugcauucuucacccacagcuuuggggcugacugaagcguguuggagcucuucuuugguaaauaucuagaacaguccaaagaugaauaaccuuggacaauuuauuuaacucucuuggacugucagauucucagucuacaaaauaauggagcuggauucaacagacacauuaaaaaaugcucaucaucacuggccaucagagaaauguaaaucaaaaccacaaugagauaccaucucacaccaguuagaauggcgaucauuauaaaggcaggaaacaacaggugcuggagaaguuguggagagauaggaauacuuuuacacuguuggugggaccauaaacuaguucaaccauuguggaagacaguguggugauuccucaaggaucuagaacuagaaauaccauuugacccagcuguggggaaaagaaagagagaucagauuguuaccgugucuguguagaaagaaguagacauaggagacuccauuuuguucuguacuaagaaaaauucuucugccuugagaugcuguuaaucuguaaccuuacccccaacccugagcucucugaaacaugugcugugucaacucaggguuaaagaauuaagugcugugcuuuagauaugcauacacauaaacaucucaaugccuuaaagagcaguauugcugcccgcaugucccaccuccagcccuaaggcagguuuccccuaucucaguagauggaacauacaaucggauuuuauaccgagacauuccauugcccagggacgggcaggagacagaugccuuccucuuaucucaacugcaaagagguguuccuucugcuuauacuaauccuccucagcacagacccuuuacggguguugggcugggggacggucaggucuuucccuucccacgaggccacauuucagacuaucacauggggagaaaccuuggacaauaccuggcuuuccuaggcagaggucccugcagccuuccgcaguguuugugucccuggguacuugagauuagggaguggugaugacucuuaacgagcaugcugccuucaagcaucuguuuaacaaggcacaucuuacacagcccuuaauccauuuaacccugaguugacacagcacauguuucagagggcacgggguuggggguaagguuacagauuaacagcaucucaaggcagaagaauuuuucuuaguacagaacaaaauggagucuccuaugucuacuucuuucuacacagacacagcaacaaucugaucucucuuucuuuuccccacacccagccaucccauuacuggguauauacccaaaggauuauaaaucaugcugcuauaaagacacaugcacacguauguuuauugcggcacuauucacaauagcaaagacuuggaaccagcccaaauguccaucaaugauagacuggauuaagaaaauguggcacauauacaccauggaauacuaugcagccauaaaaaaggaugaguucauguccuuuguagggacauggaugaagcuggaaaccaucauucucagcaaacuaucgcaaggacaaaaaaccaaacaccacauguucucacucauagguggaaauugaacaaugagaacacuuggacacaggaaggggaacauuacacaccgggaccuguugugggguggggggaugggggagggauagcauuaggagacauaccuaauguaaaugacgcguuaaugggugcagcacaccaacauggcacauguacacauauguaacaaaccugcacguugugcacauguacccuagaacuuaaaguauaauaaauaaaaauaaaauaaaauaaaauuaaauuaaaaaauggagcuggauuagaucauuucuaaauuccuuuucaaaucugagauuuuugagucaacauggaauuucuuggccaagcccaaguggaaaccaguucugccugcuagagagaguugcuuaccuugucccuuugcucuuucuuuuuugauuuuuuucuuuccuuguuccaucuucagugauucccccuuugaugaaucuucugaugggggaaaaaguguuguuguuuugcuugcucgguguuauuugguggaccuuauaaaguguauuuuauguaauuuuuuucucuuuucauaaagguugucagcuuuuguuuuaagauguuuccuugaagccgauccuuacauagauauugaucagaauguguuacacagaacauacacuuggcuuaaaggacaucagaaauccaacggugaauuuugggauccaggaagagugauucauagugagcuucaagguggcaauaaaaguccaguaacacuuacagccuauauuguaacuucucuccugggauauagaaaguaucagguauuucguauuuaauuuaauaaaugauagaugggaaauucaaggaagguaggucuuaaugggucaaauauguguguggaaacuuaacaaguugcagcuuuacaacacaugugaaaucugaauuugaguacucuuuugcuuugcauuuguggccauguuccaaaaucugagaauaaaacauuaacccacucuuucagaauaacuaagagaauucuaaaaaugcuuuuuaauguauguauuguacuugcuauugguaagauaagucaauacauguuuuaucauugaaaaaguuaauuucugaggggaaagaaaauuauuuaaaauuugacaauguguucuagcaaguuuagauugcaaaggauuuuuuacuuauaaaacaucauggaacaguuacaauaucuguuaauuuagugcugagaacacccauacccugaaaaguguguugaaugggcauggaugccuggaugagaaugaguaugcguggaaagguaugcugacgagcuuaaguuugcuccagagcuguccuggugauugaugccuuuacugcuuacugccugcugcauuuuaugagaucaccaaagucauucucuuuauuaggacccccacuauuuuccuauucuacuaguaggcauguagaagcuaaacuuuuccugaacuuagggccgcacuaccagagaucaaauauaagaaauauauuucucaagcaguuugcuguucuuaucugagucugugauacugagugggagaaacacuggcaaaagcucuacuuuuuucuucuagggaaugacaccuguuuacuuauaaaaacugaaaaacaguauuauuuucaaaaugcauggcaaaucuuuaaaugucaaugaucaugguugauuuucauugccuaguacaaggucagguacuucauagacacugaacuuauuuuuuaaaugcauguuucaaaguacuuuuuguuucaguaugugguaauggguuacucugaauaguaaaaaacauacuuuuuuucuuccaagccuaacauugaugugcaagagucuauccauuuuuuggagucugaauucaguagaggaauuucagacaauuauacucuagcccuuauaacuuaugcauugucaucaguggggaguccuaaagcgaaggaagcuuugaauaugcugacuuggagagcagaacaagaagguaaugugcugggcccacuugagguuguuaugcuuuaugaaauauauaacuuacaugagaaaaauuuuuagccagguuugaaauugauuacaucugcaucuuuuggugaaaaguaaaacacauaaugagaucaggaugggccugacauggccacaaugcuucuggucuccccaggguuuuuuuaacagaauuucagggcucagaugucucuuuauuuuagauaugugaugcccuaugucaguuacccuuugagugucugauaccauuucugguuuggcagccuuguaguuugcuaagaccuuggguucuggagagacagguuaaauccugguucugcaacuuaccuuuaugagguucaguuuucccaacuguaaaguggaaauggcaccuauuuuagaguggcugugaggauuaaaugagauaaugugcaaugcugcugcauagcaaaugcucaaaaauaggaacuaaaaugcuaauuaaaagaaaugugaauaccaaaaaaugcugcuaguaaguggauuauguguauuuuauauacaaaguggacagggauccagguguguguguguguguguguguguguguguguguguguguaagaaagagagagauggaagugggugggcagaaauaagauaauguccagugauucaaauuucuguuaauucaagaagggauaauuguagaaaguguuuagaggcuucugagacuguaaaaaauauuguauuaacaguaacuuagauugaauccuuguuaccuauuccaaagcuggggacuagaagauuauugcuuagaggcugaagcagucuuugacauuuuuucuucuugucugcuuggcuaagugguaguuauuuaauauuccaccuaaguguagucaucaucuaaauaguaauauuugagagagggcaccaaguaggaugguccucuggggacuagagcagaauuaucucuaggaagguuguugaguuagcuggggauccuaauuuuuuuuccugggggcuugaaccucaaacuguuaacaccaaccuucagauaaugaaaaugggagaguccagaauauuagagcuaguuaauggcagauucccagaauaggauucuuuucaaugugucuuaaaauauuuuggggauggccuggucagauaaguaacgugcauuaucuucugaaauauauuauuuuuuccuuuuauuuauagcuauuuagucuugagccaaauauagggaauuucucauaggaaaacuauuuucaucaaaacauccucaaauguaggcaaugggaaaaggaugaaaauuuacaaguauauagguugagcaucccuaauccaaaaaucugaaauccaaaaugcuccaaugagcauuuccuuugaguaucaugucagugcucaaaaaguuucagauuuuugagcauuucagauuuuggaauguauguaugcuguaaauauuccaaaaauucaaacaaaacagaaauuggacacacuucuggccccaagcuuuuuggauaagauauacuuaacuuguaauaguuuaaaaaagcaacauauaggcacauguauacauauguauguguguguguguuugugauaaauaaauacaugucuggcauaaauaaauacauguauacaaguauauauuuuuuaugcuaguuaaguacaacuuggaccagaguaggaauauuuaaugguauaaaauguaauuuuucuggauaauugaucagaauguuauuacuuuucucuugcagguggcaugcaauucugggugucaucagaguccaaacuuucugacuccuggcagccacgcucccuggauauugaaguugcagccuaugcacugcucucacacuucuuacaauuucagacuucugagggaaucccaauuaugagguggcuaagcaggcaaagaaauagcuugggugguuuugcaucuacucaggugagagaugauaguuuuuucccuuuaaacuauaauauauaauauagauuuauuuauuauauauauuuuauauauaauauauaguauauauuauauaaaucauauguuauauauaaaaaauauuuuuaaaaguaugugguugcauuuuuuccuugauuucauaaaauuacuuggcaguuucaaaguuuaguaacuuaagcaaaaggcuaaauugauuaauuuuaauuuuuuucuccucauuacuaugaauuucaugucugauauuuauauggaauaaaucaguuccccaucugccacuuuucaucugugguaacugauauaagaguagauguucaguuccauauagcaaauauuuucuauuuucuuuucuucuuuuuggaaaggaaaaacugaaacuuuuaauuuacugauaauaugaucauuuaugagcaaaauucagugggaucuacagaaaugcuacuaggauuaacaagugaauuuaguaacauugugguauaaaaaaaucauuguacagaaauccauuguaucuauauauaagcaauggaaaugcaaaucaaaauagcauaacaugugaacuguuuagggauuaaucugacaaaaaucaauaagaucuauacacuaaaaacuauaaaacauuucagcaaacauuuucugagccucuccuguacucuaggccaaggacauucaaauaugaaucagggagcauuccacucugaaggaagguguaugaauauccagcaacaaaauacuacuaaauuuacucuuugaagaccuugauauauacuuauauguacaaauguuuuucuucccucaacaggauaccacuguggcuuuaaaggcucugucugaauuugcagcccuaaugaauacagaaaggacaaauauccaagugaccgugacggggccuagcucaccaaguccuguaaaguuucugauugacacacacaaccgcuuacuccuucagacagcagaggugugggcaaggggcaguuauuuaaaaaucaguguagacaauucuuuaugcuggaauacugcuuuauuuguaaucuguugauuucaacaaagacuuguuuccagagcucuguagaguaauagggagaaguggugcccuucuuuggcugaauuugcugagcucuggaaggguggggaacuuuggaaagauugguggaacaggagaaaacacgggcacuguaacauugggaaaggaaugaacauagaaaccuguugaguuucuauucuucauaggcacugugcuagauuacuuuacguaugcuauugcauuuacuucucaaaguaacucuaagaaguaaguacaucuauccccaucauacauaugauaaaacugaggcugagagagguuaagugacuugcucaagaucauguuacuaguaacaguagagcuaggauuugaacucaucauuccaaagaccauguucuuuucagcugcuccacaugucuucuuaggagaauugauagaaccgguaguagaauucuuacuuuaacuggaauaaaagaauaugcuaguucuuaacuuuauucccuugaucaguuuugugggagguuaaguacaauggaugaaggugauaacuucaauucuggaaagugaugaagaguggugaugauaaaggaaaagaaagaauaaaguuaggcacagucauagacaauguguuauuguguuccugggagagccaggggauuaggcccugauuaagggaggucaggggagggagaugacuuuaguuucuugucuuuuaugcuucagccccaacaggaggacagacuugucaguagcacuaaugugcccucccaugggcagaggugagggagcuuggggagugugcacuuuuccuuucaucaccuugcuuaccuauuugacccauagcuuuugauaugugagacagugcaaagcucuuagugcugucagugauugcuucuuuuccuaaugagggauaggacugaucuguuuugcuacuuggaaggaucuagauauggaaaauuagccucauucacuuuuuuucaccuugauucagcuugcugugguacagccaacggcaguuaauauuuccgcaaaugguuuuggauuugcuauuugucagguauguaacgaugcuuauuuuuuuaaguuaaauaugacuuuuuauaauaauuauuugguuuggggcuuuauuaaaucuuagauaacuugaauauaauuccuaaugauuuacaucugugacuuaagcaagauauaucacugucuuuaauaaaaaguauuagagauguugccagccaaugaguagagagcaauuauauagauugauuuucuguuugaaaaguauuucuuggagauuauuugcuuuuugaagugaggguuaauguccuccaauaugauuccugauaacaaauacauguuuuacuuauaauuucuuaauauucaucugagaauauagaagucaacaugguagaauuauugacuugaggggaggaauugugucccuuuaauguaaaaucuuauauaauaguaaauauaacaauuaaagcauaauuaugcucaauccucugguacagaaagaaaauauaaagaaaucuacauuuuuauagugcagcaggagcuacaauaaaauggaaguaguaugaaaaauacugaauaagauaaucaucacacuaaauagcacauaaaaauauugaggacuuuaagaucaucucauuagaacccaaagauaauuugugauaggaccaaaaaugguugugugcuuggguagaaacaaacgaccaaacaaaaacacugaaacacuuacugagaaaguaaaaaaauggcuauuauggagaaaaaguacuuuuuucaaaaaccagaacaaccauucuaguagagagaacagguauacuugcugaguagggcggguauaccuugcuaagcagguauaauuuagaaacuuccaaauaauucuaagauuauuuugcauuauucucagaauacaguaaacauuuuuuaaaacuaaaggaaaaaugaucacaaugaaaaggaaugguauucagugaaaaggucagaaagagaaaguaaacaauuuauuucgaucuuuacuaacaaagaccaugggaaaauucucauucucaagcugucuugcaauccaagaguaaauccagaaguaaauaugcuguguauucuagauaaaauugaaaaauuauauguacuuaaaucaccaaguugguuggaauucauuuuugauaaaccaaauguagagaaauuagugaaaccaagugauuuuuuacuugaggcuugaagcacacagggguaaaugugguaccuguuggucagaauguucaucaaucccauguuggucucaaaaugcagaaaacaaaaggaagggacuaguaggcaccucucaugagggaggaaaaaaauuacaaagaaguuggucacucagaaauggguauugagauuucuuacaguugauauuuuuauaagugcucuggaacaaggaaggcaaagaaaacucaugaguuugcaguaaauauuacccucuuuuggguaauaaaauacuaaacuguuggaaauaaacugcaagaucuuuugaaguucccugagugagcaguugagcuuuauugccaaauguaaacccuaauacuuaguuauggaugggcauuaauuaugacccaagagacagaguaguccuuguuuguuuccugauagcauuggucucuaaagggacaauugcaugccaccgaaaggggaaugauggaaauaauagaaagcauuucuccaauuuuaugggacuguucuucagcugcuucaggaauacucuauaauuuaaucauuauacuuuaagaaagaguugacaaauguccaaaguaagauaaccagaaggaucgaguggaugaaggauuauaucaguuuggauuguggcagaauaagaagauugcaacuuuuagauuugaaaaaugaaggcuuagaggauuuuuuuaaguaugcaaauccaugagggguauuagauguuaguucugagggguguguguguaugugugugcacgugugcauauguguauguguuuuagguauaaguuaaaagaaaacacaaccuuacaaagcaacaguaagcuuuaugaaccuuguuauaaaaaaggggaugagguaaaacauuuaaauagauuccaguccaucuggagaugagauuggacuaggaaguuuugaguacauuccuaagcuucugauuuaggaucccuuugagaaagacacggguccucaggcucucccagugugucuacggcaccuuuaacaucagugguggguacagaguagaugcugagaaagacccaguugacuugaaagcuaucauuuauuuuaucaucuuugacaaacauuguaugaacaaaaauaauccucagcaauguucaacuaaggcucuucaauguuuuaguuuugauuuauccuacugagaguuuuugaaguucuaguuagagaaaaaugacuccauuugggcaacaggccuuagaaauuagugaaugcugucaagaaaguuuuuuccucaagggaauguuugcccucuuuggcaaaccaguauccccaaauaucacccauaguguuuuauuguacuuguuuuggaauauuacuuaacaguuuucuccauuuaaacauaauuuuauaaauuuuaauacuauuuguuaauagugauacuuugugagcaaguuaaauuaauuuuuuucuaguuugaagauuaaaaaucuuacuggguccauccaaagagaaucauuaccuaauacaguauuuagaaggcaaaaugauggaaauuuauguccaacuuguuauuuaugcuaguuuauuuuuuacagcucaauguuguauauaaugugaaggcuucugggucuucuagaagacgaagaucuauccaaaaucaagaagccuuugauuuagauguugcuguaaaagaaaauaaagaugaucucaaucauguggauuugaauguguguacaagguaagugucugcuuaggucucucuucuuuuuuuccuuuaaaaaauagacuugaagguuuaauuauguauaguugucuauaucaaucuaagaguuauauugaacaaagaauucaguuaugcacuacacuucagauuacaaacuagaaauacuacuaauuauauucaagcauuuauuagaugcauacaaaaauuauuuacaaguuuucccuggacguauaacacauuugaauagaacaguguauauauaaauuaauaaaacucaggucuaauuuaggaaaacuuuaaauuaagucaaucauauuuaauacuucaaaaaugguuauuucuuguuaugaguuauuuuucuguagaaauaauuauuucagguucauauugaaccuuaacuguuaggcauuuaacccaaaacuuuaugauaacgugcaaauucaaucaagaggauaguuuuuuuuuagguacauugaaaauauuccaguuuaggaguuucucaucuuggauaauuagacacuuaacagcugaagcuucugggaguacuuuuuaaguugacucuuaaauuguucuauauccaaagcaucugagaaucuuguuaauaaggaaaaaggguucuaccucaacccuaccgacuucacaguaagacugggaagcugcagauuuuuggucauuccacugcacacaggaguuugagcacacuccuugugaaaguucuugaauagaggcuucacuuuuuuuucuuucgugaaucuauucucuuacaucugcauuauuugguauugagcugggacuuaaagaugcacuggcauugaggagcugcuguuugcucuucuaaaauaucccauaguguccugguuuaacuuagcuuauuguugggcuagaagucccugaugugguccugagcuggcagauguucuucaaggucaucucuggguguucauccagguggccagccuucacagcuauugccuggacccagucuccgccauuacugcuacugucugucuuuaucuuuggaccuucuuguucaugauuuugggguaaaaugucccacauuugucccauucuucaccuucuugggcauuuugggccagcagcaaggggauaucagaaucucuguguuggcauccuuuucagcugagaaaaaaguaggacuccaauuauuuuuuacgaaucuuccaauuggucucuguuauagaauaacaacuucaaguuauuacuauuauuauaaacaauaacaaccuacaguaauuacaaacuuauaugccaggcacggcaccaaacacuuuuacgugaauaucauuuaauucuuacaggaacucuguaaaguauguguuauuauuaucccugcuuuucucaaauuccuggccucaagugauccuccugcguuggccucccaaagugcugggcuuacaggcaugagccacugugccccaccuauucuugcuuuucucauucguuuauuuauucccucagcaaguauugcuugagucucuacuaugugccaggcauggugucugugugucaggcgugggaauauaauuguaagccaaaaaagacacaagcucugccuuguggaacuugcuguuugagggggauacagaaauuaauggaaacaauccccuaagcaagccuaaaauucuaauuuugaaaagggcaaagaagaagacccucauggaguuaagagagggagauuuuuaccucuuaagagacaucaagugaagaaacaugagaaaaaugagguggggaaccagaauucagacugugaagaggccucagcauuuauagggguucauguaaggaugcaggauuuccaguuuuaagcaucaggaaucagguggacaacagaguuugggugguagguagagccugaagaagggaaauguuuucaugugaggguagggguuuuauaaaaaggauuuaaaugcugcuacuaguuuucugagaaaaaucugguaugaaggacaaauaacauuuagguguauuuuuucagcagcacauuauaaaaagauuacuugauauuucagacacuuuauuccuaucaacaggguccaagaccuuaccucauaccaggcuuucuguguggcaugauaguuuaacaaauucugccccaggcuugguagagagaucagaucaaccaagguacuuuuaauauguacugaaaguauaaucugcauugugcuuuuaaauguuuaagcauauugacuguuuuuuucucaucuauauuuuuuucucauaugcaaacaccuccaguuucaauccauuuauuaguucucaauaacaucuauuuuggcucagugcauugccagcagaugguuucaguugcuucggauugcagagccagcugaagucagcaguuguacuguauggcuuuucaaucagucauguuuggcaggcauggguuuucugcucuaaaaagcaagauuuuucuaacagcccuucuuucuuuugcuauuuaaaaggacaacagguacuaacuuaaugcuaugauucuuuuaaauuggaggcaaacaucuuuccauaaucacuuagcugggcuccuucugcucuaaaugaaaagcucuugccaucaauucauuuuauaaaaauauuuauuuccaagcagacaaaauguuguuggugcccagauccuuugaugcucacaucacguacaacagggcgagagaaggaugcaguguaauaaaacuuuccaaggcuuguaauucccucacgguggccaaagaaaacagaaaauguucuucaaguauaugggagaacaaagggaaggcuucucccuacuggucugauguuucuaaaaucagacgaauaaaagguugcuaagaccuuggaugggaccuaucacuaaguggucaagugaugccuccuucucagggccuggcuuucagcuugcaaguuuggugcugucaacuuuugagaaaaggaaaagugcaauucuguuuggaaucaccacuagaaaauagaguugucuguugaaaggauguauauuguacugucacaguuuauaagcacaagccucuuacauugcaggcauugcauacuaucugucagaugaacacauuguuguaucauuauuccuuauaugguuaaaaguuucaagauuaccacacauguaagaaaaugauaaccuguuuuaaaauucucuauagggaauuuuauuugaacucaaacaguguuuggaauaacauuugguggguuugauuuuuguaugaagauaauuugauaacagcuauggguuuuuccugaggaguuuucauucauccucccucuuugauuuagcuuuucgggcccggguaggaguggcauggcucuuauggaaguuaaccuauuaaguggcuuuauggugccuucagaagcaauuucucugagcgagacagugaagaaaguggaauaugaucauggaaaacucaaccucuauuuagauucuguaaguaguaaaacauaagguaacuguugacaaaaccacuguguuuuguauucaggugucuaccuuacuuuaaguauguuuucuuuaauucauuguuauuucaacuuuuugugucccugaaugaguuuaacauggcaaccauauauuuaucuccauuagaaagacauaaguauaaaaucaguuuagagaguugcuauuaaugacgagccugaugaaggccuucauaacuaaaucuuuauuucaugccagauaugaaauacguagaaauuuccauaguauaauuaaaaaaauucaacccagaucugaauuugagagccugucugccucagggaguugccuaggcuggagugcaguggugcaaucguagcucacugcaaccuccaacuccugggcucaagugauccucccacugcaggcuccugaguagcugggaccacaggugcaugccaccaugccuagauaauuucaugagaauuuuuuguggagauagggucucauuuuguugcccaggcugguuuugaacuccugacuucaagugaucuucuggucuuggccucucaaaguguugggauuacaggugugagcugccaugccuggcuggaagacgaaagucuuaauuacacauuuuaaaauucuuccaugaagcuuuuaacaaaccuuaaagggguucauauucuuaccuugaaaaauuaggugcuaaaucauggaagacuauucucagagauuugaucuugacauagaauuguuacauaaccuucguguacucuuuccauugcugagugaguacuacugauucaagaauaaagugcacacaguguguagggaaagguaagugaagaauuccagacucuacuugguaugucucaaaacuggugguauguaaguuuauucuuuucuuauagcaucuauaugagcuucauagguugaacugauauugaguucauaguauucuaaggauuucauauuacauggguggguuuguauguuucuuauuucaguuuugcuaaguaugaaucagaaauauauugcugaauauaugcuuuuaaaaagauaguucuugaauggucucauuuguuuuagcacuucaaaaccacuuugguuaaagcccuguuaaaacuaauucagucucaauauaauguuaaauaacagucucuagauucuuuugcuguuuaggaauuaucuuacauuaagcacugcucaaaagccauuggccugauuuggaacuugaaaaacaaauuuaagguuuuaguuuaguuguguaauugguuuuggaguuugucuucuaucuuugaugcucuuguuaaugguuauuuuaauuugaguguccaguacucuuugaguggucaguuugacuuuucauuuacuacuauuggcaaauaagggaauguuugaaggaauuuacuaauuucugauucuuuaaugaguguuguuugccaaauuggccagaucuaucucucuuggagacagauaggcuggccuuguguaccccaucucagucauuggcuguggaguacagccccaucuuaguuaccucaccuacugggugacauggcuugcaugagcugagggugauucccaggagaaggaggcugcugugagccauuaguaguaacuggggguggggugcaccaucugagacaggagaucuaggugcaugcacccucaggcuugcugcuuacuuaaccacucuaauucucaguaucccauucagcaaaauggaacuaagaacaauaccuuuuuguaagcauuguuuuacaaguuaaauaagauaguucauaggaaguacuuacugcaguaucugacauguagaaauccucccuaaguguuagucucuguuuccuaaaaugaugagaaaaaagaaaugucuuuacuuaaucaugaacacacagugugccaaccccuuaagacucuuuuguauuucucaagguaaaugaaacccaguuuuguguuaauauuccugcugugagaaacuuuaaaguuucaaauacccaagaugcuucaguguccauaguggauuacuaugagccaaguaaguaugcucuggaguucuuaauacuuuagaaauuaagccaggcauucauucauuuauuggaagugaccacacauuggauugguucuguggcgagggcaggauuugguaggagaaaguacaggaggcggggaggcaggaagugagcauuccauuucagugaagacuauugauaauuuacaagggucacaugauagguuuuagcauaugaaauuuagaaaugauauauuuuuucauaauguuuuagauuuuuaacucacaauuauaaacuuuacaaagaaaaauuggcauauagaguccaguuaugucucauuugcaagguauugcuucuauuccaagcacccauuccaucuguuuccagcuuuaaaaugggaguucuuaauguggcacauauacaccauggaauacuaugcagcuauaaaaaaggaugaguucauguccuuuguagggacauggaugaagcuggaaaccauucucagcaaacuaucgcaaggacaaaaaaccaaaugcugcauguucgcacucauaggugggaauugaccaaugagaacacuuggacacagagaggggaucaucacauaccagggccugucaugggguugggggaggagggagggauagcauuaggaguuauaccuaauguaaaugacgaguuaacgggugcagcacaccaacauggcacauguauacauauguaacaaaccugcacguugugcacauguacccuagcacuuaaaguauaauaaaaaaaaugggaguucuucuaaaaguagagcuaccauuugaccccacaaucccguuacuggauauauacccaaaggacaauaaauuguucuaccaaaaagccaccugcacucauauguuuaucacagcacuaauucacaauagcaaagacaggucaucgaccuaggugcccaucaacugugaauuggauaaauaaaaugugguagauguacaucauggaauacuauacagccauaaaaaagaacuaaauuaugucuuuugcagcaacauggaugcagcugaaggucauuauucuaagugaauuaaugaagaaacagaaaaccaaauaucacauguucucacuuauaagugggagcugaacauuggguacacauggacauaaaaaugggaacaguagacacuggggacuucaaaaguggggagggagagggggaauaagggcugaaacacucucuauuggguacaauguucauuauuugggugacaggaucaauagaagcccaaaccucagcaucacauaauauacccuuguaacaaacuuguacauguaccccugaacaguaaauaaauaaguaacaaauaauaaauaaaaugggacuucuucaggagagaacaugaacagcaucugcaaugcaguagcaucggcuggaguuagcuguuucuuuauugagggagucugguguuuugcugaaacuuacacuugauaacagauuuuuaaaagugugucaagaaaaauauagccuguuuggaaaauaacuugagcuucuuugauuuuacugguaacuucuuauuuuuauaaaaugauggaaauuuaggacguaaaaauagagagcuggucuggagauggcccaaguuuaauaggaugaauccauguucagucagagggacuuuuuguaugugaucucuggccuaauguuucuaauuguaauaugucuuauuuugaauaagcgcuugugguggcucagaaucaucacaaugcaugagaagcaugaacauuuuuauguguuagguaguuguagauaauuacacuuuaaaugagaugaacuuguucccauuguuguuaguguuucauagaguauucaagacuaagguguagcaccaguucucuccucauagucaacaagccaguuccucuugucuuuugccuccuguuggcacugaggaagaggguucacccagguucuugugggacauuugggaaacacugguguggcacuuuuuuucuaguggagggauggaauacacuguggagacccaaugacaguaacuaguuguccaacuuuauuacuuuacuuaguugcaaaauuccccaauuuauauuucuugggugcauggggaacauuuuaaacauuuaagaaacaaaaauaauucagucuaugcaaauuuuuauggaaaacaacuuacuuaugaggaggccauuuuaaaaugaaaauaugggaaagaucagaauaagcuaaaccuuccaacccauuuuaaaaaaucucaaaacacauuuacgauauggaaaacagucucugaaaaaucaugaauaaauuugaaaauagaauauguuuuuuaaaaauuauaaaacucauuuauguuuuacagugaguucacugugguguuauagguacuuuaaguaguuuuugucauguucgcuuuuagauacuauaugcugaguguuuuaaaacaagguauugcauaggcagucuucccuucauauuuauguauuuuuuuacuagagcccaggguaaaugccccuuuucaguaguucuaaugauuagaauuugauuugagugcauagagaaugucauccuaaaauaaacucuugaggagguuaaacaguccuuaacugaaaauucucccugaugcaguaagagauuaaaguggugcuugugauugcagugugcagcugcagucuauuugcucucuuuuaaugcuggccaacugcuggugguagacagauuggacugagcgcauuguuucucucuuggauuugguuaguacuuuggaccacucuuggacauuucaguuguuucuuguaaagaaaaauaaaauuagguuaagaauggaaaacucagaaaaguguaucgaaaugcucuuauauuuuggcaaagucaauguuucuaaacaagggagccgugugaacugaugucugcuucuuugaacagggagacaggcugugagaaguuacaacucugaagugaagcuguccuccugugaccuuugcagugauguccagggcugccguccuugugaggauggagcuucaggcucccaucaucacucuucagucauuuuuauuuucuguuucaagcuucuguacuuuauggaacuuuggcugugauuuauuuuuaaaggacucuguguaacacuaacauuuccaguagucacaugugauuguuuuguuuucguagaagaauacugcuucuauuuugaaaaaagaguuuuuuuucuuucuaugggguugcagggaugguguacaacagguccuagcauguauagcugcauagauuucuucaccugaucuuuguguggaagaucagaaugaaugcaguugugugucuauauuuuccccucucaaaaucuuuuagaauuuuuuuggagguguuuguuuucuccagaauaaagguauuacuuuagaauagguauucuccucauuuugugaaagaaaugaaccuagauucuuaagcauuauuacacauccauguuugcuuaaagauggauuucccugggaaugggagaaaacagccagcaggaggagcuucaucuguucccuucccaccuccaaccuagcccuacugcccaccccaccccaacccaccccaugcccaguggucucaguagauacuucuuaacuggaaauucuuucuuuucagaaucuagguggugaauuuuuuuuaaguggcacggucuuuuucugcuugaaaucugaucacaccccccagccauugcccucccucucuuuuuccucuguagagaaaugugaggggcaguacauuuacugugcuuuucacaccaucucagagguugaggagcauacugaaaauugcccuggggggugcugggugugcuaucuccuucccacauccucagccccacaccagcucuauuucaggggugagagucagagagcacugcaauaugugcuucaugggauuucgauucgaagauccuagaccagggagacacugugagccagggauacaacaaaauacuagguaagucacugcagaccgaccucccugcaguuugggaaagaagcuggguuuguggagaaucagagcaucuugacaugacugcugaccuaaagaucccuggcauuggccagggauccuguggaaccucuucuaguucaggggugugagcauuagacugccaguugucuagugacaucugaugcuugcugugaacuuuuaagauccccgaauccugagcaccucaaucuuuaauugcccuguauuccgaaggguaauauaauuuaucuggauggaaauuuuaaagaugaaucccccuuuuuucuuuucuucucucuuuucuuuccuucucccuuucuucuuugccuucuaaauauacugaaaugauuuagauaugugucaacaauuaaugaucuuuuauucaaucuaagaaauggu

SEQ ID NO: 16063 - RNA, 18412 nt, Homo sapiens
gggauccuucuaaaguaaauauucugguaccuggugcuggacuaggaagacuggccugggaaauagcuaugcuagguuaugcuugucaaggaaaugaauggaguuuuuuuaugcucuuuucuuccaacuuuguacucaacagguauuuaauuuauuuuuugcuggaaauaguaauuucucagaaucagauugacuuaccuauuuucuugaacaauuuugaauuugaagauaaguacauagcauuugauuauuauauauaucacaaaugugucuuauguuaaaaucaaaguacuuacacaaauuaucacuugaaccaauugccuaguuauuagaguguugaaacaagauggguaagugacuuuauagaaagugacugggcauuccaugaaaugauuucuguacaaaaucuucaggacuaaguaugaaccaggaaggaguauuucuaaauuuauuccuuaagcuucuuuacuuccuuguuucuuuaguuaaauaagaguuuaguuuagcaauuauaacuuuuucuccuuaaucaaguucuuauaaaauggccaaguaugcucucaugacugaguuggaaagaucucucagaacuucuguggccucuuuuggaaggcaguggaaaacaauuguuauuuuuaaagccagaagauguacauugaguagcugccuuguuuaaauaauauguugucucggauggcaguaugaguuuuaggggauuggugaaaaagggaaaaaagaagaggguuauacaaaaaauagcaaacuguuuuaguugaaaccaguaccauuuuaaaaaaccucguuggacuguuauuacuugguuuugaaguuuagaaauacauuuuuaaaaaucugaaugaacagcacauuuauaucucugaauuuacuuuuuuuuucugucuuuaauccauugauugguugcucaucuacauguauauguacauuuucagauaauuagggaagcuguaauagugacucuuuaaauauuaauuauauaugcaaaucuucaauuaaacaguauauuuuuaguauuuaaaguggauuuucuugguaaaauauuuaguuaacaccugauuuuauacucauauuuugcagauguucugaaauuaauaaauauaaacuuuauccuuggauccaucaguuuagcaauaaccggagaucagcugaucagauucgacccaucuuuuucccugauguugacccccacagucuuccuccugguucuaacuuuucuaugacagcaggagauuuucaagagauuuauucagaaugcaguaaguccaaaucaagcguuuaaaaagucuuguccuuuauucuaaauuuaaugagcuaguuuuauccuaagccaagguuuagaucauucauuuugaugguagaacauaaggcauaugucagugucaauuuagaauguuuucaaggucguguacaaggcagugauaggaaauaagaaguguaagauaucuacagucaagaaauuuagaaucuguugggcccauuaauacuaagagauaccauguaaacaaagguuaaaugaguaaugaauaccaaaaaaaugaaagguuauuaguguaagaaggaagcuguucauagugaggcuaugacuugaagguugagagaauagcauuugaggcagacagaaguacaaagauaugaacaaggugauuggggauggcagcacagcuguacuggcagggaaagaaaagauuuaaugggagauuuaaugagauuuaauaggagcuauugcuagaaaagugaauuuguuccagaucauggaggacuuguauagucaggcugcacaguugacuucagccuggcaaacuguugaagaaaucugagcuaggcaggagagaaagggagaugguaauagggaaaguggagagggagauuggcacuaaaaggaaagcaaaauagaauaccgaggguucagcaagaucauugagucaauagguauuuguugagcaccuacuaaguacuagguauuuuucuaggugucaaaagagaacagugaacaaaacaaaaucccuguccacagagaacuuccaauagagaaagugaggcaauaacaaauacaauauuguaaggaagaaaaaauaaggcagggaagacggguuacagagugacuggggagaggcugcugcuuuauauagaguugucagggaaagccuuucuaagaguagaaacuaaaaaaaaaaaaugucuaguagagaaccuugaaagaguacacagacaaaccacugagauauuugaaggcaaaauuuugcagauggggaauggcaagggaagaggaucagggaguagagugagugcuugcucugcucaaggaggagcuaggcuguaguaagcaauggguacaguggugagaggucagccucgagaggguuugaugaggcaaacuuguuggcaggccauagcaaggacuuggaauuguacucagagaaacaggaagccauuggagggcuuaaagcagggauagcaacaacauagauuguuuuuauuuauuuauuuauuuuacaacauagaaaguuuuuguuuauuuuucucugaacucugagacugggacaaccuguacucugaaggaagaaagggagagauggaagauguuagguguuguggauaaggaaugaaauaauggaaaacaucacuuaggcaaguaaaaguccccuuuuucuggagcaagguuugagagaacagaugaugaagguaguccuccaugggaucaagugccuuuauugcaccagcauuuguauagacaccauaccuccuagaggcaaacgguguucucuacuggguucccacccacugcuucugccugccccuggcuccccuuuuucccugguaauuauucgaaguugugguagauguugaaguauuuggaugucauucauuucucaguuggcaacuggugccugcagucuuucugaaaccugccagaauuggugguuaacacuaguuuaaauuugaaugacuauuauuuuguuuuaagugauuuuaaaugaaggcuagaaguugaauagaggauaaacaaaacucuaacaaauaccauuugguaauaauauguagagauuagauuauaauauuaguguuauuggggaugauuuccaaauugauuacuuaaucagauuauugauaucaguauuucccauaaaugacuguuugguuacuguaauuauaauguugaucagaaguuuagcuucuguaucucugucaaauauuaauacucuguaaaagguaacuggcagauuuaaauaauuaauuaaaagaaaaaagcaaaauaacauaacagaugcaguaauuugauuuuucuucauuagauaccugggacuguauugcuaccuguuucuucauagacacagcucacaauguaauugauuauauugauacaauauggaaaauacucaagccagguggaauuuggauaaaucuagguaaguuuuuuaguauuuacuaaaauuuuguauauuaaucugaguacuuacagcuguauuacauuuaacuucacagucucaaaugugcaugaacauuagaauuauguuguaaauguuuuaaaaccacuacaguuuccuuuagacugcauccugguggugaucccuccaaaggcaguggaagcucagaaguuguauauucacacuuaggucagucucacagucauuguaauuucaguguauacuaauuguugaucugaugguagguaaucauucccucauuaucaccaucccacaugcugagacagugguccguucuguuaggaagagaguguucucuuuuucuuucuauaaugaagcaugcggggagauuuuaccucuuccauggaaucuuccucccuaguacauccauauacugggaaggguguaggugugauaacuucugugauuaccuugaguuuaagaaagaauagaaacacaauuuuuuuuaugcaaaauuuuuuuuuacugcauucuacuuacuacucgauguuagaaauuaaauguugacuauaacauggucccuccaguccagaaucuaaaggaaauugccauuuuacuccuuuuuaaaauaaaggggguauaaugauaauauucagguagauauacauguauucuuucgugagauauauaaucuguguucagaaagacaucaugacuagaacauaaagguuuucaagauaaggauuauuauacuacauaaaaggacauaacguacauggucuugagcccuuggccuuccgggugggucuaguuuugugacugauuucugacaccuacucucuuuuuaauuuuaauuuaccagaaauuuugccauuugggacuaagcccuggagguaguaguaagucuuuugcaaacuucucuuaagaauuccuuaggaccagaugaaagcagcuguacaaugcaaucauaauaaaauaaauaucccaaacuguaagucuucuuuaaaaguaguuaccuugggaaauuuuucccaaggaaaaauggaaagauauuaccuacuggguauuugcuuacuguggguuagguacuguguuggucccuuauaaauaccuuguggaaucucaaagcagcccuauauugaaauggcacuauguuauaguugaagagacuuagagucuuggguuaaauaacuagcagaacaguccuguagcuuacauguggcaaagacaggcuugaagcccagagccaauuucuugauuacccucaguuaauuuguaaguuagcauuaacaugacccuguguuuauauaauuaaauuuuuugacccccauuacugaguuaugguaagguuuuauguauuuccagagcaugugacuuucauagaaacagcuuuuuuuuuaacauuuguuuuauugguuuaugaauauuuuauuaaguuauauaauacaauaauuguaacuaccugaagcacauaaaguuggcuccugauaaguauacuguuugauaagaguagauguacuauagugugacuuaugaucugucaugggcaucagaaguaauggagcauguugguuaacaggaagucaauuaggagagcuaauuccauuauggagucucaaaacaauuuugaaaauuguaauaauggagaaacacaguccuuaaaaauaguuauuuggaagguuaguacuuuauaaaguauuaacuuacacaucuuuugcauguauaaguuaaagaauguaaaaaaaaaagucucagaaucagcuuucuuuuaaauguuacuguguucugggcaucuaaucuguguuuuucauuuuuuaugccauguacucauuuuugacuccauauuccuccuaccuaaucucauggcuuuuccuacucuuuggauucccaaucuguaucucugguccaaacaucucucuugugcuccaagccaguauguccaacuuggguguaccacagauacuucaaaauccuugugucucaagaccagccugggcaacaugcccugagaccccaucucaaaaaaaagccaaaacaaaacagaaaaugauuccaugccucccaauaucuuuucuauuaaucaucuacucagguuacccugaagaaaaauacugggagccuuucguuaccccuuuuauuaggucacucaggcuaccauaacaauaccacagauuggguggcuuaaauaacaaguuuauuuucucacaguucugaugacuggaauuccaggugcucaccagguuggugucuagugagggcucuuccuuugauuugcagggguuacccucuugcuguguauucacauagccuuucuuugguugugcauagagggagaaggagugaaugagagcaugagugagcucuuuggugugucucuucuuauaaggacacuaauccuauuggaugaggaccccacccuuacgaccucauuuaccuuaauuacuuccuuagaaguccuacuuucaaauacagccacacuggggauuagggcuucaacaugugaauuuggaggcagggggacacaaacagucaauaggaccucucuuuuuccucgcuguuugucucuagucagucuaaaaguuguaucuccuaaagcuacuuaaucgcucuugaauauccuucuauuccaggguuucucgauugugguuuugacauuugggcuggaucauucuucagugggaguggugagggaagugggggucugaccuguauaguguaggaugguuaacagccuuccuggccucuaagacuccaguaguaccucccaguuuugacaaccaaaaugucuuuagauauugaaaaauguugcccuccggggguggaggguguuggcagagucauccccaguugagaaccauugcuccaauuucaugguuucuugccuggauuagcauuaggauuacuguaguaauuuccuuaaggacgccccugccuucaaguugucuucggcccuuuucauuucuccacauaaucaucagugaccuuccuaacaugcaaaucuguuccuguaagacucccugcaugaaauucuagcuuucuggaaaaccuaaacucuucaggauuauguuuuuuaccuucaggauuauuuuuuaccaccccuucucugaccucaagugccaguccuuugacuuagcccuuucuuucucuucuguuuucccuugguuaguccuuauguguucuuaaacacuuagcucaggugauccuuucggguuggguuaaguauucuguauuucuuauguucuaagagacucugcuguaacauauacuucaguuugguauuagcacccauaugcuuuuguuuccacugcuagucucuaagcuccauaagggcaaagaucuaaugcuuccuagucaccugguacaaagccuggcaaacaauggguauuaaugacuguuacauguauguaugaauguauuguuucaaaauuugaaaaagggaacauacuaagaugucucgaagagaugaugaagugccaucuauauugguaaauucauaacauucuuaugguuuuggcuuuaauuauauagaccuggaggcuuaauuuacccuguaaacugagagaucaaccucuuggggaugauuuuacccuaacccugcuuagguagacuagaacaucaauauauucauauauaaugggaaauguaauggccagccauucuggaacaaaugacauuggagguaaaauuauauaugaaaauguugcccaaacugcaugaaaucagauuugguggggaucauuaauuuacaaaugcuuuaauuaaggaggauuugauggacucuuuaacacuacccaguuuaaggaaagcuaguaagccuuuuaagggaacuauuaugcauauguccuuuggguaaggcuaugauuuuggcaaagaacaaaagaaugccugugaauucccuuuuucaguuuuucauccugaccagcacuccuuaaacacauuuauuuauaauuucuucuaaaaagaaaguguguguguauguauccacugauaaauuugggagucagguaguggagggcaggcauuuagcuacaucuggaagaauuaauaaaaugaaucuaacuacaucugaagaauuaaaauguaacuacaucugguaaaaguaccaaaggagaucuuuguaaaguguacugaaagauaggucuuaucagauuuuagagcauuaugaagcuacagaauuuuuuuuucuuuuuuuuuuuuagauggagucucacucugucacccaggcuggagugcagugguaccaucucggcucacugcaaccucugucuccuggguucaagcgauucuuaugccucagccucucaaguagcugggguuacaggcgugcgccaccacaccuggcuguuuuuuguauuuuaaguggagaugggguuucaccauguuggccaggcuggucuugaacugccgaccucaggugauccaccugccucagccucccaaagugcugggauuacaagcgugagccacugugccuggccuagaauuuuuuaaaacgagauucccuuuaaaagauagaugacugaacacauacagcccuuuccucauuauaguaguaguaaaaauauaaaaagauauaaaacacauggacaaagaauggcaggcauguuacugggggacaaaauaaugugccaguuuuuagaaguugggguagauagguaaguuuugcgaagaaaaacacaugugagagccaccuuacccgaauaacucuggaaaacgaggugcuguauggaaaaaccuaacuugaaaaucuguauauauugaacaguugacuccucuauaaucaagaugccuaccuuauaugcccauuuccacuccaugcucaggugagagaccauaaguuuaauucucuagaaaaaguaaauaggaaaggagcaggauuuaggaaagcguguccucauauagaaugggggcgaaauguagggcagaaaagaaggggauuaauuaaaaacuuuggaaaaugcucaagcagugaacgucagcccaagccaucuccaaccccuacccugccuauaaaacguaccaagguuuggccgggcaugguggcucacaccuguaaucccagcacuuugggaggugaggcaggcggaucacgaggucaagaaauugagaccauccuggccaacauggugaaaccccgucucuacuaaaaauacaaaaauuagcugagugugguggcgcacaccuguagucacagcuacucgggaggcugaggcaggagaauugcuugaacuugggaggcagagguugcagugaucugagauugugccacuucacuccagccuggcgacagagcgagacucccucuggaaaaaaaaaaagaaaaaaaaacuuaccaagguuugaauuccagauguuuugcacagaugcaagucacauuucuuggagugggcaugucaauaucacuauaugagcuuauuuuaaaauuaauaacuguuucuuguaucuuuuucugucucuuaaaucuuuaugccuaacuuuuuagauuuuucagccuuuuuguggcaaucuuuauguuuuaggugugucucuuacaaacagccuacaguacauuuuuacuauccagucaaacaaucuuucucucuuaaccagaacuuuuagagccuuacagguguaaaugguuuaaauccgccugucacagauuuggcaagugguuuggcaacccccuuuaagcuaguuccuguucuuucgacauaucccugucacuguuugguaccuccuuugugaaacaaccagauauuccaagcccaucuuguacuuugucugaccagccauuauuuccaaggauuccuaguuccuuuuaauggggaaugguuuguagaaauggaaaaucuaguuccuaccaccgaagugguauuuugucuaggccuuuuuggcaaacaggguaggaaauauauguauauguccgucuguaaaaaucauguauaugcguguauguaaaaaucaucaaaggagggccuuaagaaaaacuaaacacacacacauacauacacacaaacauacagacaaaaucguaaguucauacugauaacuuuaguuccaaugcaacacucaguauaaaauacuaagguggcagguagcuuucaacacuuagaauauaucacacccaguggccucuaguuuccgucuuugcuguugagaauucagcuuuuuaaaauguugcuccucugaagguauucuguuuuuuuaagauuuuuaccuuguaguuuuaucaggucuaauauuacaucuagguguggaguucucuuuuuaauacugugcacaguuuguuaggcuucuuaagucuaugaauugaccuuaucaguugugaaaaauucucagcuuugcggggggauccccucucaccaaucauagguuuagcauuaaaauauguaacaauagccauuauuucuucacauacuuccucugccucauucuuuuucucuguuucuucuggaaaugcaaucaaauauauuuuagaacuucucaugguagcuuucauauaucucaaccacuucucuugcuaucuuucucgccaugcugcacucuggauaguuucuucugaccgauagucuuuuauuugaaaauacugagcauauuauuucugauaauucugacaucucaagucuuugcaggucauuuucugcuuucucuugcuuuucuugguucuuguucaugauuccuuguuucucugugcuguugacuuugaguguuuauuggggauuguucaugagaaaucgcacuuuggauuucuuaaggccuggguugaaguguuuuuccccaaaggaauuugcauuugccacuuuuaaagcaucagaucuugcaagaacucaguauccugagaacagcauggggggagccaccccuaugauccagucaccucccaccaggucccucccuccaugugggauuauaauuugagaugagauuuggguggaggcacaaaggcaaaccauaucagcaguaaacuauauuuuuagauuaaaaaaauucuuuaaagggggaacaaagagaaaacuacccagcaaugaaauaggcuguacaacauaaauaugcaaguuauuuuaauaauaaaaaaacuggaugacguagcucaugccuguaauccugacaacuccugaggucaagccaggcagaucacuugaggccaggauuucuagaccagccugggcaacacagcaagacccuucaucucuaaaaaaaaaguuuaaaaauuagccagguguaguggccugugccuguagucccagcuacuugggaccugaggugggaggaucacuggagcccagaaauucaaggcugcagugaacuaugccuaugccauuguacuucaaccugggugacagagcaaaacuccaacacucaguaaaaaaaugaaaaaaagaauaaauguaaacaaccuauauacagaaaaaaauguucauucucacuguuaaguaaauaaacauaaaugugcuaccauuuuucaccuaucauauucacuaaguuuuuaaauuugcuuacuuaaagcuuagguaaguacagugagaugggauaugcucuuguucuguuaguggggauguaaaaugauaugacuuucuucuagaaaaacaguaacauguuauaaaauagugugugggaaaaccuuaaauauucauacauuuagucagggguuggcaaacuacagcccaauuuggccuguagccuauuuuuguauggcccuaccacuacaaguauuucuuacauucuuaaaggguaauggggaaaaacacaaauaagaauauaugcuagacacuguaagugggacacaaagccucaacuauuugccaucuguccuguuacauaauuaauccacuauuaccuauguuuauuagauuaauuauacuucuagaagucugucagaggcaaauaaucagauaugggcggacuaaagacugaugaaauggacagacauacucagcaagaacuuagagugaacuuauauuucuaacaguaauggaguggacagucauaagacauucauacaguaaaacuauuuucuagaaauaaugaaauagagaaauguuccuaaugaaguauaagauguaaaacuguauauggaauauacuguacaucaaggaaagacugcaaggagauaaauauucaagugcuuacucugaauguuagacuuauaggugauuuuuuaauuuuuuaaugcuuuuucauguuaucucagcuuccuaguuuugaucuuauaaucaaagaaaaaaacauaucuuugcuccuucuguuauggccacuaaaagaauaugaagaaagcugcgugugguguugcaugccuguagucccagcuauuugggagacugaggcaagaggauugcuugagcccaggaauucuaauccagcuuggguaauauaacaagacacugucucuaaaaaaaaaguuaaauaauuaaaaauuaaaaaagaaaaaaagaacgaagagacaugagaguugagaaaauaaagaacccuuugaggaaugugucucuguuauucaucuucauauauauccagugccagacauuagcuaggugcuugguaaacauuuguuuaaagaaugggcaacuaggucgugaauaugaaaaacugcucagccucaaagagaugcaaauucaaauuauauauaauuuuccccauaucaaauuagcaaauauuuuguuuaauaaaaauucuuguuguguuuuuuuuuuaaguuggauuuuuuuggagauauaauugacauauaauaaaauucacccuuuuuacaaauguacaguuugaugcauuuugaaaacuggauaauuguguaaccauggccacuaucaagacagggaaucuucccauuuccaucaccccaaaauguccccuuguacuccauucucuccucuuacuccuaauaccaugcugucacuacuuuggauucuguuacuauaguuuucccuuuucuagaaugucauauaaauagaaucauacaguaugcugcuuuuugucucuggcuuucuuagcauaacacuuuugagauucaucauuuuguugcauguacuguugugguggucuuuuuuuauuguugacuaguuuuccauuugauauauuacauuuuguuuauccauucacugguugguggacguuuggguuauucccaaauuauuaugauuaagaauaaaguugcauuaaauaugaguauaaaucuuuguguggcugcaaauuuccauuuauccugcguaaauacguaccuaacagaauugcugggucacauauggugaguguaucuauaacuuagaaacuggcaagguguuuuccaaagugacuguacuauugcauucccacaauuuaauauaagaugcugaaauaaguacuuauugcaauugugagugaaaacuuauaacucuuugggaaagcauuuuuggcauucugaaucaggucaguaaaaauguuuauucucuggccuucaagaaacaucuuuguaagggauaaucuaaaauaugcacaaggauauuugucaaaguaccauuguauuagaagacuaaaaauauacacuccagcuguugucuuugguaaaauuuauaaauucagcacuaaguuaggcauugugguggguucaaaagcaacuuaagauguguuccuugacuuacauaacuuguaaucuagugagaaaacugugcuaauugccugaaaaauuuucacugagcaaugcaacacagcauuaaaugaguguuaaaauaugccacauuaagaagaaugagcaguagggaugaagacuuggauggauuucagcaagguuuugaagcacggcuaaagcuugaguuggaggguuggagcuuucuagguggaacacaccaugacuagagguaaaaauggucuaaguauguaaaaaucauuggaauauauguauguauguagagauaauaaaacuauguuauuggaggcucuuaauggaacaggaacagcauaaucuuuaaaagcuggaaagacucugcugugaggcucugcauucuuauaaaagcuuuggguagucuaggaaacagcagugcucaggaaaugguagaaaacaaucauuuuuacugguacuaauauaacaaauuucagcuugauagaguaguuugauaaggaaccauuguuaucuuuuguaaguagcacuaacauauacauuauauucauggucauuuuuucuagucguuuauguaggauacagaaaggagagagaaagaaaaacuuuuuuacccugugauccacagaauguuaagccucuugguagcagaaccuuugucuuguuauuaaauacuucugucuuccaugauuagcacauuguauggggaguaggaguagagagcugguugcaggauuuauaauuaacccaaugaaagguaaagagaagauugucuagauuagccugagguauauauaacuguguuaagugauaaugguuccuggaugagguugauggauugggcaaaaugauagauugaaagauuugaaaaucaugcuuuaaaucauaugugcauuucuugaauguauagaaugagcaaauaguaaagggaggaugucauauaaacaguguaauaccugccauuuacuuagugccuuguuuaugacagguguaauacauauuaucucacauuaaagucauacuacagggcacacacgguggcucacgccuguaaucgcaacacuuugggaggccaaggcugguggaucacuugaggucaggaguucaagaccagccuggccaacauggugaaacgcugucucuacuaaaaauauaaaaauuagccuggcguggcgacagguuccuguaaucucagcuauucaggaggcugaggcaggaaaaucacuugaaccugggagguggagguugcaguaagcccagaucaugccacugcaccccacccuuccugggcaacagagugagauugucucaaaaaaaaaaaaagucauauuguagaugaaguggaguuauugaauugcccacagacacacaauuauuagauguuagagcugggauaugaacagugcacuuaaaaaaauaaaagccagcucuaauguuacuucuuccuuucaggaaaccuuccauauaacuccuguccaccuuuuacuaccuagguuaacuugaggcuccuccuuuguuuucauaugauauacaguugguaacugcaguuuugcauuugcuuauggaauuauaauugcagaauacauuuggaauuugaggacuuagcauucucugauucaucuacuccuucaguaacuugcaaguuaaaggugaaggcccauggugugaaucacagugcaaggcagguaugccagagggacucacuccucaugaguguaggcccaacucuugagauacuaggccaaauuuucagaggucugggcauuuucagcaaaugcccagacuuuuuauguuugucucauccaguaccuaacuuacucaacuuggaauucaguguaacacagcuaugaguguauguuuauauucaaguaauucauaguaucuuuaaaccauagguccucugcuguaccacuuugaaaaucuggcaaaugaacuuuccauagaauugagcuaugaggauauaaaaaacguuguucugcaguauggauucaagguagagguaagaauggaauaaaauauugccaaaguuuaacucccaaagcaccucaacagaaguguugauaucauggcuguuagugacuauuugaauucucuguuuucuuaucuauaaagggaagauaauacagguugaguauccccuauucaaaaugcuugggaccagaaauguuugggauuuuggauuuuuuuccaauuuugcaauauaugcauauacgugacauaucuugggaggggacugaagucuaaaugugaaauucauuuauguuuuauauaugccuuauaagcauagcccgaagguaauuugauacaauauuuuaaaauuuugaccaccugccacaugaagucagauguggaauuugucacuuguggcauuauguaggcgcucaaaacauuuuggauuuugaagcguuucagauuuucagauuagggaugcuugaccuguguuccuuaguuuucagaauuauaaggauuugggauaauguguacauaaagggaaaacuacuuucuggugaaauagccuuucaauaaaugguagccgaucauuauaauacugaucuuacagacucucacugauagaaaguagaguaggcucuggggaaaacaaaagggggucggagggcagguguaagagggauauucacaauauguccuuguguacugcuucaucuuuuuuuaaucaugugcauuacuauaaaguuuugugauauuuuggcuauuguguuucaguucauuuauuuagaagcauuccauuuuagaaacaauagguuuguuuuuaagaaugacgagaagcaacauauuauaguaguucagagcucaagacugccugaguuugaaucucaguuccaccacuuacuagugugacuguucuuuguaaagugagacuacuaauauuaauaguaccucucuuauggggguaguuguauguaauaaaugaauaugcuuaaaauagugccugccacugauacauaugugcucagaauuuguuagugguguggucaugaugacugucauaguauuaugauuauuguuugcauugcagguggaaaaagaaucuguauugucaacauauacugugaaugaucucucuaugaugaaauacuacuaugaaugugucuuguuugugguccguaagccacaauaauggucucaagugauaccaccuggaaaaaaguuuaguaagaacaaaugcugaaaucaacgacucaaaaucaacuaucagugaugacaggacacaaccucaaaucaguggugccuucuuauuccuaacgaaauuuagaaauagugucuauuuucuuaauaugucuauugcuuuuucagaaauauacuaugccaugcagauuuguacuacacaaguaaaaauggaggaaaugucuugaaguauacuuuuuccuugaagcccagaauuguguuucaguaggaaaaaaaccuaaucuccagugucuucaugaugcuguccauugcaagucugccgaauuaaugacuaauaguauugaaguacauaauaaucuuccuuuuuuuguuguuuuguaugcauugcacauguaacuuuuagaagagucuaaggauccucagucauauucaacaucuggaguugggacuuuguucacuuucaaucuaagaaaacuaugcguaaaauaugucuuuuuuuuuuuuuuucuucagagacaggaucccgcucugucucccaggccggagugcaguggcacgaucauagcucacuguaaccucaaacuccuggacucaagcgaucuuccugccuuagccuuagccuccugaguagcuaggacuguaggcauguaccaccgcgccuggccugugucuauuuuaucauucagauuaauuuaauuuuguauuuucuggcucagaugaacuuaaagaagcaucaaacauuucuuuuuuaugaaauguuaaauuuaauagcaucacaggccgguaaaauauauucaaguaacagaaauaucaaagucuuuuggccacaauaaacugaacacuuuaugaaagcauacucaucauggaucacuuugaaauauacgagaucucaacauucaaagugagaaauaaaaagccuuuauuaaaaguagugcuaggaaacagagaaaauaagaauaaaauuuacccauuugaaauaugugauuuucagacucuaaaugaauacagaguuugacagugugauguuuacaauaaugucuuuucuuuagaauaucuggauuaugaaagcaagcacuuuuuucauuaaaaaaauuauauacuaggaaaaacugucauaauaguauuaauguggggaauuuugauuaugaaauucagggauauauuacugcccguggucugugucuucaauauuguaagcagcagccaucauguaauuucagauuaauaccaauuuuguucccugauagauggagcuuaaacaguauaugcugcuuuaaauuucuaccucuagcagaucuuuauuggagggaguuuuccuuuguauuuuuuaauguaugauauucuguuuccaguagcuuggaaaguagagaugacuaauguuuuagccuuuucuuggagaaaaggaagaacucuucuugaauauuuucacagaugauugugauugcuuuaaaugaccucuguggcaauuuaaauuagauggauuuaaucucaguaaugugcuggucgcauaaaugucauguuuuaauaggaaaaguuacuuguaaaucuuuagaccuuuguugucacuuaggcuggggagucacuacccuauuuggcaucuuacuaguuggggggaccuuuuccguguacagugaugggacuuuugugaccuuuacucucacuaugcaauagaggguuucauguaguuaaucugacaugucaaaauugggaagacuguaaccuuuuuuuuuuuuuuuuaagauuucucuuuuuugugucccucaauacuuagcagauguucauuugguggaaauucuuauuacuuacaugaaugaguuugaauuuaguggcaaggaagaaaaaaaaaacucaaauuauuguuuuaaaagaagaaaacuugcaaaguacauaaguauuuuuuaaaaaucaaucgaacagaaaggaaugcaugcuguuuuucaauggcuuagacaugcuuuuuauucacugacuaguauucacuuuuuuacaacuuguaucaaaacaaaugaucuuuguuuuugucacaggcaaaaacagguugacacugguggguuggcuuuauuaauuaauuuuuuuucuauuagguuuucuuuaauaauguuaaauuucuaaauuauagcauauguuuuaguuaauucugaaaucaguuacuucauuuguuaauuuaucccucauaucaugaauauuguuuuuuaaauguucuauacaaauuugcaucacuucuuuucuuacagcuuuugcaguuaauauauucuaaacuugaaaaugugguaucaaucaauaauagaaguaucacugg

SEQ ID NO: 16064 - RNA, 121816 nt, Homo sapiens
accuucucaggcguuucguaaccgaguaaacugagagcugggaacagcccucuauuaaguagcccgcggcgcggagucucuuuccacuuggcuaaggcgaaccgccccagacgcguccgcgcgccggcagcugcaggcucaggccaucuccagucuuccugccgcgcccgccucuccuccugggauucuccuccuccuccuggacuuccccgcagcugcccacgccucggcggccgccaggugcuccuggagugcagcgccuaucgccggggcgugugggggccacaccgagcaccagcuucuccgacgccgggaagccgcugucgccgccgcuaccucucccuguugccgccgccucaggucagccugguuucuguccccuuuccccuacccccaucauucccagagacaacucgggaaacggcgucuagcuugcaccuugcccggagcggugaagaauccugggcgaggacaguuuggacuuguaauaguguaggugggcuagagcguugccuuguauacugggauuuggugauucuuugggguuuuugagggagaggggaauguugcuuuucuuaagagcugagcaagguuuugugcacgcaaagcaucccguucaguguuuccguuucuagaggaguuucaucuguagaugcugucgauuucaauggagggcgcgccggguucuggggcagcagggcccugguuaucucgcggcuguggcuuugucggggagggcaggcgugcggcgggggcgcugggaagguauuuuggugacgcacggugcggaauucuuuggagggcccgcugagugcucugcagcucgucgaggcugcacggguguguguggcaucucguaacagauuccuaguggaguguucuggcuccuuccuccccuaccuuucagagcauccgagaugguggguuaggcagcacuaggguacucauucuuggcggacuuuucccagcuccgggagaaaguccccucuccgacucccucccggugcauugguggaggcccuauucggggucugugagaucuccgcggcgguuucccacucagauccuagacuuguggggaucagaaagcgugggucgccggacucguucagcgagcggaacagguacccccaagcgggcgaccucgggagcccuucagugaccaguucagggcucccugggacucugggccagggagacucucgauccggacucuguagucuucuagugaaugcuggggaaggauagggcaggaaaggaaauaaacgcuaagcucuccuuuggcuaaugccaaggucguggugggugggagaggagguaggcgacgcgcacgcggugugugugugugugugugauuuucuuuuuaacuggacgcgggaguuaaggaauuggguucuuccagcagggaauugggagggggcgaguuggcagaaggggacgaguccacuuagcccccacucccaccccaguggacucauuuuuauucaugagggugaagugagggaguccucgcugccacguaggggcggccgcuuucagauauuuaugucugagaaugcucaaugaaguguugcuaagcauucaaaugaauguuuuggcuaaaaaggagagaaagcauuuucuuuuuuaaaacauauauugacgggaugcuuggcuggcuggcguuccgauaucccggcgcgagaugauucauucuugcagcuaagucgggaaagcgacagguggcgaucgagacccagcaaaaguguuaccacucagguuuucguugaguucagcuguuaaaaaaaaaucugcgcacagcuuuucggugggucgauuguucgccuuuaacuucucgcgagcacgacugccaacugaguuggaaauuauuauaccaaaguuaaggcaagaugauuggaacaaugggccagucucaccucuugcuuuucacugauguagaagaggguuagaaaugucaaacaguuguuaauuaggaagaaagaaauugcuagaccccuuagauacuuagggcagugccaaaauuuuaaucuuggcuucauaaaaaggagcuccaggcaauuuggcacgccugcucaucagacauuuaaaaugcaauuuacacacaggcugaggaaagcugcccucaugcuuugugccaauaauuuggaaagucaucguuggagauugucaguuucuuuucucaaagaggccucgaccuuuggcucauuuuugcauuccgacgcaggacagucuccuaucccccuccauuuuuccugaggccuaggcuguuggcuuacaauaaauuauguacuucagagucaacucuuuuuauguuuugccacuggcaacuucccaguucaguuccuugcuaguagcuuuugucuuuggguugaacccuagacuauuuuaggagauuccauucuguagacauggguuaaguaccuacugugugcugggaaaccacaaagaugaauaagauucuuugucuuuaaggaauucauaauguaauuacaaaauuagaaaaaaucggaacagaacauauucuccucugggguauguauacuaauaaucuuccagcuuaaauaaacaguuaaauacaaagauuauuauugauaauuuuuauuuaaaaacacguuggaaaaacagacaagggugucuugcuucuuccauuuugcugccuuauuuguuauuauguauuuuggaguuguuuuucccucaucucagguaaaggauuuaucagaugugaaaacaacacaguuagcaggagggucagguuucagcugggccuuacauauuucuguauaauccauuucagaucuuaaagagcugcauauuugaaagcagaacaaaaugaagaaaaaagagaauuaaaaagguuuauuauacuuuuccaaauuacccugagaccacuaaaguacaguuaccuaaagaguucaucagcuaggaaaaaagcagucaaauaaaauccccagcuggaagagauauuuaguugagugagggauaaaaugaccucugaauuagccauuacccaggcaggaugaagucaugugagggcugguaaaggccuucacccgggaugcuaagcaggaccagucuccaggagaacaggacccuuuuuaaacuugaacuuccuccuagggccaugauuaaacuucuguagacgaacuugacuuccacugcuucacaauaggcccauuaugugcuggaguaggcccugugguuuuuaaggcagaucuggucggguucuggacuagguccaggcuccaguucuaaccugguucaaggccugcccagacccaguucugaugcagucacuacuuccucccgcagaucucuucaugccgcuguaagcucggaggccaaggaugcggaguaggcuucccccagcgcuugccgcccugggcgcggcccugcuccugucuuccauugaggcagaagguaaaaggcucccuuccccuucaccgagugacaaugcaaaauucgagaaaggaaaaaacacaucuuucuugcuucuauugcuugcucuguuuucccugcgcuucgugcuuucuccggugguuucucuccuucagagaaacgccccuuucuccugagguuuguccauuucccagcucucagguccagcucuuucguauucugcuuaaugcauuccguacagugcuguguggucuucuugagcuugucucugcggugugcuguccacacugccaccugcacugccgccuaauaagaggaccagccgcccgagagggggcgacggcucuaaucagcgcaaccaacaggacaccuccggguggcacccaggagccccgaagagcgggcgcacucgcucgcuuggcugguaaccaaccaccuggcucggggcugcgaccucggugacagaacacaauaaaagacuccaacagcgcuggcucugcgccucugugugcuuuguggggagcucagucggcggggcggacggugcgggcagaugagccagcagccaagcagccugggggaugauggcaggcaagcggagauccgggaccccagguguucgcacgaccuagggucgcggcugucccuguugguuagcagggcuccaaggcgcguggccuggacugguccagcucagacagguugagccugggccaagguuuccagccugggaagcaagcgcgcgccggaguugcugggcaccaccuccaguguccugcccuugcuccauccugccucccucagggacagccgggugcgucggaccuucccgcggaggcaguggggcgcuccgagauggguuuccaaaacggcgccguguggccccuccucuagaaaauggagggcuuuuguuagaugucccacccaauuuuauuuguugugugcacuugaugucuuaauuucucaguguucauuaaacaagccauuucaauaugucaaccccauggcggcuucuguggccccucaguugucacuggagaccugacaaauuaguuuucuuauucugcaaagaaaaugggguaaugucaugaaagauaucuuuuuuuuuuuucaguaaagaaauaccccugaugaaguuaagggaggaaaaaaaacacuucugccaagugacagcuguggaaguucuggguugaggugugcuuuuuuagaggcugugagaaaguaugguuguuugcaugauuaugccaagguuuucaagguuucuauaguguuggauuuucuacuucaagacuacagguaaaaaaaaaauuaggggaagcagaguguuuccaaaauguauggcauguuaagaaaagugacagaaacuugcugacuuuucuuagcugaugaauauuuuaugaauguagaggcuuuucagaguggccucugugaaguaauagucagaugaaguugcuuuuaauguuccuuucuaugucguuguuaggaaggaauuuuauuugaggaacuucuggaggcccuacuacagauauuuuuagauaauucacugaaguggcccauuuauugcucauuaagaaaauaguuauuugaaaaucagaaagaguugagaauucuuagaaaaagaguuaggcuggaaaugauguaaguggaaaaaauugauucugaauuagauauuggcugguuagcaaagugcaguuagaaagaacagcuuacuaucuacauuucugauuauucccauauuauauuuuaucuuuuaaauuuguauuuauuuccauaugguacagcucuuuuuuuuuuugcuucuuaaucugugucuuuucuuguaucccaucuccuuaaguuaguauuuaauaauuauauuuuaauaggauucauuuuuuggccuuauucucuaguuuggcauugucaaauagaaauaugguaugagccacaaauguaagccacauauguaaccuacauuuuuuucugguagccauauucaaaauggaaaaagaaacaggauaaauuaaauuuuauaauguauuuuauuuaaccuaaauuauuucaucauggagccaauaugaaaauuauuagugagauacuugacuuuuuuuguacuaagucuuugacaauuggguguguauuuuauacuuacagugcaauuuauucuuuaaguuauuuuuauuuuuccugagacagagucucgcucuguugcccaggcuggaguguaguggcuugaucucggcucacugcagccuccgccuccuggguucaagugauucccaugccuuaaccuccugaguagcugguacuacagggguuugccaccaugccuggcuaauuuuuguauuuuuaguagagacgggguuucaccauguuggccaggcuggucucgaaccccuggccucaauugauucaccugccucggccucccaaagugcugggauuacaggcagcacaguuuauuucguacuggccacauuuuaagagcuugcuagccacagaugucugguugcuuccgugucggacagcacagcucugcuguugacuacuaaguggugcuaggggccuuugaagggcuaacaaaauuuggggccaaagccuuucuggggucacugggcuggaaccagaauuucuuugaaauauuucuguugggggcauuucaaaauuucaacuugggacuccauuugguaccaugccauuuugaucugaguccuaaaguagccacaguuacguuucuuuuccuuucaugacucacacuugcacucuuauauucauacuauuuuauuaccauuuucuaugaccuuaauguuuuauauauuaaaaacccaauaccuuuuugaaaacauuaaaauguuuugguauucacuuuuugccuuucuucuuuuuuauagugguaauauuuuugucuuguuuuucuucugcuuauuuguauuaggagcuauauuuuucauacuauguuaucuuguccuauagaaauaagaguggaaaugauuuuuucacuucaguaucuauaauuuuuagccacugcagagacuuuaucaaccgcaucacugcauagacuuuaucaacuguaucugaguggccuagaauguaugaauuauuuuugguucauguaugauacaguauguuaauuauccuguagaaaacuuaacacuuugcauauaaagauuaauggucaguauucccugagaacugggcacuuuucuaauuaaucuaggauuagagaugaauacaaguuuucugaaaaacagaguguuaauuuugguuagucugauuuauaguuuauaauauauaaugaacaauugaauauuaucaauucaucggugaguuguggcuauagcuuugucuugugucuagguugagacuaauuuguauauauuuuuauaauccuaugucuaauuuguguuauaacagaaauuucaaacuagaggcuaacauagagaucaucuauucuacuucucucguuuuccaaaugagaaaaugaggcccagagaggcugaaucacuuggucaacuaaugcacuuacuuagauaugaaaaacagacaagaccccagucuucuaguccuagguuagugcugguuuggucacacugugcuuuguuugugcuugacaacugguugauccggaaaguuuaaugagagggcauguuuuguaauguguacaaaauaaucuguagcuuauucuaaaauauuauuuuuucaacugauuauuuaugguaccuugaaaacucaaaugaaauggauuucuauaucauggcaaagauaauuaaaguuaugcuaauuuugcauggcaaauguaaauuaaugccuauagaauauaguuaacucaucacuuauugcacacuugucaagauuucuccuauuaagguaguauccuuuccaguguuguuaucacagauaucaaacuaaagaucuuaguaguucaucaagauauuuuaguaguguauucuuaguuuugauauaucuauagcgcauuauguauacuuaccaaaacuuauuagacuccucuacucccucucauccauuuucccaccugucuauccauccuucccuucauucaucucugcaguggccgguaauuucuuggacauagccccuuuuugggugcccuauuaaaaauguuucaaaaaguuauauaucaagauggacacuuuaguuuuaaaugcuugaacaaguguauaaaguuaauauaccaaauuucaucuauaucugaauuggagauaccugaauaccacauauuuauguauauauguauaauaauauguaauauguaauaacaauauuacauauguaauacauauguaauauguauaauauaugcacauauaauuauacauguauguauauauaaaucagcuacauauaaauauugcuuauauuuacaaauauagguauauauuaaaaauacguauauauuaaacccauuuaugccuaguguuccacuauuggaaugcuaagcaugugggagugauuuauauccuacugcucaaggucauugccaaggucugauuacaaaaauucaaaaaauugcaaccucagguauaaauggguuaaaaguaacuacauauaaauauuguuuucuaaaguuaauuuuugauggaaauauuucuucuacuuugcauuuaaucuaguacaguagaaaacuguauguuuuguagucagaccauguaauccaaguguuguugccuauuggcuguguuaaucucucugaauuucacugauuuaucuguaaagcagggauaauaaggcccaucauuggguucuuauaaggaaaaaagcagcaacacaguaaccagcucucugccuguuauagagaacacucagcaaguuucagcuauuauuaucauucccaaaauguccuaaauccugccaguuuauguaacaaaaauuucaucagaaugagucuucguagcauagcguuuugauaacaaaaaacauuaucuguaaauaugaaauuaaacuauaagaauaaaaauacuuaaaauuuuagucucuuuacugucaguauucagguuuuuugaauauauguaagauuguuauuuauuuguaauuuucauucuguuucucuugguuuggauucucauccuaugcaacuauggcucuuugcaguuauaaucaauaugcagcuagugcauaauugaaaauuuccgggcugggcacaguggcuuauuccuacaaucccagcacugugggaggcugaggagggcggaucaccugaggucaggacuucaagagcagccugaccaacauggagaaaccccgucucuacuaaaaauacaaaauuagccaggcaugguggagcacgccuguaauccuugcuacucaggaggcugaggcaggagaaucgcuugaaccuaggaggcugagguugcagugagccaaguucguaccacugcacuccagccugggcaacaagagcgaaacuccgucucaaaaaaaaaaaaaaaagaaaagaaaagaaaauuuccagcaucagcauugucuuagggaacacuuagacucugugaugaugugaugguguuuaugaauuauuuuuauguaaaagaaaauauuuuuaaaauuaauaaaguacauuuuucagcacugauuuauguugacacgggucauacacuuacaucugcuuuauuauuauuuuuucaugaaacaaacaaauguacaaauagaauggcaugccugaaaagcuguacaugcaauaaaaucggccagaagaaaagugaagcgggcucucuguuguacccaugcggguuggccauucuuuucuacuuugauucucacauaucacaguuucuaugaacaccucaagauccucugaaauguuaaagacuuuuccccacagucaauuuuucaguuuaucuggaauccuggucauuuggauaucaacaaggggggcugcuacugcccuucagcaguuuuaaccuaauguccgcugcuucaggucauuuuccuuccaagguuggugguacuguuuuuccauguacugauuuuuuuuaaaagcaugcucaggccagugugucugccuuugcauuaaauuuguccugagccauugcuacuggaacaauauuuuauaaugauauucuuaauacccguuguccuauuaacaucuguugcaugcauguuauacugagugaugaguacagcuaaaccucaaaauaugauuaaagacugaagaauguugaguaauuaaacuaugcauguagauuaauagucuaaucucacugccuguguauggauaguaagaauauaacauucauuccaauacuaguguauccaauaaaaauaaaaagccaucuccuacaguuggacgcagcaguccacuaaagcaaauguuugcuuaauuauuuccauuaaaacauauuauuaauauuacauaaaucuuuaaccccaguuaaauucugugacucaugucucaaagcugcuaguguauuuuaauugaccuuugaaaaaaccugaaaggaaauuguaaucucucaaaacagaugcaaaaauucugacucacaaggaauacuuucagacuaaaacauuuuaagaagaguguggcugaaagucaucuuaauuuguugaccuguuucaagaguaauaauuuuuaauucaucaaccaugcacugacagugagucaguacaaugcugcaugaugaggcaugaacauuguagagagaauaucauuauaaaauauuuaggaaacgucuuuguguaaugacuacuguacauggaggcuuuuguucauugugggaaacuaaaaacaagucaacauuucauugacacaugcaugaugcucuacaguuuuguauguaaacuauuucuguacuuuucaguuauuccugucauugacuuuuccaaguuuuuaugcgcagucaugucuucagaucacugauccuucuucacuguuuucuuuaaguucuguaaauaaauguccauaaauauacauugauguugucuuuucauaauuaaccauuguuuuguaaaggaccauacuggcauuuuaaucuaaaaugcccuuucuaguauggaguauaccugcugcaaaggaaauaauaguguugguuuacacccuggaacauucagcaagcugguguaaacaggcagaauauuaguuuaauaaacuuuugaauaucgcuauuuauauauuuauaaauuaacaucacuuauuuuugaauacuugccuaugaauaugaauauacauuuaaauguauauuuccuugucagauauaacuuucccaugauuccuuauuuucauuaaaauauauuuuucaucucugcuacauauugagauuuaucaaauaacaaugaauaauuacaaggcaaauaaugcagagaaugaaccaaaaccaucauuguuucuuguccauauugugggaaaaaacauauuaugucaauguuuugaauuaacuucucugguuguaagcagguugugauuuggcaugcuuguucaaaaugcacucagcauguaucgaaauuccuuuaauuguuaugugaauuguuugcauaugugguuauuauaugugauuucauuguacuuguauguacuuguauccaaauauguuucuauuaugcuugauuuugcuggccauucuugaaugaccuagcaacucaagaaucaaaaguguuuugugcugucuucuguaauauguacacucucugauguuuugucagcuuuuaguuuuauucuuauccaacaacauaucuuuuauauuuguuggaaacaaauuuaugcaaagacaauuuuagaaagcuuugcucaacacaauucuuuauuaauuaaauugaccauuuugugacauugaaaaguuuaauaauauaaacucucucuuuugcaguugacccaccuucagacuugaauuuuaaaauuauagaugaaaauacuguucauaugucaugggcaaaaccaguugauccaauuguggguuacagaauaacgguggacccuacaacggguaaguuuugagacugggguuuuaggacagaagcaucaugaugauauaacucaaucuccaccucuucuccccuuucaucaugaagaagcugugcuuuaggaagccugagggauuugauccaugucaccagacauuugcugaacucagguuucagauuuccagucuaguguccacuauuauauuuuaauguuauugaguuuaacauguuuugcugugguagguuguuauuauuaaaaauugacucuauuuuuaccugaucagaauauuguuaguaaccuuugaucuuauagaaucaaauccucauucuuuggcauucuucuugaauuacuuaauauuuucaacauuuaaaguaucagcugaugaaguaaguuguuacaccuuacccaguguccuacacauuucaguauccaggaaacaccauucugugauaaugguaaacaaccaugaugacagauaagaauuuacuuuggcuagguggauuccaucgacacuaggcugaauccuuggaaaacuaaacaaaacuuguuuugcuuguucucaggcauuaucuuuaguguuaauaauguugccaaaauguggagaaccaaacucuauugauuaauuuuuaguucuaaaauggaaugagaaaauaaccauuuccacugacuguaaacuaguucaaccauuguggaagacaguguggcgauuccuuaaggaucuagaacuagaaauaucauuugacccagccaucccauuucuggguauauacccaaaggauuauaaaucaugcugcuauaaagacacaugcacacguauguucauuguggcacuuauucacaauagcaaagacuuggaaccaacccaaauguccaucgaugauagacuggauuaagaaaauguggcacauauaugccauggaauacuaugcagccauaaaaaaggaugaguucaugucauuuauagggacauggaugaagcuggaaaccaucauucuuagcaaacuguugcaaagacaaaaaaccaaacaccgcauguucucacucauaggugggaauugaacaaugagaacacuuggacacaggaaggggaacaucacacacuggggccugucaugggguguggggaggggggagggauagcauuaggagauauaccuaauguaaagaguuaaugggugcagcacaccaacauggcacauguauacauacguaacaaaccugcacguugugcacacguacucuagaacuuaaaguauaauuuaaaaaauaguaaaaaaaacaaagaaagaaaauaacuacuuccacuaacauuggcuaaaugguaggaagaagucuugacuggcugacaguagagauggaagaugucaacacaacuuauuacuagaacuguguuuauuuaucuuuuagccuuuaaaaauaccaaugauuuuacauauugauuuaccaggaaacguagcuuuuuuuaaaaagaugauuuaaaaacuuaaaaagggguaaaaaauuuacuuuuuucucuuucaaucuuuucuccccaaauauauuugcaguuaacauauucauuccaaaucagaaaaucaguucuaacaggguccauccaguuucuagauguugggaauaacugacaccuaacacuuccaaaacuggcacuggggcuacccaaccuggcagagucugagugucuugauguccucuggggaucuugguugguuuugcauguucuaccugcaaaccaagagcauuuuucaguggucuguugcaccuguuaucuuuccuaauuauuuauauuuugaugaaaacaauauaauuaaaaauaucaggcacguaauucccaggaaccaccagguuuccugauugaauugagaauuaacagaaucuagaagggaguacauaacugccaaaauauaaguaaacaccuaguauacuggaccuugaaauauuugauaccugcuuaagucaaugcagaggucaauguuacccauuaaggcauguagccauuugaguauggaauaugcacugcuuccacacagauuuuuucccacuagggguuggucuuaaccuaugggguuuguuuucuuugaguuuauuuucaucucuuauuucucucucucugcucuccuccaaugcauaauuuaaaauuaaauucauuuucucugcuuuaucucucauuuauaaaacuguuaucuaccauuagucuccaaaaccaaugaaagauuuuuaguucgauauucugguauaccuuuaaacuagaaaugucuugaauucucaaacaaguauuaaauaugauuguaacaaauaaaagcaauaccaguccauuuauuaaauuucuaaaauucaaaauuuuaguuuuggaaggcaguaaaaaauaauguuugaguguccugaaaaaauguauauacugaauuuuucagauuuugaguaccucugggaauuacaauguauuguguuauaugugaaaaauguuuuguugcauucauauuuuuccuuuuuauauuuccagaugggccuacuaaagaauuuacccuuucagcuaguaccacugaaacuuuauugucagaacuuguaccugaaacagaguauguggugacaauaacuucauaugaugaaguagaagaaaguguaccaguuauaggacaacuaacaaguaagcacacauauaaaauaaaauauuuguauaauuuuuauuuugcagaagguuuuuccaacuucagauuuaaucuuuuaugauacaaaguuaauuuacagcaguacuaacuauuuuuuucugguauccuaguuauuaguggacaugaauaauucauuccugauuuauaacucuggucucuggaaacagcaggaauguuaugaaugaagaccauuaaaaauguuaaacuuugcuggacaacaaugugaauaucuuuuugaaauaucucaaaaauaucacuaaaauaacuuacuuguaagggaaugauuauuuggcaguauucuaugaccagcugggcagagccauacauuuaagagacaauaacaaaaacuaauauaauauauuuauucuauuuuaaagagaauaucugcuuggguucauuuccuuuuguaauaauaaaguuuuaacuuaguucaaacagguaguucgacaaagccaguggagaagaaaccuggaaaaaccgagauacaaagugaguguuucucuuacuauuuuugcuuagauucauggaagucauaaauguaggauagaacagauguuccaauuauauacauagauugaucuuauuccuauauuaauuuauauaagcuuuaucuggaaggagcacagacaauauaagaauaauguauaacuaagucauuauaaccuaaguucugacauucuagcuaguuuuucauucuauuuacuagauauucuuuucaaugggaguguuuugaaauuguguguguccaaccuuuccugcaggauuuuggcaauaggugaaaacaaagcacaucucaggacucaacucauuucucaaagacaaacugauagcaguaggugguacuuaggaauauaugagaaauacagggcuggaacaugagagggaugcccucagcuaguguucaaaguaauacaauugccaugaaaauacuuuucuaagucuguguguauguuaugcucuucucuagguuauuuacauggccuuaguugaugguaguuguaaccuuuuugagagucucuguaacacaccucuuauaaauuggugcauuuguaaucagaugaaagcaauuuuauuuagucuagaucuugcaguuauuagccuccuuuugucuuauauugcuuuucugacuuauggggauagauccuuaagggguuucuuggacuucuaauuuugucaucucguaaaacuuggauuuaugacccagaaugacaauaaaaagauuauaaacacaaaggucucuuuaucuggaaguauccccuccagaucacuguuuaucauuauuucagaugcuaauauuuucaacaauuauuauuuauuuuaaauugagguauuaugccaaguauugacuuuuuaauaggcuuaaauucaccuauuaaauagugugcaaaacuuauuuaagcauacaacuuguauuuauuuggcuugcaaaauuuuucagcacccucuccuucucuuccuagccaaauacuucuuuuauuaccuaucagcugacugcaagaacaaaaucaucaucagaaaauucacuugguauugcauuacaaauacagauuuucauaaaaccaaccugaccuccaccauagagagaaggaaagauaacauauucaguuacaaaagcugaucauuguauuuugauaauuucaggauaccacauggauuuuuaacuuuugaauaaaaauaauuguuuacccucuuuguucacuaaaaguagguuuuaauugucaaauuuaaauauauugauaauuaggacuauauauuuuggcuauuuugcauaauuuuaugcuuguuuuuacuucuaucaggcucccuuagcccucuagacuaacccuaaugcaaacuuuagacaauuauauugaaaagugcaagaguauauuaacaaauuaggucuucaacucaacugcacuuccuugaaugguacagcaauuauuuuguauuuauuuguugauaaauaccaaggaauaaaaacccuuugcuuauauuucuuuuguaugacuccuaaauguuuuauaaaauuuguacuuguaaagaagagugaggguauaguuuauaaaaauggauagguugauagcacgaauacuuggacuuuaugcucccggagagcagauuauagaucuauuuaucucuuuuuguauaaugucuuauaaagcaauuuaaagacaucuaguuccaugaauucaucuugauaaaggcauugaaaaugcuucuauguguuguuaguaaaauuguauauuucuuugugcaugugggugaagaacaauuggugaauauguucuaaugaacagaaugauuuaaggagccaacauuuuugcaauguuaacauguauugaugaguugauuuaauaaagcaucauuuaaaaagauaucaaauguauuucagaaugcucugucagugccuggacugauuugguuuuccucguggauggcucuuggagugugggaagaaauaauuucaaguacauuuuagacuucauugcugcucuugugucugcuuuugacauuggggaagagaagacaagaguuggaguuguucaauacagcucugauaccaggacugaauuuaacuuaaaucaguacuaccaaagggaugaacuucuugcugcaauaaaaaaaauuccauauaaagguggcaacacaaugacagguauguucuacagauuuuuuuaaaguuaaaaauaaaugaaaugucuguuucagaaagaaaugaugcauugccuauuacauauuaaauauuuuugacauuguucacauaguuuuugacuuuggaaaaauuguguaguacagaguaaaugaacauguuucuuuucccuuuaggggaugccauugauuauuuaguuaaaaauacuuucacggaaucugcuggggcaagaguuggcuuuccuaaaguggcaauuauuauuacggauggaaaaucccaggaugaaguggaaauuccagcaagagagcuucguaauguuggaguugaaguuuucuccuuggguagguuaaguucaguuaauuauuuccauuuuacaacuccuacaguauacuuaauguuuaggaagaugaaagauugauuccucaaggaaggaugcuauuagaaguguuuacugcauuuuuauaguguaauauuaaagacuuaaauugucuuuaaguaaaaauucugcuuaucuauuucccucauauaacucccuuagcauauguauuuaggaaggugguauucacauucuuugccagcucucuacuuuucaaagaaugcugggccaaugauucuaauaaagauccuccuuguauuaucauuaaguguuuuuuauguguuuccuauauuauguaauacuugaagaauucagagggcuccagcuuauugaggacucuggaagaaaaaaguauuaucuuuacagauggcaaagacauacgaugguaugguugggaugaaagcccacucuguuuaaccaaccacuuuuuuccucuuuggcugaccacuauaugucaaauuacaaaauguuuuugucaucugcacaguugcaugugcaacuguuaugaaacaaagcaauucuggcuuaugacuuaaugacgauuugaauaugucuucaguugugaaagauggagaaaacgaagaacuucuccaagucaguuggcacauuucccauuucaauauguccuuauccuuuuguuuugaaggcauuaaagcugcagaugcaaaagaacucaaacaaauugccuccacaccuucacugaaccauguuuucaauguggccaacuuugaugcaauuguggauauucagaaugagaucaucucccaggugugcucagguguugaugaacaacuuggugaauugguuaguggagaagaaggugaguagacuguguagcauuccccauguguuagucuuuuccauuguuugaguauuuauaguuaucuuagaaguagacauauuuauuuaaauauuucuuccagugauucuacaauuguauacuccacuguauuguuuuuuagcaacucaacuuguugauaccauuuguauuguuuuuccuucuaguggaacauucaguaaaauguaucauugcacaguucuuaaaauuuuuuuggugggggacaaguuaugauuuacucuuuucuuuaagacucuuuuguguacauugaaugucuaucugauuaugcuauucugcuacuugcuuuaauuaccuugcacucugauuuaaacauugaugggcuggaaagacauuugcaacuuaaaauaauaacaauguuucugcuaacuagcuaaggacaaggguuuucuaucauuauacucugaguaauguuuugaaagcuuuuaagaauauuucaaagaucagucaaugugauccuccccuuagaaaauucucccauuucuauuaguuauuacuucuaaauacaugggagaaagaaaagacauuucaaaagcauccuuuugaacauuaaaaauaacaacccaaagccuuuauauuuuuccaucauuguucuccucucagcuugagaaucgauaagugauuaaacauaaauucuaaauagugacaucuucaaucauacaaacucuuuaaucuucaaucucugaacauuuugucaaaauguucauuggcccuaauucugucucagaaccucucauuacuucaugggcucucaaucuauccuuuguuuuacugucuacugucuaaccuuuuugcuuuguauuauuauaaaauccaucucacucaccuccacuuuucucugauuacuucucuucacucagucuuuuaaacaguuuaauucuuccuggggugcaguugcauguaugcaaggguaggccagacuuuuuuucugccacuguuggaacuuucccuguguagggggcuggggcuacaucacagguguucacauuucucuuuagugucuucucucuucugcuggacuaaucuaaggcuucucucuucugcuggacuagccuguacugccucuguaucccucagguuuggccagauuuccauguggcaucucuguggcuucccuccuacuauuuucuacuuaaacaucauuuuaaauauauauauauauauauauuuauuuauuuuuaaaauuauuuucauuuuuuaaaacuuuuaaguucagggguacauguacagguuuguuacauagauaaacuuguuucaugggggcuuguuguacagaucauuucaucacccagguaguaagccuaguacccauuaguuauuuuuccugauccucucccuccuccuaccuucaacccuccaauaggccccagugugugugucguuucccucuaugucuccauauguucucaucauuuagcccccacuuauaagcaagaacaugugguauuugguuuucuguuccuguguuaguuugcuaaggauaauggccucuagcucuaucauugucccugcaaaggacaugaucuuguucuuuuucauggcuguauaguauuccaugguauauauguaccacauuuuccuuauccagucuaucauugauaggguuuuagguuaauuccaaguguuugauauugugaauagugcuguagugaauauacgugugcauuuaucuuuauaauaggaugauuuauauuccuuggguauauacccaguaaugggauugcuggguuaaaugguguuucuguucuuaguucuuugaggaauugcugcacugucuuucacaaugguugaacuaauuuacacucccagcaacaguauauaagcauuccuuuuucuccacuaccucaccagcauuuguuauuuuuugacuuuuuaauaauagccauucugacuggugugagauggugucucauugugguuuugauuuguguuucucuaauaaucaguaauguugaacuuuuuuuuguaugauuguugaccacauggaugucuucuuuugaaaagugucuguuuauguccuuugcccacuuuuaaaugggguuguguguuguuuucuuguaaauuuguuuauguuccuuauagaugcuggauauuagaccuuuguuggaugcauaguuugcaaaaauuuucucccauuuuguauguugucuguuuacucuguugguaguuucuuuugccaugcagaaacucuuuaauuuaauuagaucccauuugucaauuuuuguuuuuguugcaauugcuuuuggcaucuuugucaugaaaucuuugccagggccuauguccugaaugguauugccuagguuguuuuccaggauucuuacaguuuugggucuuacauuuaagucuguaauccaucuugaguuaauuuuugucuguggucuaaggaaggaguccagauucagucuuuugcguauggcuagccaguuaucugagcaccauuuauugaauaggggguccuuuccccagugcuuguuuuugucagguuuguugaagaucagaugguuguagguguucagucucacuucuggauucucuauucuguaacauuggucuaggugucuguuucuguaccaguacuaugcuguuuugguuaccacagcccuguagcauaauuugaagucagauagccugcaccuccagcauuguucuuucugcuuaggauugccuuggauauucggauucuuuuuuguuccauaugaaauuuaaaauagguguuucuaguucugugaagaaucucaaugguaguuuaauaggaguaguggccaaucuauagauugcuuuuggcaguauggccauuuuaaugauauugauucuuucuaucuaugagcaugaaauguuuuuccauugucaucucugauuucuuugagcagugguuuguaguucuccuuguagagaucuuucaccuaacuaguuagcuguauuccuagguauuuuauucuauuauucacaacucccauugugaaugggauuucguuccugauuuagcucucagcuugacuguuguuguguauaggaaugcuggcaauuuuugcacauugauuuuauauccugagacuuugcuaaaguuguuuaucagcuuaagaagcuuuugggcugagacauugcaguuuucuagagggauuaugucaucugcaaacagggauaguuugacuuccuuucuucauauuuggaugcuuuuuauuccuuuuucuugcuugauugcucuggccagaacuuccaauacuauguugaauaggaguggugagagagggcaaccucaucuugugcugguuuucaagugaaaugcuuccagcuuuugccuauucaguauaaacaucacuuuuauguccuacaucugguugcuuuuuugaggaggcgauguguaaauuugggccuguuuuuacacacacuuccugcagguugauuugugaaaaauuauaacuauaucuuccgggaaguugauuccauugacaaauccagaauuuugauauugucugaaauaucuuaaaauacuuuacguuaacugucaaauacaugacuauguucuauguugaguaaggaucaccauuuuuuagaggacugauaugcaugcguuaauaugcauguuauaagccauuguuuccccucuguuugguggcacugugaacauaguugaacuuuuuuucuuacccugaaacuagugaaaauaaaauuguuuaaaauuauaagaaccugucauuuaagaaguacuaaaugcuuucucuuucuuggcauauuauaaaguaucuuuuaaagauuacacuuuuaugauguuauuaagagagaaaaauucccuaaagaauugaaugaagcauugauuuaacaaauauuuaucaagugccuacuuuggugcuugagaaugaagacaaugagugaauaccaaaaccagaauggaaaucuugguuucagagaagaauuaggcaugaagugucccaacauuaauuucuuccaaauacuuucuuauuccauuaacuucucagcaauuugacuaaaagccaaguguugaaccacuuuugguuugauagggacaugugaaauuggggacugaggcggguauugggcaacucuuuucaauguauuuaggaugaauuugaauaaggagauuugaagguccaaaccuaaagaccaaauuaguaagguuacaucucacuguuauuaaucacugucugcuuguaacuuuuuaguuguugagccuccuucaaauuugauugccauggaagucucuucaaaauauguuaagcuaaauuggaauccaucuccuaguccagugacuggcuacaaagucauccucacaccaaugacugcaggaagccgacagcacgcucugaguguggggccucagacaaccacgcucaguguucgcgaccucucagcagacacagaauaccagaucaguguuuccgccaugaagggaaugacauccagugaacccauuucaauaauggagaagacucagccaaugaaaguucaaguggguaagucaaugugugcaucauuguauuuggaauaugugaagaucuguuugacagaaugccuuacuuguuuggacuuaguuuugaaugaaauauuugcaauaguuuuuuuuuuaaagaagcacgcuuacuaagaaagcuagauauguauauuuuaaugauuaauauguauugaaguuuaauguacuuuuuuucucuuuacagaaugcucacgugguguggauauaaaagccgauauuguguuuuugguugauggcuccuauagcauugggauugcaaacuuuguuaaaguuagagccuuuuuggaaguucuuguaaaaaguuuugaaauuucaccaaauaggguccagauuagucuugugcaauacagccgggauccucauacugaguucacuuugaaaaaauucaccaaaguugaagauauaauugaagcaauaaacaccuucccuuacagaggaggaucuacaaauacuggcaaagcaaugacuuaugucagagagaaaauauuugugccuagcaagggaucaagaagcaaugugccaaaggucaugauucuuaucacggaugggaaaucaucagaugcuuucagagauccugcgauaaaacugaggaauucagauguugaaaucuuugcaguuggugugaaggaugccguucgcucagaauuggaagcuauugccucuccuccugcagagacccauguguucacaguggaagauuuugaugcuuuucagaggauaucuuuugaacucacacagucuaucugccuuagaauugagcaagaauuggcagcuauaaagaagaaagguuaguagacuuugagaguaaaaguuauuucuucaugaacaaagaauuuuugguucuaaaauuguggauaauaugcuuguucaauucuucuuauagacacgaaaaaguaacuuuccuauguuauugaaaacuauugaacuuaguuuucuuagcucugagauaugacuuucuccuggauauggaucauauuuuaguuggugaaaaagcuguuuaguuacaagagucaugagauguuucuguuccuagauugucaagcagguuuaggaacaaguuuuaucauauguaugugucauuuacaauccaaaucccauguaugggguguucacuaugugcuggauacugagcuggguccuucaacucaaaggugaagagaauauagucuugcaccuuuggauucuuuuuaugcauuuccuuuccugaaucauuuugggcaucauuugucacaucuggaauuuuccucauuugucugaucuacuuuucaauguguaguuaaaagucccaucccuugaguuuguguccuuuucagggacauggaugaagcuggaaaccaucauucucagcaaacuaacacaagaacagaaaaccaaacacugcauguucucacucauaugugggaguugaauaaugagaacacauggacacagggguggcggcaucacacaccgggaccuauaggaaggugggggggcugggggagggauggcauuaggaaaaauaccuaauguagaugacgaguugauggaugcagcaaaccaccauggcacauguacaccuauguaacaaaacugcacguucugcacauguaccccagaacucaaaguauuauaauaauaaaaagucccauccuuuucauuaagccuuccuaaacuguaacuguccuagcacuaucaugcuaucacuuucacucaguuggcuuuccuauguacuguuuuuuuuucuuuuuuuuuuuuuuuugagacagggucucacucugucacccaggcuggagugcaguggugcaaucuaugcucacugcaauaucugccuccccaguucaagcaauucucgcaccccagccuacccaguagcuggaacuacaggagugugccaccacgccuggcuaauuuuucuguuuuuuuuuuugguagagacgggguuuccccauguuggcuagucuggucuugaacuccugaccucaggugauccaccugccucagucucccaaagugcugagaucauaggcguuagcccccauacccuuccugccuuuuuuuuuugguuguuaauaauguugcauucucucguuucucuauuuugacugugugcccccuaaggauuuacuguauguguuaaacauugucucuuucuaugauuuaguuuaauaacugcuaaguuuaauacauauuuuguuguugggaaaaauuccuuaauuuuuacuuugaaauauuugucugcaaaccaccaaagguuaauauccaaguaccagggaugaaugggaaaauguagaugguucauuuuaggucugcuaugguuuaaauauuccaauuaugggcaaggccauucuauuacgacugcuuuaagaaucucaaaauucacauucaaauuuaaucagucauuuaaauaauagaaguuaguauuauagauagucaaggugaauaaucaagaucucuuguuggguuguaaguuguggggggcuuucucucaauggucaaauguagaugagauacccaguacaguagucucaaugagcaccauucucccaaauuaauguaagccauuuuauaaacauugaaauauugguuacuguuuuguuuuauagauucaagcauuuuuaacugucuuuuuuuuuuuuuaaauagcuuacgucccuccaaaggaucuuaguuuuucagaagugacuucuuaugguuucaaaaccaacuggucuccagcuggagaaaauguuuuuucauaucacaucaccuacaaggaagcggcuggggaugaugaggucacugugguggagccagcaucgagcaccaguguuguucucagcagccugaagccagagaccuuguauuuggucaaugugacugcggaguaugaggauggcuucagcauucccuuagcuggagaggagaccaccgaagaaggugugaugggguuucugccacuguuauucagaaaaugaauaauuuauugcacuacaaaguuacaguuuguaauaaccaucugcuuuauaguucagaauugccaaugccuuuguaagauuuggcaucuuuaaaagacagcuuuucauaaaucuuuuuaaaaagagaaaaauaacuuuuaaguaaaaaaccuuagacuucuuuugaugaauuugaaguuaggagaccuagagaacuguugauaauuauggaauuaacuuuugaaauacuguuuauccaucuuuuuuggucccaaauuucaggaaugucaugucuuaaaucuuucugaaauuguuuacuguacuuacagaguuacggcaaauauauauauguauauauagguaauaaguauauuauaaauuauuuauuuucuuuuuaaaaaguugugguaaaauauacauauuuaccauuguaaccauuuuuugagugcacauuuuaguggcauuaaguacauucaccuuguugugcuacuaucaccaccauccgucuuuagaacuagcaaaacugaaauucuguacccauuaagcaauaacuccccauucccuccuucccucuacuccuggaaaccaccauucuauuuucugucucuaggaauuugauuacucuaacuaccucacuugagaggaaucuuucaguacuugucuuguugugccuggauuauuucacuuaguaaauguccucaagguugauccaugucguagcgugugucagaaugcucucucuacuuaugguugaauaauauuccacuguauguauacaccacauaucuuuuaagaugggguucuuauuauguuauccagguuggccucaaaauccuaggcucaaaugauucuuuugccucagcuuccugaguagcugggacuacagguguguggcauagcgcccugcuucacauuuuguguaucuccauucaucaauggacauuugggcugcacccaccuuuugugaauauugcugcuaugaacauggugugcacauuuugccaaauguuuuaagcaguauuuguuuacauguguacuccuuacuggauagaauugaauauauuuggacacacuuuguuauguuugacauuuaaggcaccaauuuaaguugguuaguggaagacuaaggcaaggcaauuauucuuuaacauaagcauagcaaaguaucacaauagaugucaauuguucuuuccucuuuugacugggaauaggagguaaagaccaugaaagaauagugugaggaauuuaagauaguuauaaggaaguauuugcugacagggauggugcacauuggcauacuauacugauaaaagcuagagaaucuuuuuucugugaaacauuuuucagauaagauugcuauuuuuccuuuuuuuuuuuuugcaugguuuagguauauuucuuccugaaguccaucacauaaacuaaauggucuaagaaguccuuucaucuuaugacuuguggucauauaagggagaaggcuguacucagauauuucugaguuucugaugcuuuuccuguaaugcccacacugcugcucgaugacccugacccuuucuuuucagcauuuugggaggggaaugggaaaucugucucaagagaggacuugucucaggguuuuugaguagaagucacuccauucauacacacucuaguuuuuggucauuggucuacuacaauggaguuugguaaagucuuuucaguuauauugucuguaauggaaucugggauuuaaauuugcuuuaguugauaagaaaguuuccaauguaauacuuucauuaagcuaacaauuacagagcuccugcuaugugucaggggcucugcuaaauguuuuccauagauuaucucauuuaaccacuuaaauaauccuauaaauagucauguuuugcugcuaggguaaucuguggcucagaauuacauaucuguuaagcuucagagcuaggauuccaacccaucagucuaucugcugauuuguucugacucguuuaaucuuuuuccuuccaauacaaaaugaaucauggguguaaguuggccaacuaccauuucuuucuuuccuggagagauauacuuccuuccuuucucuucuagagagauauacuuccuuccuuucuuucucccuggagugaucuauugauguguugaauauuuaaauaaacuucuaaaugucuguguguuauuugccaggcguguugugcuaggcuuucaccccaguggacugagaagacaaagaccuuuaguucaucuuuccugaauauguugucuguauaggcaguuggccccauugagcaagaaggucauuuaaacauguuuacuaaacacaaaaccaaaugauguucucauuugggcauaaugaaaaaugcauuuaaaauuaugagucuguggguguuacccauagugcaucuuagcuucaagauguagaucuaaugagcauucauuaaguaccuauucugugcuuguuccauccuguguaugguugaauuauucuccaagucaaaugaccauacagauaaaaaguuagugugggacggacuggauaagacgguuugguuggguggguugauaugguagagcuggguguuagguguuauuuuccuaguuucgugagaaaauguaguaagagugaaagucuuggcugcuuauauucaaagaaaugacuuguuuuuauucuugaaguuuauagcaguauaaauuuagcauuugauagaauauuuauuauuuuaaaaguuuacuauuauauacaucuuuauguaauuaaaaaauuaacaguacuuaguuucuuucuggauauuauagaauucauauuugcuguuucagaauuuaguuaaucucuggcuaaaugaguacagaaaccaggauguuugcaaauaaauugcucauggauuucuuuagagaaaugguauaauuuaguaauaaaaagguaauuuuuguauuuuucauauaaagucagucaauuuaugguuuaaaaucuauuuuuccuuuuuuauuucaguaaaaggagcaccucgaaaccuaaaggugacagaugagacuacagauaguuucaaaauuacuuggacucaagcuccagggagaguuuuaagauaucgaauuauauauagaccaguugcugguggagagagcagagaaguuaccaccccacccaaucagaggaggagaacacuggagaacuugauuccagacacgaaauaugaaguaucuguaauuccugaauauuucucaggaccugguacuccauuaacuggaaaugcagccacugaagaagguagaggaaauaugcuuaucauauggugacaaccaaacucuuagacuagaggggaaaauugggacaacuauccagauaaaaaacuaaugagacacuuuguuucaauuguuugaguauguuagaccauaguccuuuuagauuuaaguuaaaauuuuuuuuuuacuuaaucaugacauuauuuacuugugucaauagauuuauuuguuuaauuaauuauuuaauuaauuuuuuucagacagagucucucucuguugcccaagcuggagugcaguggcucggcucacugcacccucugccuccuggguucaagugauucuccugauucagccucccaaauagcugggauuacaggcgcgugcaacuacacccagcuaauuuuuguauuuuuaguagaaagaggguuucaccauguuggccaggcuggucugagacuccugaccucaggugaucuggccgacauggccucccaaagugcugggauuauagacgugagccaccacgcccggccuugugucaauagaauuuaaaugcuaggauauagucucaauauucuuuuaaaaauaauauuauuaaauguuuuagugugaauugaaggaugacuaagaauuaaaaaucaaacugcuaugcaccauugaaauaaauuguauuuuacuucuuaagaaagauuuuuaaacauuaacuuguuuucuuuaaaugggaugauuaggaucccaguauacauucugauguuuguugaaauuauuaauguuuaauacgugauuucauugggggaaaagugaggcauucauaauuuuucauuuuauuuccuagcuguaauguuuuuaaaauagcaguaauaaugccaaggacacauuagcaauaaugaaaaguuacugaguaccugucuggugucagguucuguacaaagagcuuuucauauauuuuguuuaaucucugcauagacuuuauguuauuauuaucaucaucucagcuugauaagagaauugaggcugaggaaauuaaauaauaaaucaagaccacacagcuaauaaauggugaaucugaguuuguggauuuuacuguccuacugcagacauuuacaaggaguauccauuaucucuuggucugcaucacccuucucugucccacugcccucccucccucuacaucacucuccccacuccuacugcauuccucucccuccucccccacugcgucaugcucccaccgcccacugcccucccucccacugcaucacuuucccuccucccacugcaucacucucccaccucccacugcaucacucucccaccucccacagcaucccucucccuccucccacugcaucacucucccuccucccacugcaucacucucccaccucacacuguaucacuuuccuuccucccccacugcaucacgcucccacugcccauugcccucccucccacugcaucucucuuccuccuuucacuguuucacucuccucucuucccccugcaaccuagcucauuagccuguucugcuauggaggcuuucucuuuuuaccugcuuccuuccuccucucuuccauuggugaagugugacuacuucauugguuuucucucuugcugagggucuagggcucuuugugcuggguaccauaaugugacccaauaccucuuuaucuuucuauuuucuggaguaaaacuagcuggcuuuuauaugcucaguggagagugacauagggcuggauuccuuaggaaccuucaaagaggacaugaccaaucuacaaagaaagucaugaaauagcagacaucacagcuacaaaaggauggguggucccucgggauuuguacccaaggcucggucucacuuagcuguuuuuucucuuacuuuuuuucccccuagggaaagcaauauguuuauaauuuaucauuuuuauuauaucagaauucgcuccuguuaccuuuagauguucauagcauuacacugauuaacuguuuuuacugaagauuucuuaaaggaauuaaaaucugcauuguaauacuaaucaauguguauauauuuuauagugcuuuguuccacuuuuaaggaaauacagggaaacuauuuuauaggaaauauucuaacaugaaagauuuuacauggaagauuuuaaccuuuguaaacacagaaaagggacugaauaucuuuccccuuguuucuacuaacauauagggucugauucagagaugcuuaagcuuuguuggcuggucaacaguuaaaauugucauagucucacccaggauauaacuuugauguagugcacaugcauaaguaaaguaacaaaguguuuuucaagucauuuuuuuaaauaauggguuuugaugauguugucauuuuuuaaugaaguuagagggaauccaagagacuuaagaguuucugacccuacgacgucuacuaugaaauuaucuuggaguggggcaccaggaaaagugaaacaguaucucgucacauauaccccaguggcagggggugaaacucaagaggucacugugaggggagauacaaccaauacggugcugcagggauugaaggaagggacacaauacgccuuaucugugacagccuuguaugcgucuggggcuggagacgcccucuuuggugaaggaacaacacuugaagguaauuaccaucauauuuucugaaaauccaggaacuuguuuguggugcugccucuaggaagcuuaaaaugucuucagacaaugaaucuagaagugugcaauccuuucucuuaaaaagaauccauauugaaaaacaaauaaccauaaagcucucuguuauucagagauguagaauguaagcaacugaaaaaauuaaacuugauucagaagugccuuggggagcuggaugcauaauaagaccaaagagauguguuuauaguuccauggguugguugaaaggagaauagguguaugacauucagagcgagaagggaccuugggaaacaucuaugaaaaaagguuuggauugcccaaguuuaugcagcuaguucuaucuuucagauccagauaagagccauuuucugacuuccauucaagugcucuuuccauuuaccaugcauaaaagcucaagaaauauaagaauccaaguuucuuuuuuuuugugagacagagucucgcucuuucgcccaggcuggacugcaguggcgcuaucucggcucacugcaagcucugccucuaugguucacgccagucuccugccucagcaucccaaguagcugggacuacaggcgcccgccaccacgccuggcuaauuuuuuguauuuuuaguagggacgggguuucaccauguuagccaggaugaucucgaucuccugaccucgugauccgcccgccucggccaccaaaaugcugggauuacaggccugagccaccgcgccuggccaagaauccaaguuucuauuuguuuucuaagugauuucugaaauuccguucuguauuaaauuuucaaagugauugcgauaaaguacuuaguaagaaacaucagcaagacuggagcaguuuccuugguucuuuagaguuaauugucagaggccuuuauauuuuuuaggauuuuugagauauaaucacagcuuagguuuaacucaccacagcuacuaagugaauaaugcaagggagagaaaauacaaauuuaauugcaccgcaaugagaauggauugcaaugcuaaaaaucccaugauguugacucaguccuauaacugggggccuacauggacuaucagcaauagcuuuccuucuccuaucauuauauuuuauaugauuuauuuuaaaugauuauaggaagaaaaugaaucugaaguaucuucuaauaugaaaucacagugacuaagcaaaauauccaucaaaguugauggcuccaggagcuuggaagguuguagauauuguaauuaaugagacaggacauacaauaggcaguucuuagaaacuucaaggguuaagaaugaaaaacaaauaaauaaaaaauacuaauuuaaauaguagugaucgggcaggcgugguggcucacgccuguaaucccagcacuuugcgagaccaaggcagguggaucaccugaggucaggaauucgagaucagccuggccaacaugguaaaacccugucucuacuaaauacaaaaauuagcugugcgugguggcgcaugccuguaaucccagcuacuugggaagcugaggcaggagaaucacuugaacucgagaggcggagguugcagugagccgagauugcaccauugcacuccaggcugggcaacaagaaugaaacuccaucucaaaaaaaaaaaauaauaauaauagugaucaagaguuaaauuuccauaguccaugaaaucuguuucuagaaaaagauuuaaaugaaagauuaaauaccaguguuuaaaguacuuacaacuagaagagucccaguuguacugcuuagcugugugaccuggaguaaaccuuuaaccccucugggccuuaguuuauucaucuauaaagaagggaugauuauccucccucuuucuucccagaguuauuguugagaucaaaugggagaauguaagugaaauucauuggaaacuguaaaauacucuaugucuacaaaauucaucaagaggacauagcuuauuaacuuuagaucugauaucuaaaagccucuugguauacucaggguugggggcugcagauugguuccaagacgccugcauauaccaaaauccccugcauauaccaaaguccucuuauacucaaguccggcagucggcccuagggaaccuguauaugugaaaaguuggcccccggauauagguggcuuucgcauccugugaauacuguauuuuucgucugcguuuuguugaaauaaaucugcauauaaguggaccuucacagugcaaacccaugcugucaacuguauagcuuuaguauuucaaauauaauugguaacacaaaaaguuuugaaaaaaauaguagaaacagaaauugccuuaaauacacagacauaauccaaacaaaaaaagcuugugaucuuuacaaucuggggcaacauccagaauuuuggagaaauuuguccuuuucuuuggaccuuuugaaguucuguuucuccauaugcuuuccacaaucuuuuagcauagguuguucauaagauuuuuuuagaggacaaacuuucacucuuuauuuuuuacaggauagauguagauuguauuugugaacauuucuucuuuauaaggaguaucuuggaaauaauuuaauaguuuuucuucugguugugccuuuuagccuucugguauucauuugugcuuucuugcuuuuaaaaauauauuuaugcucaguaaaaaucuucucgauucuaaaaauuaaggcauuuuugccaagaauaauauauuacaaauuguauuuaacaaaauguacuuuuuaauuuuacaggaagcacauucuacuaggcugugauuuuuguaagccagauguauugcucaauuguuuauaauauuauagcucuucacaagugguaucaaaaaccuaucaacuuguacgcaugugugaguauacacacacgcacgugucuuugauaagaaacaaucucuaagggaaacacauagcuaguaaaauaaauuuuaaaagcuauuguuuucuauuuccugagaagaaggaaagcuagauaauuugcaaguuugcuuaaaaaaauacaguuaauuccuaacuaaauuguaguaauuuacaauggacauuuuguucauuuaugcuaaagugcuuuacugcagugaaggauuaccgaagggccuccagccugauuuuguuaacauauuuaucccauugcauuaugugugguaaacuugacaaauaugugaaagcauaguugugacuaaaugaaaauaauagaagauuuuugccccugguuauuccauuucauuuuauuguauuaacucagccaaauccacauaccauauacaggaauaggauaugaugguaaaugcagggaguggaaagcccagaaacagagccaggcaacugcuuuugagggcugcuguuuuucuaauuuguuuuucucuugggagaggaggugguaagagcagaacuugaaggaauguuuccuuuauccagaggcauggugucagccggcaggagcauucuguagguuggacaucuuauagauuaccucaaaugcauuauggcuuucaauucaaaaggaaauaaaguuguuguuguuuuguauuuugaaaaaauguguaguguggucuacaaccaucccuaacuugaaucuauuuccuaguacuuuuuuugaaaugcagccaaugaucagaaaauucccuuguugcuggaagagagauuuauuagcacuggcauuggggaaguucaugguuggcuguaguacuguaugcaauagaaucacaaaggcagaguuuauuacuauuucagauccaaacuucagaggaaugugagcauacaucauuagguuugauuuacauuguuuuuuuccccuguuguuguuagagcaguuagacaauguaauuacaacaacccuacuguauauguaauugaacuucaagucuugaaagaaccuuuaauugcugcuguuagugcuuggaggaaaaucuguuuuuauaaaccucucaauaaauacugcccauuuuaauucagcgauugaccacaaaugaaggagaauuucaauuugaagaauaauauguuuucuuguuaaauuuuugaguguuguuuuuuggcuauggaaaauaugacuuuuuagaauuuccuuuguuucaguugcuauagcaaccugcuaauguccuggauaugaauggcuuccuacagaucaaaccaaguguauucaguugacauuuuguuacaaugagguuuuuagcacaucucaggaauucugcaugauguugaguaacaugggccccuuaaagauggacuaaacaaggccucuguguuuucccugauuuacugcugucucauaauuugaaaaaucauacauucuggguauaauaacucugacguugccagggaacuuuagcacagucaccaaacaauaauuucuauuuccuuuuucugugaauuaauugcuugucagauaaaaauugaagucaauguggagaggugauaauuacggaagaaacacuuuuuugcucaagccgacuuugaaguugaaugguaauuuaauuguuaaguuguuuuuaagaacugugcauagcuuaaaguaacugaguuaacuuaucaauagugaacuuuguccuuuggaaugguggcucuaauucauugguuguaaaucaaauguauuuccacaugaauguuauccacaagcagaucuucuguauugcuguggaaaguuggaugacuuuugagcugagcucuaauggaaaagacaaauugauuuagaagagaguuuacguuacauuuucaauuuaacuucuauuuuugaaagugguauaugaaacucaaugaaagcuggcuggaacaaucuauaagaugaaaugcaguuuuauuucaugaugauuaauuuuucauuuaucauuggcuaauuuguguuauaauuauauuugaauuggaugauaauuugcuuuucagaaagaaaauggaaaagggguaaggaaacauaggaaaguuacuuaaaugaggcauuaguucuuuggcuugguauguggaaaaaagcaguguaggaaucaaucccuucaggauguucagaucaugagaaguagaccugucugaauuacuucccacagcagcagcacagagacacaugcaagcacacacuagaaaaauggcuuuugaauagauguaacuauguuuuauaauaaggacagaaaugcugaguagccagauuucaaaaccugauagaguuuuauaccuuuaaacuuaugacauuuauaccuauacugguacuauacuaggaagaauaaaguguaagggaaaauugucaagauagaaucaaaggaaugguaauaaaggaauaucaucauuguagaugaugacuuguuugaaaugauugccagaauuucuauuaccagagauaaaauuaauagagagaacacaggcauauauccagaacagaagagagcaaguacuaugagacuaaacauuauucaaaaaaaacccuaaacaaaccccagcaccauaagacacauauuuguaaaucuuggggaacagaagaaagaggaggaccucagaagggagggagccucugcuagagcaaaaguagaucuagguucagggaaagguagugacuacauggcaaaaagucuacuaggguugcuuucuguucacugccacuguuucuaugccuuccccuuuugaggagcaguaaccucuccuagagauagccuacagacuggucuucuggcaucuuuacguucuucucccucucucuuuccuagucccucuuagguacucuaaaaagggacucuugcauaaacccaauauaaugaaacuaaaccaaagcaagucggauaauuucuuccuguaguuacugaugucuggagcuccucagauucaggacaaaaaugacaauguauugaaccaaguaaaugccuugcuagguaacacuuagaacuucauuaaugugaaaaugugcucagcucuucaauaagaggcaugcguguguucagagccauuuccugucgagacaagauggaggggagaagagagcagugaacaucccacauguguccauggagaugugaugaaaagcuuaaaucaucuccucuguucucugagggucagccuugagauuauuuugccgccuaaagcagugauuuucuguacauggcaauauaaccacacaaaauacaagccacccagcaguccuacagagcaucauguguguaaugauuuugaccaguuuaccuucaccauaccugucuuuauuuugaaggagcaccauuucuaugugaaagcagauuugagguuccuucccacacugacccagcacaccucccgaauaaaugcuucucuagaccucagagaggagaaguagaaagaagagcaaaaaggggaaagaauaaagaauuguagagguuuuggaaucacagggcagauuuaaaagauauuuagaaggcaccaguacuuaggugcauccccaaauauuccaauuuaauugauuuggguaggguccagccuuuguuuuuucaggcaauucuguuuaucgguucaaguccaguccaguuauuuugcugcugagggccccaaggccccaggaggugacauagccuguuguugaccugcucagaugguugcauaccuggccccaagaccaguucagccacuugccagcuuccauccugccaacuguaccacagggcgcaauccacuugcuucauuuuuugguaaucuaauguuuggccaaaccaagaucucauuuuuuaaaaauucaagggcuauacauuuacuugucaugaguacaacuuauucucaaaauuccugguuguaauguaacagaauauucagcccuccucccuaaaaaaaauuaucaauguguuuggggagcaggauggauuuaauauuuaggaauauucuuaucaaacugacugauugacauguaagaaacccauaugaagcaguuuaucuucucaauuguggugucucgauugaacuaucuuucuccuuucuuuggagucuauguugcuaugucacuaacauggaauguuguagugacagugccugccuuuacauaccacaggcagaacuacaauuuuuagugaguuuuuuucugagauugagaacuuacucaguguucacucaaaauaguguugucaugccauuaauuagagcuuaaaaauauuuuuuaguugauuuuuaauuugcaucuuaaaaagugcuguuguagauuauuuucaggauaucgauaaaccuugggaaaggucuucauugcauuuuacuaguauuuuguucuagcuuuacaagucuugagaguguuaaaauaguugauuaaaauccauaggaagacaugucuugugaucuuaaauccuuuuguuuuaagcccagaaauaucuuugugaauguauuuuugcuucaaccacaauucucuuccuauuauuuuucucacagugaaaucauuagccuguguuuaugagauugaugucuguugucauggaaauaaacaaugucacaaauuuagugcuguagaaagaaaaauagguugagaagcaaaaccuuugggaaaaauaaaagcugaaauuguuuuaaaauuaccccgguguuaauuugaaagauaauuuccacauucuaguuaaccuuauuugucugauacuuuuuugaaacgucguuaaugcagcucauuuaaauucaaaauugcuuucaagcaaggucauuucacaacagcuguuccugacugcaaucuaggaaauuuagaggaaaaggcacauauugaaaauuguauauaucaagcaaaggaaaaacgugcuguacauuuaaaacuuagagacuaguuguugggauaucgauuaucaaaacaaauaaaaaacaaaacaaagaagcccacagccaaaccaaauaaaacaaacaguuuuaaauuguacuuuuauauuccaaguagagaaaauagaaagguguaugaccauuuacauaguaaagacagcuaaagaagacuuucaaaugggaauuaaccucaagagcugaggguaaaaauucaaugugcucuuaaaaauaaguauucuuuguuccagugaaauauguaacuaauuuccuuccagggaugagaugugcugucagcaguuaaaguuauuuauaauggaguuagaauuuuccauuugggcuuggggucugguaggcugcccagcuucuguuucauuuauuuuuucccucuaaaucgaccauauaugauagguuuuuguccaccuagauuucuuuuucauucauuguuaccuuuacuuuuuguguugaaauauaauuguuaaauuaugacugcguuuaagauauucauuuuaacucuuugaguuaaguaaaauaauaguuuuuaaaauucuuguaagagcauuauauaucauuugcaugaauauacaacaauuacugguaaaauguaugcugggaagcagauagauuuguauuuaugucauacuguggcauaaacccuaguaaagguagacaauauaaagugaccuguauauuuaucuuacauuuaaaauauggagagugaggguuuuauugaaagacauuugugccuccuguuaaguugagguuuccauauuuuuccacuuggguuguauguuuuuugaaugaaagagccaaaauuuaguagcagacguuuuugaucagcuagaacaagugguauguuuuauuuuggugacuaaucacuuuuaaguuuuccagaagaauugguuguuuucaauuuuguuaggguuaagcuauauugaaaguuugcacugcuacguuuuaaacugcaugagcaaauaaaaguuucaccaauaaacuguuguuggcauuaaguuuuguaagugauaugagauuguugcaguuguuguaaaucaugcauugaaacugaguuuauuuaaauuagaucagagaggaaaagaucaugguaaggaaauaaagaucuuugugaacaaugggccaugucacaaggcagacaaaaaugugauaaaauucugggacuuagauacauuuuuuuuccuuuggaauuuuuuuuuaaagacaaauacuccuucaaauuuggaugucaaucuuguccugaaggacaagauuaucugacuaggcauaugagggcaaaguuaagagguaggaaucaaauagaauucuaaaguuuuauugcaucuaucuauuccacagacagaauaggauggacaacucaaaaagaagaaaugggcaauuuuagacaaauugagugugaguccagcaagucagaaucucuaccaggaucaaugaauauaauacuuaaauaccuacuagacauuuuuaaaaaagauucccuuuuaauuucuguucuagaacgugguucuccucaagauuuaguuacuaaagacaucacugacacaucaauuggggcuuauuggacaucugcuccaggaaugguucgcgguuacagggucucauggaaaucacuuuaugaugauguugacacuggagagaaaaaucugccugaagaugcaauucauacgaugauagaaaaucugcagccagagaccaaauacagaauuucaguauuugccacuuacagcaguggagaaggagaaccuuugacuggagaugccacaacugaauguagguaacauuauggguguguuugggugugugccggugcuacccaauaguuaucagcucaagugacaugcaguuuaaucacuugaauguuuuuucuuuacaugauaaaugaagacugaggaauuaggaucuuuaaagaauuuggcuuaaauucagaguagguuagugucuaaaaguauaucaaauuuugaaauaucgaaucucuuucaacuaccuauauuugucuuuuuuuuuuucuggugcaaugauugacuagauagaauacccaacuaguaaaaagaccagaagcuaugaagcgaagagaauuugggcacauuuguauagcugcaugaucuuugucaaguuacuuaaccuucuuugagccucaguuuccuaaucuguagaaugcagauaauaaaucuugucucuuagaguugugaggauuguauaaaauagcaauauacaaaguggccagcauagugccuagccacuuagagaugauugauaaaugauugaucgcuauugaaacuaugauuaucauacaaccaagacuuaacuuaguuuuuuaauuuuuuauuuauuuuuauuuuuauuuuauuccuauuauauuugguaaggucaaaucaaaagcccacucaauuuucugauggcucagauuuaccucacucuuacugauauuuuuuuuuuguaaauaauuaugaauuaccuaucauaaucaucuggcuggugaaagaugugucaggauaucuuaauucacuauccuaaaagguuauuuguuuaagugauaaucaugugucaguguagguucagcaguuguaacaaauguaccacuuuggugaaggauauugauaaugcaggaggcugugcauguguggaggugggaaaagguacaugggaaauuucuguaccuucugcucaaucucuguaccaaaacugcucuaaaacaauacaaaaucuauuaaaaacaaacaauugaaaccaaaccaaagcaaaugucauuuguuaagcaugggcauuucuaagcauuuguaggagaaaacuuuaauccuuuuguuuugggaagguuuuaggaaaaggagaaagacugggcauucaugcauuuccuucuauaaaaaagaaauagaggaauuuggugauuuuucuggcaaaggaagagagagggagaagugccaugagcaauuucaguuaaguccuauaucuugauuuuaaguuguccuuaaacuaaaaucuuugugucuaaguucauuuucuuuuuaucauuugcaagcucaguuggauguucaaguuuaaauuuguaucuuaauucaccagauuuuuaaaaaucaacuucuuuauaggaaauuuaaauaugugagaagacauaguucucagauauucacaugauugguuucuaugguaguaaauaaaaucuugugucuggaauauauuggcugauguaguuuaagaacaugguagaaauucauucucuacuuuugaggaaauucacuugucaagagaagcuguauuguaaacuuaggucauauaugacacauaaagcuaaauuuauuuguaggaguacagauacaguucauguggcugagaaauuacaaaaguauauguauuuagagggauuuuuuuccuccagaaauuauccuccguuuugucuuuuuccaaaaaguuggaggcuucaaauaauuauuuggaauuuaaaaugucuacaagagauguguugucgccaaaagcaaauaugguggcagaaacuaaauaaaucucuguaucucagaagaugagcaucuaagaaauuuucaauauuucuuggcuaauugcuugauuuaaacauugaugaacagaaaguccuauuuuuuucccaaguuaacuuuuuuuaaaauuauacuuuaaguucugggguacaugcgcagaauguguagguuuuuuacauagguauacacgugccauggugguuuguugcacccaucaacccaucaucuacauuagguauuucuccuaaugcuaucccuccccuagcccccuacccuacuacaggccccggugugugagguuccccucccuguguccauguauucuuauuguucaacucccacuuaugagugagaacauaugguguuugguuuucuguucuugcauuaguaugcugagaauguucguuuucaacaugauccauguccuugcaaaggacaugaacucauccuuuuauauggcugcauaguauuccaugguguauaugugucacauuuucuuuauccagucugucacugaugggcauuuggguugguuccaagucuuugcuauugugaacacugcugcaauaaacauacgugugcuuguguauuuauaguagaaugauuuauaauccuuuggguauauauccaguaaugggauugcugggucaacugguauuucuaguucuagauccuugaggaaucaccacacugucuuacacauugguugaacuaauuuacacugcuaccaacaguguaaaagcguuccuauuucuccacauccucuccagcaucuguuguuuccugacuuuuuaaugauugccauucuaacuggugugagcugauaucucauugugguuuugauuugcauuucucuaaugaucagugaugaugaucuuuuuuucauaugucuguuggcugcauaaaugucuucuuuugagaaguguccauuaauauccuuugccaacuuuuucaugggguuguuugauauuuucuuguaaaucuguuucaguucuuuguagauucuggauauuagcccuuugucagauguauagauugcaaaaauuuucucccauucuguagguugccuguucacucugaugauaguuucuuuugcugugcagaagcucuuuaguuuaaucagauuccauuugucuauuuuggcuuuuauugccauugcuuuugguguuuuagucaugaagccuuugcccaugccuaugucuuaaaugguauugcauagguuuucuucuagggauuuuuaugguuuuaggccuuacauuuaagucuuuacuccaucuugaguuaauuuuuguauaagguguaaggaaaggauccaguuucagcuuucuguguauggcuagccaguuuucccaacaccauuuauuaaauagggaauccuuuccccauugcuuguuuuugucagauuugucaaagaucagaugguuauagaugugugguguuauuucugaggccucuguucuguuccauuggucuauuuauugcacuuuacguuuuugguaccaguacugugcuguuuuuguuacuguagccuucuaguauaguuugaauucagguagcuugaugccuccagcuuuguucuuuguggguaggauugucuuggcuauguggacucuuuuuugguuccaucugaaauuuaauguaguuuuuucuaauucuugaagaaagucaaugguagcuugauugggauagcauuaaaucuauaaauuacuuugggcaguauggccauuuugacaguauugauucuucauaucuacaagcauggaauguuuuuccauuuguuucuguccucucuuauuuccuugagagugguuuguaguucuccuugaagagguccuucacaucccuuguaaguuguauuccuagguauuuuauucucuuuguagcaauugugaaugggaguucacucaugauuuggcuguuugucuguuauugguguauaagaaugcuugugauuuuugcacauugauuuuguauccugagacuuugcugaaguugcuuaucagcuuaaggagauucugggcugagacagugagguuuucuaaauauacaaucuugucaucugcaaacagagacaauuugacuuccucuuuuccuaauugaaugcccuuuauuucuuucucuugccugauugccuuggccagaacuuccaauacuauguugaauaggaguagugagagagggcauccuugucuugugccaguuuucaaagggaaugcuuccaguuuuugcccauucaauaugauauuggcugugggaggccucuuuugaacaaggagcagacguggcaggaaugaaauguucauuuuuagguuacgauuggcccuccauauucucagguuccacaugugcaaaaguaaccaacugcugauagacaauauuuuuuaaaaagcaauaagaaauaacaauacaacaauaaauaauaaugcuaguaaaauacaguauaauaauuauuuauaugacauuuacauuguauuauaaguaaugcagagaugauuuaaaguuaacaaguucucaaauaauaucauaacauugaugagaaaaaagaauugguuccuggugggggucaccaucuguguggaguuugcacauccucuccaugucuguggguuuccuccagguacucuaguuaccucccacaucucaaagaugugcauguuaggugagcuggugcguccacguggucccagccugagugagugugggugugugugugugugccuaggaugggguucucccuuucgcccugagcuacuuggacaggcuguguccacugugacccuuaacuggaauaaaugggugaauaauuauguuacugguuuucauuuaucuuucuuaaauguguauauagcucacacauacaucaguguuucuuaugagaaguguuuugguuuuuauugagaaguuuggugauguuuuugugaucagaaauaugauguaggaacuuaacucuuguuuauaucaauuaaccucuggaaaauugguuucuuuaugucaguuguucaaaguugcaguuuucaagaaauuauuuaacguuaggugagggcuuacuguauuagggaggauaugcauagguuuaugcaaauacuaugccauuuuauaucaggaacuugagcaugugaggauuuugguuucuaugggagauccugaaaccaaucucccauggauaccaaagggcgacuguaugugaaaacugcugaaaugucuaaguaaauaagaaagaagucauggaccuuucuuuguucuaccaccacuuuguuguuguuuagaaaguauuuucagaaaucugagugagaucugcuauucagaugguagaggaauccuaagguguggauaacucagcagaaacccgagcccaugcuccuagaguuucacauaugcuuccaagagggcauuuugggaaugucuuuaagauugcuuucaccugaaacucagggacaugguaugcagacuguugauacaaugaaacgaauacauugauacaaugaaaaucaugaauugggguuagaaagccagcagaagggacacuuucuauugcccuucuaauuuauggcagcuggcuuagcagugguacaguggauguuugaaagugucuggugauaguuacuaacacaugaaaagaacuuacaaugugagaggguguaacagcauuuaauggcaugugguauccaaucaaugauguaaaaauucuugcucuuugguuaugggaaaccaacaaggguuuuuuuuuuuucucccuaaaauccaguuucccauuaaaacuaggaugagauaugcuauacuguauuuaauuucaguuucuuuauuuugaagaguuaauuaaaaggcaggaauauaagugagguuguuaaaguauaucaagguaugagauaucacuuuuggcuguuauuaacauguuuaaauuuugaaacauuuuaaagcuuggcaucccauuuuuuuuugaaacuuaaguuucuuuaaacauuuuaaagcuuggcaucccauuuuuuuuugaaacuuaaguuucuuuuuagaucaacauucauaagauuuaacuuuuuauuuuucuaaauucugaguugugugaaauucguuuaaaaauuuuguaagagagagaaugucuuguuccacugaguaaaaauuuaagagaugaaacaaaagaugagaaaauguauuguagcacaaccccuucuagaaaacuguuagacacccaucaacuuauuugauauuugugacaacugguaaugcuaauaauccaaauagauuauuuuucuauauacuauucuuucuuguacuauuuucaaaacuccagguaaaagucuuuagauuuuuuguuuggaaauacauauauauguuuauauaauauauauuuuuauauaauaauauauauuuuauauauauaaacuuuuuuucuuuuaauaguucacguaccuggagaauaauaauagcaaauugaugauuaaucuaaauaaauuuuaauauuuccagaaaguaauggacuucacugagaguucucuuaguuucuuuaaaccuaaaaauaaaaauugcagccaauauaauuuugauugaaauuauauuuuuuaucucucagaagcauaauucauaaccaucauaaccauauauugaauuugcuuacuuuaucauucuuaucuuuguccucuauacauauuauguguuuuuaaaaaaauauggcugcuuuacagauuuuauuuuuauuacuaauuuuaagcaauuuaauuaugaugugucuugguauaguuucuuuauguuucuuguguuugggguucacuacacuucuaggaucugugaguuuaugguuuuuauaaaauuugaaccaguccaucccauuauuuuuucaaauacuuuauuuauuacacccccacuuuauucagguacuccaauuaauuacacauauguuagucugcuugaaguugucacacagcucacugaugcucuguucauuaaaaaaauuuuuucuuuccuuguguuucauguucuauuauaaugccaucaaguucacuaaucauuuuuuuauauuuucuaaucugcuguaaauauuaucucauguauuuuucauuuuagauuuaucuuuaucucuagaaguuuaauuugagucuuuuuauauguucuauaucucuaguuaaaaugcuuaaucuuucuccuaccauuauuacauaugaaauauaguuauaauaaguguuuuaacauccuuuuuaauucuguaauguaugucauuucuaguucuguuucuauugauugauuuuucuucuuauuauguguugucuuaguuuggacugugauaacaaaagguauuacuauugacugaguggcuguaacaacagaaaguuauuuucucacaguuuuggaggcuggaaaguucaagauuaaggucuggcaggguuugauuucuggugagggcucucuuccugguguguggucaccuuccuuuauguccucauauggccuuuucucaggcugugaauguggaaagagagagagagcucuuuggugucuccuuuuuuucuuauaaagucaccaagccuaucagauuaaggcuucacucugaugaccuuauuaaacccaaauugccuccacaaaggccucauguuuaaaugucaucacauugaagguugagacuucaauauaugaauuuaguggugggagaccuucaauccaugauacaagucauaaguuuuuccuuuuuggcaugucuuguaacuuuuauuagaugucagauuuugugaauuuuauuugcuugggugcuagauauuuuuauguucuuauaaauacucuuaaguuuuauucuggaauacaguuaaguuacuuggaaauaguuugaucugacauuugcuuuuaaacuguuucaguuuaggacuaauuuugccccauuauugagacaaucaccuacuaaauauccuacaugaucucccuacaguugugagguuuucucuucuggguagggggaacauuucuaacccugugugagcucaauaaauuguucccugggcuccuuuggggugguucuuucccuaguuuugggugguuuucuuacacaugugcacugauuauccuagguugaagaccaaguauuuucucuguggcacucucucauucacaguacucuauucuucaaguucugguugcuuugggcucuccagacuugcaacaacaucuugacaauuaagggaggccaccagccuccaucuggauuccccuuucuuuuacuggggacuggaaauuccaagcaauagcugggcaaucauagaaccuauuccccuuuguuccuuaucucucuuagggaucaguguccuaugccagcugaugucgugucugaaaauuauuguguuuauuuuucuuagguuuuuuuuuuucuggguuucuucauuguuucaaauggcucuugaccacuugaacacgaaauuuucucuuacaaucaggaaagauucuuugcugauuuugaauuuuguuuagcuuaaucuuuuucuauagaacauguuuauguucuuuugaacacugauuauugaacugaauaaaaugguccugcuuaugaacucuaauuauauauaaaaauaggauguuguagguuauuuguggcuguugguuacuuauuucauauagcguuauuaauaauugugaaauauuaguaaacggaauuuaauaauuacauauuauugauuacauauuaagcaaacacuauuuacagauagugcuuucugaaauacucagcauauaccaguuuaucuuuagagccccugagauauuuugaaguguuaguuuccuauucuuuugugcucauagucugagaugugcguggcaaucauaagaaugguguuaacuacagucacucuggcuaguuauuuauggauugcaacuuuuucugaaaaaguucaaguaaaauguccaacccugcauucauaauuuuuaguauucuccacagcauuauuacuggauaaauucuuuacagauggaaauauaauaaaaauucuaaaaccuuaucuccggaaauggauguuuucuuuacuaaagucucuagaaggcaaauaggaaaucucugcaauaugaacuuccauuuuuuaguauuagcuagauaaaacgaaaacaucuuacugagaucuugaugagauuaggcucacacgccaucaugaauuuaugagagauuacaaugcuaagcaauggaacaguguacauauuuaagaagccacagagaguuucuuuucacauaaaugaagagguggacauacauuuuuuuucaacaugguauacaguuuaaucuuccuuuuaucucccaguaucucaagauuccaaaacccugaaaguagaugaagaaacagaaaacacaaugagaguuacauggaaaccagcaccagggaaagucgucaacuaccguguugucuaucgcccucaugggagagggaagcaaaugguugcuaaggugccccccacagucacuucgacaguguuaaagcgacuucagccacagaccacauaugacaucacaguucuuccuauuuacaagaugggagaaggaaagcuuaggcaaggaucaggaacaacagguaugaaauaauaauuauauuuugagggggagagaagguaauguuuuaaaagaugacuuugguaugucuacuucauuuguaaauguuuaaaacugauuccguaauaaguuaaauuauaauuacuagacaaugucuaaauaacauguuauuuuuaccaaucuaguuccugguaaaaugauucuacauauuaauguucuuaugcaaaucuaaucugaauugugagaauuauuuacacuucuacuuagcuagcacucuguuaucuggacuucuauggaacaugcuauuuugugcuaccggacuuaaacccuuuuuauggauaugcauuuuuguggggcuaauaaaaaagaaaccccaaagccuagucuuacagauaauauuuuaaaaaucuuuuugucuuuacagcuucucgguuuaagucuccuagaaaccucaaaacaucugacccaaccaugucaagcuuccgagugacuugggagccugccccuggggaagugaaggguuauaaagucacauuccacccuacgggggaugacagaagacugggggaguuagugguuggacccuaugacaacacaguuguuuuggaggaacuuagguaggaauuaacuacguuuguaucaaaggaugaaauuaauuuguuuacaagguugaauagcuuuuguaaauuaguaggcuuuacacaaauaucacuuauaugucuguuugccagcaaaguauuuaaaaucagcuaaagcuguuuucuuaugcuuggugcugcuggaguugaaguuaggauucaggggucagcaacagaauuuaggccugagcaggauuuuuuuguaauguuuaauaauuuuuguuuguuuuuaagggaucagaauugguguuuucaauaacacccugcuuuuaagaaauuaauguucuuauuacacaaugucaccgaaauuguagccauguggaagcauggggguuccuguaccuuuuggcaagguuugagggacucaugcugagaucuugagugugaaucccccuccagugugccauacaggagaaagaaggcaggaccuugugggugccagcuggcaggaaagggcaaggcugggcucaugaaagguccagcuccaggcugugcagugaaaaacaaggaaguuucaguuugaacagcacccuacauucauuacaguaaaaagaaugaacuacuguguguagucuuuugggaaguuuguuuuucaaucauucauucaagacuauugaaaucuauauaaaugcuugugauuuacuuuuaccagaguagggaguauaaaauuuauugagcuuacuaugugucaggcauuguguuaggcauugucuuauguuaccuugcaagguacagcacuucaauuauuuucuuaaagcccauugcuuagaaacaguaagauuaaagagucugacccuuccugacaugcugaaaggcaggguagagacucugcaucugcuagaaaggcaagacagaaaccagugcugugaauuccuaguguucucuggaaugauugcugucuaguuucucuugacaccucacaggguaagcguaagugagaaagaggcggaaauuauuuuucuucucuuauaauguuguacacuauaaacucuucauaguguaagcuuguaaaucaagaaaaaugucuuuaacaaagcaaaaaaaaagugcuaccacuugagccuaugguucucacaggcuauauauauacuuuaacauuuuagggcugguaccaccuauaaaguaaauguuuuuggaauguuugauggaggagaaagcucaccacuuguuggacaagaaaugacaacccuuuccgacacaacuguuaugccaauuuuaucuucugguaagaaauugaguuacauuccuugaggaaaacaacuuaggaaacuauuucaaaugugaacuguuaggguaucauacaauggaaaacaaugauacaaauuuuacacuaaaauuuauuucaauaauuuacauacuuagcaaaaaaauucuucaaacauccagucaagcaugcuuuuugacaguauuuuuuuauacuucuuuuaucagcauugcauuauuucauacuuaaauuauuacauaaaucuauuuuuaagaguaauauauaauuauuaauguauuaauaauuauuagugauguaauuaauguaguaauuuuaaauuauguaauaacgcauaauuuaaaauugugcauuaaauuuauuaaugcauuuaaauauuaaauuuaaaauuaugcauuauugcauaauuaagcucuauuauuuaaagaguuuuuacuaaauguagauauuguaccguuuucuauuuuuaaugacuaagaugcaguuuucuuuuguuaaaguaauugcagaaauguuuuauuugggcuggguaagcaguguuagguuacauaaaugggugggcaacuaugacuugggaaggaaaaugguaacauaagccccuuagauuuucugucccugccacaauuacagccuuuaugaacauaaagcuaguuuuuaacauucuuagagacggaggugguggacagaguuuacuucugauaguuuucauuauugcuaaaaaagaguagaucugggcagagcaggagcaggcuuguaagggcuuauuuccuugggauaguauuugggaauccuuaauccugauauaguauauaauauaugagugacacauuuguauucuguagugugaugagcauuauuuaauuuuuuccaaugauuucuuuuguaauauaaagaccaaaugcuaaccuuguaauaaacuggaaaauuuauagcugguaauauaagcuuuuggaaaggagaacauuaaaaaaauggauguggacaaaaucaagugucaaaucuugcuguuuugcauuaauguucuauuguuucucuuaugaugauauuaacugacuuauauuuuuauuuuguagcuuguacacugaggauguugggauuauuuucucuuuccaaagcuuuuccuauguaucaauguuugugcuuaucuuuacagcucucaauuuguauauuuguuugcauacuuuucuaaauugucuuccuucuuucuugauucuuuaaaugugcaaacuucaccaucuauauuuacaugauuuuuauucacaguagaucauaaauuuaaaugauuaauagcuagauaauaauauaucaggguuuaaaaaauauaucuuuaccucaaaaagguauaauuuuaaaaguuaugugucuaauccuucauauauaugugguaguuaccuaacagcuuagcuauuugaaaagauaauuuuuggcucacaaaaaccuuuuuuuaguuuacauauuuuaucaguccaucucauucuugucugcuaugaccauuaaauauugcagaagaaugcaauaucuaaugauuugacuacauuacaauuuuauuaaaguuauuaguacuucauaguuagacagcuauacauucucauuuauuuauuucagccuuugaauuugugagcccaucaaauuuucaacaauggcuuaauucaagucuccagguucuaugaaagagggcaggaaaucgagucaaagauaaaggaaagauuggccacugaaauaaucuuuggaggaacugcugacucuuaagacuguuaauugagguuaauaaaucagauggacauauuuucagagucuuauacuccacaucacugagcuagaccauaguacugagacaggcaacacugaggauccagggagugguagaggugugacaaggaaguacccuugccaacaauuugcuucuuacugucuugucucaugauugccaugucagggauggagugucucaccagagcugaggcagacauuguguugcugguggauggaucauggagcaucggccgggcaaauuuuagaaccgugaggaguuucauuucucguauuguggaagucuuugacauuggccccaaaagaguacaaauugguagguucugacaacauuggagccauuuagacauuuuuaucuuucucuuucacaugcacuaaugccaguggugucauuuuagcucuugcucaguauaguggggaucccagaacagaguggcaguuaaaugcacacagagacaagaagagcuuguugcaagcuguggcaaacuugccguacaaaggaggcaauacucucacaggugaguaaggacugucugacagucuuucagcucaugcuucugguuaagguuuguggcugaauggugaugugacugauucucuuuuaaaaaucccacuaggcauggcuuugaauuucauucgccaacagaacuucaggacccaagcuggcaugagaccucgagcucgaaaaauuggugugcucauuacugauggaaaaucacaagacgauguugaagcaccuucaaagaaacucaaggaugagggaguggagcuguuugcuauugguacgcacugaaaaggacagugaugccccugggguuacaaaugugcugaggauauuuuucguaguuagaaguuuuaucugaagcaugaaaaaaaauacccauuuuuuucuaucacauaauuuaucaaaauaauguuccaggaaguuaauucacuuuuuucuucuuuuuuuggggacaaaacuacaugguuucuuaaacgaaaauuaauagaucaagaagaaaaaugugguauuaauaggauucauaaaaacuccuacuugguuuuccacagaaccguguuuauuuuugauauccauuauuuuacauuccagaaaaaacacugaagagagucuuuuuggcgggaaauuggugcuauauacauuuagaagaagccaauuuaaaagagcuuucaguuuguauuauccuuuguuucuguuuuauuauugagaaaaauaauauguauguuuuaguuaacuaauuauuaaaccuucauaguuggccaaaagcagccaugaauuaagaaagccguaaaucauuugcuucauuccauuaauuuuuuucugagaagugcuuuuaauuuguauauauccguuuuugaagguauuaaaaaugcugaugaagucgaauuaaagaugauugcaacugauccugaugauacccaugcauacaauguggcagauuuugagucacucuccaggauaguggaugaucucaccauuaauuuguguaacagugucaaagguccagguaaguuuaacccagaguuucucucccucagcacugcugguauuuugggccaaauaauuauucuuuugggugggggggagggcacuauuuugugcacuaugaaauguuuagcagugugaaaggccucugccgguuggaugucaguagcauccccuaaauuguggcaauuaaaaagaucuucgguuguugccaaaugucugcugcagaaaaaaacuguccccaguugagaaucacugcauuagucacugauuuuuuuuucugauuuguuucucgugauggcaccucaaugacuucuagcuuauuugaggauauauuuaguuuauauccugcauaccugcacccucccccacacaacauauauauaaaugggaagggguaggaagagagggaaggagagaugcuuucuuuucugguauauaccuauugucuuaaagcaucuucacuccauuuaguuacuacauugcuauuggaugguuguucccagacucuuguuuuccucaguuuugguaccuuuuuuaaauuuccuagugugagcaggaaugaaagagcagucuuuauaucugauuugcuuugccucaacuguagaugaucagauuugaaacuuuacacuuauaaucccuaaauauaaagagaagcuacaauuuuacaguuuagacauuuagaaauuauauaaccucuuuuuaccagugaagaaacugagaucuggagaaaaauuacuuggucugggucaaauguuuaaagauguuuuuagggguauuaaaaaaguagauauagcuaaggaauuaggauauugaaauaaaauuauagaacuggauuuauaccaaaaaaggauggugcauaaugauuacucucugugcaaaucaugggacaaaacaugguaaucaccaaauuugaagguuuuuugaaaauuaaugauaaaaauuauggcucuuauuaugugagaaaaauuuuauuuaaguacauguagauuaugguaaaauuguccuucauuaauuuaauuugguuuuggaaaaguuggaauaaguuuaagaaacaaugugguagaaaugguucacuugcucugggugcuagggguauguuuauuugaauguucccucuuggcuuucuuucuccuaacuuuugcagauuuucuuuuuugaauuuugaacaacagauugaccuuuucccuggagaaauagaccagccuggcagccagaauuuguaggcuucuggcucuugauuagcugagagaguuguaguuuuauuccauuggagagaacuuugagugggaugaaaacaucuuuuaucuguuuugcuuuuuuuaaaaaaugaacuauguaauaguugcauucauucuaguuucccagacaguaaaauugcuugauaauuuuguagguuugacucuuacccaaguacaauaaaaguuaagauacuaagaauggaaaggcuuuccccaguuuuggcuugcacaaaaaguagaaagaguuuauacgagaaugauuugccaugcuuauggaguuauuggauuaaucccuuucucuuuuaauuauuauuugggccauuuuccuguuagacauauugagcuuaauauuuccauuuucaucagcauuuauuccagacacuguuauguauuagucauuucaccuauauccacccacagggagcacaaucacaggcgguagguuguucccagauugaaaaacauguguuucuuugcacucucuccagugauacauugucagcuuccuuuguuaugcaacuagauccuguuagagaauagaaugaaugaaaaaucaauucuguccucacagagcauaaccuuuaguuaaggagagaagacaugaguauauagaaacaaaaugauaaugagggcagggaaguuguguggugccaauagugauagggacaauggagaagcuaaauugucaggaccuaaauucuuauuuacugauuauauguacaaggguagagagaggagaaaguaucaaaaggugauucagaggucuuagucuguucucaugcugcuaauaaagaccuacccaagacuggguaauuuauaaaggaaagagguuugauugacucacaguuccauguggcuggggaggccucacaaucauggaggaagagcaagggaggucuuacaugguggcaggcaagagagagaaugagagccaagugaaagaguaaacccuuauaaaagcauuagaccucgugagacauuuacuaccacuagaguaguaugggggaaaccacccccauguuucaauuaucucccugugggucccucccacaacacuugggacuuaugggagcuacaauucaagaugagauucagguggggacacagcaaaaccauaucgggucuugagucucagugacuuguaaauugguaaaguuuguaaggaagaggaggaucagguuuuaaggaaagacaaugagcucauguuuuaaucuuuugaggcuagaaaaccuuuuaguuaccuauucauaacggucuuacaggugaugagccucuaauacagauuuauuguagcuacuuaguaugugaaaagaagugugugaaagcuuagaauauggagcauaauauuguuucaaugucauuucaaauauugucaccuuucuacaauaaugagaaaaguguauacccuuuauuuccauguguaggugauuuggaagcaccuucuaacuuaguuauuucugagcgaacccaucguucuuuuagagugagcuggacaccaccuucugacaguguggaucgauauaagguggaauacuauccaguuucuggagggaaacgucaagaagugaguaggaacaccuauaacuuacuucuuccugauguugagauuggguccuccucauuaggacucugagaauaauguuaggugaggggcaagagggaugaagaggggccagaaaugagucaagaauagugcuuucuauucuugacuuugcuaggcaggcauuuccgucuggcuuuaauuaaagggaaagagcuuugcuuaaauucuuacgguuucuaagaauuguagaauaucacuauguuuuuuucauuaaaaucuaauuagaagaugcuugauuuauuuaugaauuuguaguagaaucagagaguuagcaaggaacauugaagaugaucuauuuuuacccauucauuuuacaaauaaauaacagcugggagaaaaauuauaugaauuguccaagaucucauuguaaucugauaguuuccaaauacaaaagacaauggccuaauugaaauauagauucuaagcucacugcaguuaacuacuuuguaaguauaguaggaaaaagggaacugauuauacauacguuguugcucuguuuaauuuuucccccuaguuuuaugugagucgaauggaaacuagcacagugcugaaagaucugaaaccugaaacugaauauguugucaauguguauucugugguagaagaugaauauagugagccucugaaggggacagaaaaaaccugugagucagauuaaaaaauuguuucucauugcuuucuuuuccaagauaaagcaugauggcccauuuuugccuaccuuccaaauaauuucuuuauuuaacauucauucuauaaauauuuacugagugucaucuuugugcaggugcccagaaaauacucagugguuuucuacuccugcuggcugauucugccaucauggagcuccacuguggaauagggggucacugccauaauaaucuagagggaaaacaaccuuuaauggaguuauucacuucuuagagucuuuagacuuuugcuuucaagaaaaucuccuaaaaugcaaauauaccuuucagggggauaauuuuacauuuuacucuguuguuauauguugacauuuuauugaggaauaaagcacaucaggaguaagauaugaggaaggauaccauguggggagugggacuaagaucaggaagaagagcguacagagauaccgauuucacuuuuacuaacggccagcgcucccggcugccagugagaucuucucuuuucuuucuggcaucuggucuuugcuagagaaacucuaagugcuuuggcuuugaguagcgcuuuugggguagauguuccuugcuccuauuccugguaaugcuuccagagacauaugaaauuauucuuuccuacuucuugcuucuugguugggcucuagggagaagaaggaaagccacuuuuaagaagaaggagugcgcaucacucucuagagcaagaacugacuuuauguacugcucaaguuuuagauccuuaucucuucucuuauaucccuuuauauuagacuauaggaggugagaaauaauguauuuuauaacuggcaggauuaauaugauaauuucuuaaaacuuugaacucaaucuuugaacaaaaaauaauuggaagcaauauggguguuauagggagauuguaaacuuuuuccucugcuucauggguuuaucuucaagaagccuauaaaucccugauguuccaguuauuaauguauaguguucuuauuuuaaauuuauuuuuugaagaaauauaaaaaauaguguugauuacauauauauaaaguucugugauugaagaauagaaauagucaacuuagugauguuccagaaaaagagaguaacguaucaggaaguugguaucuauuguagagacucacuggaaugccauuugacaccugaacuuuaacauuuuccuucuacaagauagugguaacgugcagucuugaauaugaagugcaaugagcaauguaaauuggauuuuuuggggcaaugggaaggauuauauuaacucuuauugauuucucacaguaacccacugucuaguauauacaaauaucaauaauugaguacaaaacaaugguuaaaaaugaguggaaugaaaggaacuagacugauggucugcuuuucuguuuuggaagugccagugccuguagucagccugaauauuuaugauguuggcccuaccaccaugcaugugcaguggcagccugugggaggagcuacuggcuacaucuugucauacaaaccuguuaaggacacagagccaacaagacccaaagaggugaaagauguuuguuucuuuaacauugggucuucccaagacuuuauagcuuuauagugccuauuauacugcaguuacuuacaaacucauuuauaacuuuacguacaaaauggaaaaauagaaaaguagguuuguggucugcaacacauuguagaaaacauuggcauggacugcccacggugacugacgccuguguaaucucagcacuuugggaggcggaggugggcagaucaccugaagucaggaguucgagacuagcccgaccaauauggugaaacaccguuucuacuaaaaauacaaaaauuagucgggugugguggcaaguaccuguagucccagccacucaggaggcugagacaggagaauugcuugaacccgggagguggaaguugcggugaguugagauugagccacugcacuccagccugggugacugagugagacucugucucaaaaacaaaacaaaacaaaccaaaaaaaaaaaaaaaaagaaaacaucagcauggaaaaggagauguaaucuuauaaaugaaaaauacaagcuguauuauaaucuaguacaaauaaacuucaguugacuauuccaaagguaaauggaaaaguuugauuugaauaucuuauuucugcuccacauauccaugugcaggugcguuuggggccaacagugaaugacaugcagcugacugaccuuguucccaacacggaguaugcagucacaguccaggcuguccugcacgaccucacuagugaaccugucacuguucgggaagucaccuguaagcuacugcuuaguuuuauuucccuucuuauugcugugagcauaauguucauuagaauuuauuucaugugaugcuaacaauaauuugauaauuuauauacaaagucacaguuauuacuuuugacaaucaaauuugagaauaaaugucucaauucuagauuuauggaggcaucucaaauucauucgaggauguguauuuuuuucacauugaacaugccugaaauugaaguguuuuacaaucaauggugucuuacuauuauugcucuuggcuaggugccaaucagaauguacagcauaagacaauggugcaucuuaugaaugauguuauccuagauccaugaaauaugacauauagcauugaugagaaugggaauguugagugaguguaauuuuggaggaagacauuggguuuaauaucaaggugcuccaaguucuuguugauguagaaacucuguggcacauaugauuaagucuguuucaguuaagugaauuaaucaauuuacccaaugcaaagauauauugauccccuauuauaugccagucacugggcuagauguugggaauaccacugugaaauuauacaaagcaguauagaccauauggacuccuuccugguuugcauuucucuuguguguguuggucagccuuuuguguacuucugacuuguuuuacuaagcauuuaggugcuuuuuucuugaagcgugacaaugauugcauuuacccacuuacugccucuugccuuacccagcugguauuuugcuucaugcuuggggagauugacaugcugggauagaugagcuggcuuaaauuuaaugagucuuggcccacacuucugagaaaaugaagaguuuugaaggcacuucaaggaggaaaaagggacuaaggaaacagagcaugauggggcagagaagagaaagauccccuacaggauggguuaguguaaauuaauugacaacaaacaaauauuuauuaauccuccuuuauauguuagaucuugucuggggcuggugguuuugugaaaaugggauaguggcagauggaaggaauggggagucagccagggauagagacucauguucugaaagugcugagagaggagacccaaagucacagugagauuaaaaacaaauauggucacaaacuuggguauggugcuggacuggaacaguagaggaauggagggcagagagagauacacaagauaaaaauguugaagagauggaggcgcagaaauguggaaguggagcuagagaguuaggaagacagauguaaagagucagaaugagagacaaguuaaacuagucaaaugggcagcuggaaagagugaaauacaucucauauuacaggagaaaaucuccucauuccguauccuccuucccccuuuuauaauggaaaguuauguuagauuugguaaacauuuaccauuuggauuuucuucuaacaauuuaggugucuggguuuucuuauaagcuuauuggaugcuuaauguugggcucaucuucauucuucacucuguaacuauuuuuuucugucacguucuugagggugcauaacucuauugauuuuguuuucugucuugaguuaaauaucugauaaagaaacaugagcuguacauuuaugaugaauuaugauuuauuaugggguugagcagcaagagauuauuuaaauaauguggaagaagaguaauauauaauugagaaguuagccuugugauaacaaaaaauuaaauauauucuauuuuugaaaaaccuucuuaagaagaauucagucuaucugguagaaucaugguacuuuuaucaucauaaucauuuuuuucaguuauuuugccaaacaccuuuaaauuuucuccaaacaacuucuugaaagcuugcauggaugcuuuggagcuuugugguugagaagcacaucuggauuuaauaucucgugcuucucuagugccuuuacccagaccucaggaucugaaacucagagaugugacucacagcacuaugaaugucuuuugggaaccugugccuggaaaagugcguaaauauauuguucgauacaaaacaccagaagaggaugucaaagagguagguugaagaugauaguagauaugaaaauauuuguuuuccuaguagguuuaaaaaaagaacuuuaucaaguauggaugauagcauguuuugaauacuugucacuuuguuaacacaguguugaaaacuugugauauuaauaaagcaguuuuugaaaaucaaugauauauuggacugucuugucaaaacagaaauguuuugcugugugauauuaaucucaaaaagaucaucccuugguagauaaaaaguuaucaaaucuaaaugguauuuccuucccauccagauuccuuauauggcuuucuauucuaagaauuacuagaaaaugucauguuucuaaaaauaaaagguagcaagagguugcagcaaugaagaggagcaguuugucagauaacaggaagauaggacacuagagaaggacacagagaaaggagaaguauguuguuagagggguguccuuuugggaguguucuuuugggaguuccgugaugaccggauucaaaguuagagcaaauuagaagggcuucaugaaccagcaaaacuugugugugcuugagggaguauuaaugucagaaucucagaggcauuuuuggaacauaggagucauuucucuaagcacucagugacugguucugcuggucauuuguggauuauacaaaagcuacuuuauacaugugcacacauuuauuucauucugcauuuccauuuaaaagggguacaauggccaguggaucucacaagauucuugugcauagcaaaugaaguaaugcugugcguaagagaccauugcugaaagaaauaaugcagugauauaaagggaaacagguggaaaaaugguuagguuuuuugaauacauaggcaguaauuauuuucuagagagucaugugccauaugaucuaguacauacauuuuuuuuccaguuuggaaauauuuaaacuguguccaguuucuggauucucauguauauuggaaaacacugcucuuuucugaucacaauuuuauauucuuacgcugacagguacaguaaacaacagagagaugucaaaaguaaacccuuuguaaaaguaguuccacugcucuguuacuguuauagguagagguggacagaucagagaccagcacuucccucaaagaccucuucucacagaccuuguacacagucagcguuucugcaguacaugacgagggggagucuccuccagugacugcucaagaaacuacccgugaguugugcuccugcuccacugauaaugggaaacaacacuuuacaugcauguguaacacaauuuacugggucauuuuguuucuuaaugcuaccuuugccaguguuuaauaaugcuuggauucauagauuguuuuucacuuauuuuuuuguaacaaggugucccaucuucuaucuuugcauccauuccuuuuaugauacuuuccaucagccacugucauuaauuuaucuuccaacuacaacuacuugaugugcaccuguguaugugugugcauguauguguaguggggugggcaaguuuucuugacguauguugcacauuugcuuuggaaaagaugcauuauuuauaauuuuuugggguauuuuacuauacgugaaguguuaucaaggguaacaaaauauaagcaucuuugcccucaccaguucaugauuuaguuguggagauaagaaaaaauuaacugagaauacaugggaucauguaagguaggucagguggcacugaaauugugugcugucagauuucagaggaaggggcgacugcacuguaaguggagugcugggggauaccgggcagccugcccagacccugcuuccugcuccgucugcugcagcuccuggagaugucaguuccucucccucucaugguuucuccauaguauuuaacacagucauuauugccuguuggucuuuugcuauggauucuacuucccccuugcucucuccuaaugaaggaagagacauuuugcucaacuuugugucuccagugccuggcacauaauaacuuaauccagugcucagcccauuacauaaagcaaauaguaguaaaaaaaacauugaggccuagagccagcaguguuccaaacaaaaauaaugggaguuuuauauguaguuuuacauuuucugguguccacauuaaaaaaggcaaaaauagauggaugaaauuaauuuugauaauguuuuauuuaacccaguauauccaaauauauccauuauaauuucaacagcuaucaguacaauaauuauuaacgagacauuuuaccuuuuuucuguaacaguucuucaaaauccaguguguauuuuacacuuagagcacaucucaauucagacuagccacauuuuaaguguucaauagccaacuacauguggcuagugguuuccauuauggacagcacaggucuagaaauuuaagcaacuugcccagccacauccaguaaccuauugaugggacugauacuauagucuggaaccuuuuccuccuuuccagaaaauuccucaccaaaggcucaauggcauguucuuuagugcccagcugccuauaccuaauuagggcaucuugucaaauguuauaaccugcuuuuuuuuuuuuuuuuuuuuuuugagacagagucucgcucugucacccaggcugcagugcaguggcacgaucucggcucacugaaagcuccgccucccagguucacgccauuauccugccucagccuccggaguagcugggacuacaggugccgaccacaaugcccggcuaauuuuuuguguuuuuaguagagacgggguuucaccguguuagccaggauggucuggaucuccugaccucgugauccgcccgccucggucucccaaagugcugggauuacaggcgugagccacagugccuggccauaaccugcuucuuaacuucagacauaaccacuucucccuuuuugacucugcuauuuucuuaccaugugagaucucuuagcaauuucauuuauuuuccuggcuuaaguucuuaccuuguaagggucauggcuggagcugagaauugaugcauaugcaucaguagacgacagcuuugcauaaaaauaacguaacagguguagugaacagaaaaggaagucaggaagaaaggcuagugagacagguaauucaguauaguagauuaauauuuuuaauauauauuuucccuuaagauuuccaaauaauuuucagauacauuuaaaguacauucuuaaugcugcuuuguuuugcaguuuugcugguggaaauaguaccacucucuuuaucucaaugggccuuuucauuguaauuauuagaacaaauuuuuaauggcucugggguuuguguaauuagcuuugguuaccagaaaauagagaaauaagugacaaugaaagcucaggaaugguggcagacauaaaaaaaugcuugugcugcaaaacagccagaggaccuggucaauggagggguugugaaaggggauuucagcagucauuugggucuccagguguucaguucucugaacagggucagcauguucugcuucauaucauguuuaagguuagugaucuauaggaagaagcuauguguggguuaccuggaucguaacaugcucagaguuccuuuccuguggcaauauuccuagauuggaauucacuguauguguagcaguauguauguauguucuaaucaauugucagagugcaauacuuuuaguguuguuuacagcuaggcagacauucucauuuuuaaacugcagugguauguguguuuuuaaaaaauaaaaaugaaacuguuuccuuuggguaucagaacaacaaauuaugaacaauaaaugaauaacuauuuccuugagcaucaucuuuaauguauaauauauuagcauaccuaguuuaugacauucucgguuaauaaggacuucuuaacccagagucuaugugugucuuugggguuauugauagacuggagaagguccauuaacucucugauauguggccaaguuugugcuuuguguauuguguauugcugugugaaagaguccauaguguugauuugauucuuaaaaaguuggagaaagguacuaaaugguaucuuaaaaaaauaaucauuuaaauagaauauccuuaauaaccuauuauauccacagaaugcuugcaguuuccagagcucuaggaauuggugaaauauuugguucuaagcaauguauucaaucaguuuucagauguccauuaauauaaaacaaggcaguuuuuauuauauuaaauugcauuugcagcucacauucaaaaacuuagucugcuugccuuuucucaugauaggacccgugccagccccaacaaacuuaaagauuacugaaguaacaucagaggguuucagagggacuugggaucauggagcuucagaugugucucucuacagaauaacuugggcaccuuuuggaagcucagauaagauggagguaguuaacucucuuuaucuuucucucugucuuucaugucccauuuaauuuguagggaagcuuaguucaaagaaguauuacucuuguugucaauaagcauuuauugacauuugagcucaugacaugcaucagagcaggaggaacaucuggcuaaauaaugugaauaaacugccauugaguguguaugauguaaguggagacuuacuuuugcguggguauguuuuuguccucuuucuccaagaccaucuuaaauggagaugaaaacacuuugguguucgaaaaccugaaccccaacaccaucuaugaaguuuccauuacugccaucuauccugaugagucagaaagugaugaccugauuggcagugagcgcacacguagguguuuagcuuucaaauaggacauugauauuuuaaaguuaauuuuuaaaaaauagggcuacagcuauauuaguaauguguucccaaauucuguuuucuuuuagugccuaucuuaacaacacaagguaagaauuuaauuugaugaauuguuugaaugaacaaauaaugaaugaauguauaaaugaaaaguaccauaagauacauaauaaauaggucaucugcuuuuaaauccuaagauguucauugagaacucuuuuacauaggcuuuucuugaaaaacuuugcuuugcuacuacuuguuuuggaguguauugaucagcuuggggugccauaacaaaagauuagacuggauggcauaaauaacagaaauuuauauucucacaauucuggaggcugagaaguccaagaccaaggugcuauucaauucguuucugggugguggcuuuccucccagcuuauagcuagccagccccuuucucggucucucucauuuucucacucucucacguggaggagagagagagagaauaaacucucucaugucucuucuuacaaagacuaaucccauuauggcagccccacccucaugaccuaaucuaacccuaauuaccacccaaaggccccaucucucaauaccaucauauuggaaguuggaacuucaacaugucacguuugcagggacagaagcaaaaugaaaguccauacuaaggagucauuuaagaaucaauaaccauuuuuauuaagggaacgaauuuaauuauaaacccagaggcauagaauucucugauugccuugggagcuguauauauuuuagggggaggcauuguucugucugcuuacucaguuuuucaacaaucuucuuucagcucccaaaaguggcccacgaaaccuucaaguguacaaugcaacaucuaacagccugacuguuaagugggauccugcuaguggucgugugcagaaauauaggaucacuuaucagccuuccacaggggaaggcaaugagcaaacgguaauuuuuuaauaaaaauuauaacuuggauuaauucuaccauuucucuucaaacucuuuuucccccucagugcuuaguuagucauacuuacuuuuuaagggauauuaagauuuaucgcauuggauggaauaaucugacucuuuagcuggcacuccacguggauugccaucauggagacucaauggauguucucaugagagaugauaguuguucuucauuacagccccaaagcaugaggcaugugcuucaaugcauccauaguuccuuuaaaaacuauuagugcuggauuauccaugacgauauccagauaguuuuugagucuauguugaccuuccauuccucucucuaacuuaaucaacugcugaaaguuugcuaaacuuaccuauaauguuuauuuucuauuuaucucauuucccccuguuuuuugcaugucauagggugucuucuagaucugguguuucuagaugugggagccuguuaaccuaauuuacacuguuuuucauuuuucuauuauccaaauggagguccccaagaaagaugguaggacucgaaacucagucuucauccucuuucucuuccuagucuuucccuauuuaauagaaccuuuguccauuuuaccucccuuacuuuaguugucugguuuugggcuuucuacaacuuugccuuuugugaacuauguaauuagaacugcauguauuauccuaggucaggaagccucaugauuuuuacauagguaugauuauguuuucugauucauuucaaaauaaaucuccaguuuuggugagguacagaguuuuauugacuuuuuuggcuagaauauuuucuuauauagccuuagagacacauguguuauuaaccuuuaaucaucugacuugccgagcucaagcaaaugggucauuucucuuaucaguuuagagguauuagccaagguagggguuggcauuaaucuaaggugugugguuaaagaucucugauacuacccaguaaguaagcuuagcugaaucagaaaccuucccaucucuagugugacuuugaguuggucuuuugaggcuuuuauagcuccagucuuagguagugugaugcauuuggacugagaauuugucuguuuuagguaaauagauuauaauuaauaaacuuaauaucaacuguaaucaauagacauuuauaugaaaauaagacaaauuagauggacugauauauuaacuucagaaacagaacuucuuuuuuuucuguggcaugccagauuucgguaaaacuacaaaucaggagaagcuuguucuuagcauuucccaucuugggggcauugauguuccagcugcuucuccuaagucucuuuuacugucuuucagcuguuugcuaucauaaagagucucguaaacuuaucuucuggaaaguaugaagcccuuaagcuuuguuagucuuugggguacuuggauuuuaacacuaguccgugaaaucaugaaaaugaugaauaacugaugcuagaauuauuuuggggagcuggaugggagagguagguagaugccccucugcuuacucauaaaagcaguucuccuaaauaggcuuucagauuuguuauguauuaaguuuuuaucaaaauggcuuauacugguauugauacuuuucucucauaaccucaaauaugaaauuuauuaaaauuagccacgguaguucaguuuguccguauugaggaugaugaccgugauucacuggguuuuucucuggaauucagacuacuugaguggaugagugcuaaguuggaaacaucugguuuguucuagcacauccagccaucuacaugugcacucauuuugggcagugugccauuuucaugcgauuuuaauuaguaugacauaaacaucugaauucgguagacuguuaauaaauuguacaaauuuucuuucaacaagauagcuagauggccuuaaguaacgaauaaaaacuuuaagcuccauaauuagaguaaauugaaaagcuucauaccacggggcugguaucauggagacaacuggaaaccccugauugaguguggccuggcaaaaggucuggucaugucguuaacacagcuaaggcuguuagagugacaguguucuugggggaaacaccaagagcuuuauacuguaugcugaaucauuuuaauguguuucuaaagcaaauaaaaacaucuguuaaaaagguaagaauaauauuaagugguguggagccucuaaaauuaugcaauuguuucauaucuuaaagucccuuuguagcucacuuaugauuagucccccccgcccccuuuuuuuuugaagaguucugugaaauguguuuuggaugaaauuuugcagugcuggcggcuagcaaguugaaauaucuuuuuggggucaccaguuuaaagcuuggaauccuuuuuaugauuugaggugcauauuuuacauuugaaguuauaccacaagguguauguuaaaccuugacugugguauguaauucuggaacuugacaagggucucaaacagcuucccuguagaaagagcuuuuucuaacagauuagugagauggagagagcaaggcugacacuuaccaagacccuuuuuacucaagaccacaauaggaggacggcagaacagugugguccugcagaaacugaagccagacacuccuuacacuaucaccguauccucucuguauccugauggugaaggaggucggaugacgggaagaggcaagaccaguaagugaaaccugaguuccuauagcuucuuuaauagcuacuauuagaauggaaucaucucuuuaucuggaaacacuggggugacacaaaguuuuacuaauauuuaaaaauucauuuagaaauaauauuaauaguuuuuucuuuucuuuuuuuuugagauggagucuugcucuauugcccaggcuggagugcaguggcacgaucuuggcucacugcauccucugccucccggguucaagcgauucuccugucucaggcucccgaauagcugggauuacaggugcacaccaccacacccggcuaauuuuuuauauuuuugguacagaugggguuucaccauguuggccaggcuggucuugaacuccugaccucaagugauccaccugccuugggcucccaaaaugcugagauuacaggcaugauccaccgugccuggccauauugaucguuuuuaacauccuugcuuggaauuacuugucucuguuuguggagaaagauguuacuuucuaggauagaaaggugcucuaagaccaaaaugucuuguggauagaugagacauaugcaucaggcugacgcggacacagugugugucguuuauucacuacuucaacaaauguuugugcggugccugcuauguucuagggugccugggagauaucagugaaucuguguuucaugugugcuugauuguuagcauuauacugugaugggauuucugugcauuucagaaccucuaaacacuguaaggaaccugagaguguaugacccuucuaccagcaccuugaauguccgcugggaccaugcagagggaaauccucgucaguacaagcucuucuaugcaccagcagcaggugguccagaggaacugguaauuauuucuuguaguaaaaaaugcuaguuuguuuaaaugguagcugagugauuuaaaaguggaacugaaggaguuaaccaguuugcuuuagagcugaagaauuucauauucauuuaauaagacuuuauagaggguaaauaguugaugccuuagagccuggguaacagagggauuguggccaggauucuucccccuggccaggggaagaagcggccguucugggaaguucuaaguggggaguauuggauggcuggagggguauagggaaauauguaaccucuuguaacaggucaugugggggcuuauuaugacauccuaauauuacagaaccuacuucuugacuuggucuugaguugguauuguguuauuugaauuauuauuucuuucacaaauuuuucaagucaaugcuuuuuguuuuauuaaaaucuuuagguaccaauccccgggaauaccaauuaugccauucuuaggaaucugcagccagauaccucauacacugugacuguaguucccguuuauacugaaggugaugggggacgcacaucagauacuggaaggacauguaaguaauaaagccaaaaaauuaauuuuucaucauaaguguugcuuuucauuauaaagaccauaaaggcccauuaaagagaauuaggaaaguuuggugugauagaauuaaaaacauaaaaauuagccauaguuuaccuuccuaacaccaaauguuaacauuuugugugaaauaacaaauuuauaauggcaucuucuuuugaaauaauuucaagauuuguaaagguacauauaaucaucaguauacuacuuugcuuaaucucuuucacugacaaaaauucauugagcuuugcuuucugcuuuauaaauuguugugaaggacuuuacaauuggcuuucauagugcgaauuguugaaaucuguucggcacauuacuuaauuucauaugucuuugguuuguuuguugaagugcuuuuuugaucuuaaaaucuguaugcuuucauuuaggaagcaguuuaugugguuuuacuguuuuuuguaguauugcuuaaaggcuuuugugcagauuuagaaauauuucuuuggcuuuaaaaauauacuugcugauaguuaaaaggaaccaagcaugaaugucuucuuuugguuagggauuaguggucuaggaagaugauguuauugguuaaauuagaguuuggaauuaguacaucaauuuaauugguagguuuuucuaaguuccuauuggggcaguuaauuaagaacuggguauaucuuauuuuucucuccuuuuaccuuuucuauuaaucacaaaguuauugaguagcaauuuguuaaaugaagaaguaaugaaugguugaaacuagcugacugaaucagaugagcucaauagcuguugucagauuuuacuuagaaggcagacucuuaaaaaaugucucuucuuccucucuccauuacuuauguuagaaaacugaaacuacuuuuccuauuucuuuucucuaucccaugacccuuuauggccaauccaguuccaccacguuuauuagcuuguuuuuaauugaauacaauguugcuuccuuauagacaaaggccauacuugcuaacuuuaacuaaauuuggguuuggagaguuuuaaucugccuuuguguguagguaauuagaaguauaaagaagauagcauuuuauccuguuacagaauguagguucuggaaaagugauacaaaagcuugagauauauaaacagacuuaaaaaauagauguuggccuucauuuccucagugaugagaggacuggcaagaaauguccaaguauacaauccuacaccuaacagccucgauguucgcugggacccugcuccaggaccugugcugcaauaucgcguuguguauucuccuguggauggcacaagacccucagaaucuguaaguaauuuugucauggaaacugcauuuccuggugaauguagucacauguuugugucacguuugauagccugggagaacacaaaccacaaacaugccaguguauaauacuuaaauuauuguuuuugaugacuugagguagguguauuaauuauaggguuaguaagaauaaaaagaauuuugggaaaaugugaauuagcuggaugaguuaaaaaccccaguaauaaauguaaaucauugcuagaccuugucaauaugucuuuguuaugaaaauaguuuaaaguuuaccuucacugguucuuacaaauugcccaaucuaucuuucauucauaacauuauucaguuuuguaaguagacuaacaauuuagaaaucagaaauugcuaauuucaauaagcauaguaucagaauaccuaaaggaaaauaaaccuaugaacuaauuugacuuauagucuuugcaaaaauaaacaguguugacaaagauaaacaaaugauuaacaauauaugcauuuggcaagaacacugauuuucaugcccauguaugguaggacauauuaagacaacuuuaccuguauguauuguauggagucucuauuucaacacaaaaucucccccaccacaauaagaguuccuauucuuguguauuuaacaugcaggauguuuuuuggggaaauaucaugagcuuugcauguuauauuugagaaucuuuauaacaaacauaaacggagauaacugaagcuacuaagggucaaggaugaggucacuuuuuuggaaagggaauuucugaggacaaauuuuguuuaaugauauggucuggguggaucuuauggagaagcacaguuggcuucugaugugucugggcucaacauuuuauuauaaauacuauugugaugacuaacugaagacuugguaagcauuugaguuguugucaggcagaauuuggcauuuccucuccugcagauaguagugccaggaaacacgcgcauggugcaucuggagcggcugauuccggacacacucuauuccgugaaccuuguggcucuguacucggauggagagggaaaucccagcccugcccagggccgaacgcgugaggcagaaauccuuucuccauuccauucccuuguagcuagauuggcagggcuucucugauugaaugaguggugggagggggguggugagagaugggugcuuucugccugggauccccuacauuuacauuccaggcgaaaacauugggucugugacuguuguuugugugacgugaacuucuucuguucguguucucauuugggacaugaguuaaggagggguuucuccccuuuuuccccucuucugcucuguaucuucuuuuuuucccucuuucuacucugcagugaaucaucuuaccaaauggggacuuuggaaaugugaggguuuagucuuuauguuuuauugaauagauauaguuauagugguuaaaauaaucccccuuuuuccuagucuaccuuucaaagcuagcucuaggucacugaaaguucagcauguaaccauagcucugaaauacacuguuuaugauuucacauuaaaaccauaaauguauauuuuauuauaugggaggaaacaucugagugaauggugaaugaaacacaugcaagcaaccuccuuaaucugacuuagguaaugcucacaggcaggcaacaaacucuauuguauuuuauuuauuuaguaccacgcaguggaccaaggaaccugagagucuuuggugaaacaaccaauagccucucgguagccugggaucaugcugaugggccaguucagcaguacaggaucaucuauucucccacuguuggugauccaauugaugaauauguaagucugauacucauuuauuggcacauuuuaucaucuuagcugaauggacagugaaguuaaacuucuuuagagguaugcugugaguacgguugaguccuugauagucacacuuuaggauuuucucugacaugacguugggaccacccaaaugugcuuacuuagucuuucuggccucccauaccacagagaagcaaugucuuugggcucauuuuuauucuaaagacagauagaaaaacuaucuuaucacaugauuaacugagcauuucuaaccaccuaaugacaccacaggaaccaaguuuagugaaaugugauaccuaucauucuggaaugucuaaguuaauauucaaauaauguauuuauccaaaucuuacccuuuccucaaaucuaauuccucuacaaggucucccuuaaauauuccaguguuaauugaucucucuuuucuuuaaacuuaacauuuugcgguacacuuuaguuuuggaauauaaauacucuccuauuagcuucaaacuuuuugagugucauaguuugucuuuccagaaccagauucaaguuucugguagcuuccucauagcccucacuaugcacauccauuuguuaugaguggaaaaauggaaaaacuaacugcuuuauuugaaauuuagugauuaauugcugugauacauuugcagaauauugcacaagauguugaugguaaauuaggucugugguuugccaucuuuuuaccacauagaucgucuuagauaauuuucccucccugagccccaugugaugaaauauuucaucuacuggaacuugauauaguaaccuuuaauucaagucccuauuuuuauuaauaagaaacacauguaacuaccauuuauaguuucugaucaaaaugagauaaacaguacuacuacaguuaguuugccaaagcagagaaacucaugguuaguguuuguucagccuugccauggacaaauaugcaauuucccuuuacuuuccgaaaacauuaaaaauacaauuuaucauuuguaguuauaggacuccaggccaggauucacuggcauaccuuauccauguuguuuguagaagcaaagcauagguuuagaagagagauugagaugucugguucauuuccucuucgaagagguaguugaauguauucccaucuguuucagcuaacuagugucagccaaacugauauuuuugaggccagaaaguuagucaauuuuugcucaccaguggauucccaguagcuaauaccugucccacugugccugguccacagcggguacuggguacauauuuguacaugaaaauggaacaugugaugaugagaucugaaggaaacaaacuuacuacugagugcuggaauacucaguaagguguucugaagcacacauggcauugcuuuuaauacaguuuucuucaaagauguuaagucacguggcuguuaaguggcugaucugggauuugaacccagagcugucugauucuaaaaccacucuccuaugcugcagagaagaagugaagauaguuugucuugucacgagcauuguguaacaaaaauaaaaugugaaaaaaacuacuauuacuguuuaugggaauacauaaaacaauacugucuuuugaucuggaagucuucuagaugguaauauauuuauaauuuaacuuccucuauagaccacagucccaggcagaagaaacaauguaauacugcagccccugcaaccugacacuccauauaaaauuacuguuauugcuguuuaugaagauggagaugguggccaucuaacaggaaauggaagaacugguaaguguuuuguacucccccuuuuauuuuugcuuugaaauugucaauauguuaauguugcuuuuauaccuuuuaaaaccuaaaauuuuaucuuuaccaauacaucucaaauaccacacuaauauuguauuauuuuuauuagacauuaaauuuugucaaaaugaugacaugugaaaggaauuuguuuuuaacuuuuuaaagguccacuaagagaagaaaaagaagaccauguacauauuuuuauucgcuuaagauaguuuuauuucuucuuuggaaaacuauugcauauucucugaauaauguuucaacugguauggugucaguuaagacuaaauuguuaagucaauauaguaucaguaagaaauauuccauugcgauugaaucuuaagccauaaauacagaaaugagaugaugagcaaucauuuucugucuacaaauuuagcuuuuucuaaaaaagaaaaauguauuuuuuauuguacuaagcaauuugcauagaauuaucaauguucagacccauuuuuacacuauacuggugguaauuucuuaggguuuaaaaauucucuaaugugguugcuugcuacagucaccugaggagcuuuaaaaauacuuacgccuggguuccacucccagagauacugauguaacuaugugaggugugggcuggaccugcugauguucuaauuaaugugcagcaauggcugagagccacuaguuuagcauaaagguaggaugaacucuagaucugaguuuuguuacugguagauauuugcauugcuguuuuacacuucauucaccaaaaaucuacuuaaguaacaugacuucaggugucuuucugcagucacuugccaaaagucuuuuugugcuuaaaugaucuugacaacauuacagaauuugaagaggugacauuugaaagcuccuaagggaaaagcaggacuagaguugacucagcucagucucucaaggucaagaaucuguauuuauugauauuguugucuacagacugagucaauggagacucacaugacucaagaugauuuuaacaaccucacuuuuuaaauuuucucagauuuuagacuauauuuugggacuuuccuggggaaaauggcauauuucagaauuucaugcuaucaaaguggauuuuuuuuaacuagaucuuggauuuuccaggaagggccaaagucauguuuuguuuuucuuaugaaaaagaaguuuuucaaguuggauucguuauuugcgcaaugcugugaauaguaaacucagcaacuacuuaacauacuaccugaacagcauugauuuuauaaguugugggcuugggggcaguaucucuggaagcuuaaggauuuauucuagguaauggugguggaggauagagagguacagggaaaaaacauuauuagguagcuggggugguuuugggcaaauaauaucuuauguauuugaugaagugguuggacuagauaguuucuaaauugcuuucuguuuccaacaaucuguaauguaugacauucuaaaaaugauuugagaucucuuuuauuuucuauaauccugagucauagaacacuuccgcucuggauacugcuuccugcugagaaggcugcucuggaaaucacuaguucuugagucuauuugaguugcuguuuaaauuuggaaaacuauuaagcauuuuuugaauacuucaaugccuuuuaauuguuuucuggauaaagacauuaugggauauuaugaaauugcucccauugggcuuuccuaccgauacuuuuaaaguuuugugcucucccugugugccaauaaaaggucaguaaugugugucaauguuuguuuucagugggacuccuuccuccucagaacauacacaucucugacgaaugguauacaagauucaggguguccugggauccuucaccuucuccaguucuuggauauaaaauaguauauaagccaguggguaaggaagugccuuugucaucauagaaaugcuuuggaggguuauuugcauaugaggguauuuucucuuucaucccccacuguuggguucuccugagaguucagaucacaccaaguuuccuguaaccaaaggcaauguuuuuggcaauaacauuuuaagccagucaucuaaaguaccauuguuauuauagguguagaugagauucuuauuaaaugucaugauuaaaaaguuugacuugguucauaaaguugcacaaaucaaagaugccugucuucagacauccuauaugaucaugaaauaaugcauauuacaucaauauaccuauguauuuuucccacuaugcccagguauuauuuuauuuugggcauagauuccaugcagcuuauucaugacagccuugcuuucaaauccccucugaaaauuucaccuaaauuaguaucaccuugauuaaauuauuuguuauuuuuguuuuaauauuuugucuguauucuuagagaaacuggaagaaaaaugcagauuucuuagggcaucuuccauauauccaguaagaguaugaacuagaaaaaacaugaaagagagauggcaagauaaaggaaguaaaauuugaaccuauguaagaaauagaaagagaacuuaaaaaagaaagugggguugguaacuaaggaguuuagcagccaaaguauguggaaugagguccaagauagaaauucuuaaauuaucucuacaauaaaugaaaaagugucaguuggacaccuacuauaugcaaaacacuauguuggcaaaauagggcuugagaaagaagcuugagaauucauucacuaaagaaacauugauuauauaccuacuauauuccaaauacugugcuaugcuuugagaauaggagggugaaggauucagugucugcuuacaguuucauauuugucauauaacauagcaugugccccagugaguaaguguaugaggacuauggaauuaaucguguucauaauacccuuugacuauaagaucuuuaauuuuaagcaaaauuucaugcuauugauggcauguuucuguguauuuuugugguuguuaauaaagguuccaaugagcccauggaagccuuuguuggagaaaugacaucauauaccuuacacaaucucaaucccagcaccaccuacgaugugaauguuuaugcucaauaugauucuggacucaguguccccuugacagaucaaggcacuacaugugagucauggauauuuucaugguugugagaaaaacuguaguagaaauuaccaggucagccuguuuuaauuuccuguuucugaacauauacauguuuccucagcauuauguaggcaggcuauuuugugucugguuagacaaaauaccuauucaaauacauaaauauuauaauugaguauauaaaaauauauauggugagaaauuuguguauuucacauaaaauauuauacuuugaauuuuaaaagauaaaaauuauagaaauugucauuuuauccaugaaugaccuguaaaauuagaucugugaugcuacuuaguucuucuugacauuugauaccaagauauauauuaccuaaauucauugauuuaauuugacuuaauuauugaaucaugauuagugugauucaguccacagauauauuuuaaggucaccauugcuuugauaacuauuuaacgacuuagcagauagccuuuuagaaauuguuuucauuauuuuccaugagauguuuuugaaauucuuaguuuugagagggacuauauggaauuuccuuuccuugaaaaucagcgaaagaaaggggggucuauuuuggcaguaccacauuuuuaaauaugauucauguauguuucuuauaaggaaacauaauacaauuuugaacuuuuuuuuagccacagugaaaguuugaaaauuguguuaugauuaaaaguacacuuuuugccucaauuuacaaaguaaaucucuuucuuucuuuauuuuguaguauauuuaaauguaacagaucugaaaacuuaccagauugggugggauacauucugugucaaauggucaccucaccgggcagccaccuccuacaggcuaaaacuaagcccugcagaugguauguguguaaaaaagaaaaaaaugaucuggagcauguaguggaaacauuuuaaauuucaguaaagaagaugccauuuuguuuauaacaaugcgauauaaaauuuucuugaaauauaauuggugaugacacuggcauuuuccuuuguugucauaaucaggaacaaggggacaagaaauuacagugcguggaucagaaaccagucacugcuucacuggccuuucaccagacacugauuauggugucacuguuuuugugcagacaccaaaucucgagggaccaggagucucuguuaaagaacauaccaguaaguuuuugaggaaucuggaaagcuuucauaaggcuuuagaauagaaugcucuagguaaggaagacuuaagugaauccugugcagguaccucuccguagggguagcaauaaugaugggaugauggcagauuccugaauguggagucuaaagcugguucaggaccuuuuucuguagcaauuugcaaguugucccuguuauugaguuggugcuacuuugaggaagggcuaaaggagggagagauggcucucgcugagaaggugaauucauauuagugacuuuuacucauuugacccuaucugaaggccuuacauuuucccuuuagaucuuuauuuucuguagcuguaguggauguugaaugacuaccagugacaucaauuuggauggaauaaaauccccagcaugucaguaccgaugacaauggugucucauuuuguacgacuugauuugguauccaggauuuaaauugcucuuaaaauuuacuuucugggauaucaaaugugcacaugguguguuuuuauaauuauuauuuuuaaauuuuagcugugaaaccaacagaagccccuacagagccacccacaccuccucccccucccaccauuccaccagcccgggaugguaaguacagcuaaauaggcaauacguucagcugauagggaguuacagacuucuuauuuacgcugcaugugcaucauuuacaauuaauauagaacauuucugaucuauuauugcugcugaagaguuuuuagauugaaagaaaagauaaccaguaauuuguuucucuccaucucugggcacauuuuggugugaauaaaaucagucauaaauuauuccagaucuucagcuggaagucuguuuccucaguuuuacagauuuaggucuuccaugguccauaguuacaugguggacauuucuuucugcuagcugcuggcaucaguaagcgcugugaacccuuuuggcuauauuugcgaccgaagcccugaggcuguuggcuuuaaaauuccugguguccaaccugagaaguucccuggauuauacaaugcuaaaaaauuuuccauucaccaaaauuugaaagauaauuguaacuugcagugaacuggugaaacgacauacugauuuauuaagguugaucucucagcauuugagggcaauucucuagcacuuugucaaauuaaauuuaguuaaauaacuacuguauuauucuuuucucauaugcuguuuccagcauuuaauagaaagcauuucagauauuuuuauuuuaucuuagaaggaugucgaacguuacaacuucguuaaaccuauuauauaaguaaaauuaaaaauuaaaaguguauuauugugggguaaaauaauaauggauuccuuuaaauuagauacagaaagaaauucaguaaauaaucuugguuuaaaaacaaguuuuuucuuuuuaaauaggcuuuauuuucuagaguaguuuuagguucauagcaacauugcagggaugaugcagagauuuuucaucucccagacagacugcccuuccccacacaugcccagccuccuccacuauuaacaucccacaucugagugguacguuuguuacaaccgaugaaccuacauugacacaucaucaccacccaaaguccacaguuugcguuaggguucacucuugguguuauacuucuauaugcuaaguuuuuauaaacuaaaauuuuguuaauuguuuuuggaauuuuuucuuagccucuaagucuagauauuccaauaaaaaucuucuccuuuccugcauaugauucuaguggcuuaauuuaaauuuuacaaaggacuuggccaggugcgguggcucacgccuguaaucccagcacuuugggaggccgggacagguggaucgagaccaucauggccaacaugguuaaacccgucucugcuaaaaauagagaaauuagcugggcgugguggcacaugccuguagucccagcuacucaggaggcugaggcaggagaaucacuugaaccugggagguggaguuugcagugagccaagaucaucacaccacugcacuccagccugaagacagagcaagacccugucuaaaaaaaaaaaaaaaaaaggacuuauuugcauaaagucaaucuuuaauaauuacauuucaaaucuccaaacuuuuuauuugauuucuccucucauuuauuguucaaaacuacuugaagaguuccauuaaguaagauuguaucuuugcauaauggaucuaaacaaauggaguaauuccagagcagguauugaggguccccgcaaugcuucuuaaauuuauugugcaugugagucaucuuauuacugcugguacugauucaggaagucugggguaggacccaagauucugcauuucuaacaagcucccaggcagugcuguugcugcagaaccacacuuugcguagcaagguguuauauugcauuuucaauuaugugauuucauuuaaaugaaagaauucaugagauuuggggcuuccucugcuuucuuuuuuugcaguaugcaaaggggccaaggcagauauuguguucuugacugaugccuccuggagcauuggggacgauaauuuuaacaaaguuguaaaauucaucuucaauacugugggaggcuuugaugaaaucaguccugcugggauucagguuagugucauuccgccaguggcuacucauuugugaugucuugccuuuccuuugaacuucucuuuuuaaguaaaaagucuuuucaauauaaacucuguuuugaccuucuccuauuugcuauuucuuuuauucauguauuuuugggagggaauuggguauaaaugauaaaucaauagaaaaauaaauguucccuuaguuuuuaucuuuggcuagauaauauuccuguuggagaacuuaggggauucuaagggacucuaacuuccugcuuaaaacuuccaaucaugacacauuucuauagaaguucauccaaaguucuggauauuaaauucuuugugauugucauccccugugaaguuagaagaaucagugauaaacagugacuggaguggguguguggaacuugcugccucuaucauuacuuugcagauaauuaccuugaccagaagaagguccauuguugagcuaaagcguauuucauuuguuuuuuuaaaaggauaacuaccaauuaucuugcucugaaaucacuccaaauauauuuguuauacugaaguacuuagagaaguuuauauuuccaugagggaggggccucaaagaauaaaucaucauguaacccuaacacaguuaaaagacccaauuaaaauuucacccccucuggugagguuccaugauggcuuuacccauuccaugcuuuugaauuauuuugucuauauugcugcauuacaacaaauaucacuucauauugucauuaauugugugacucuguucugucuaaucuucuaucuaaaucauugacuccuuaaagcagaagacuaucuuuuuaaaaaacaauucucuccuuuucuuucccauuucuuuggugaauuuucuucuuuauuuuggcaguuugaucaucauuguggcauuaugaaaauaagcuauuuugaaauaaaccacaaacaauuucaucaacaaaacuuguccucuuuuauggaauaguaguauacuaaauuucaaauccucaaauaauccucuggacauugauccaacccaagaagaguaaaaauucacccuaguuauauucuuaauuuaaugugguuauauucuuaauuuaaccacauuaauucaacuagcaagcuuuuuucauccuuuuaggaauuuguauuucuaaaaaaaauacugaucauauuuuauuaacaucuauguaccaguuacuuuguauacaggauuauuagucuuuaaaacaauccuagaagguaaguauaguuauccucauuuuacugauaaaaaaaauccauugucacauagcuauuaaaugccagagcuaggauuugaacccagcgauuccugaguacaaagucuguacuuuuuccacuaaaucccauuuucaaugagguugugaugagggaugauuauaaucacacaugugacauuucuguauugccauaaagaacggauauagucagugggaaguagcaguuggcugagucaacuguuuaaccaacauuuggauucgagaugguauguucucaugucuaauccugggaucucaccacuccccaccuuuauucaucccuuucuauguccuagagaaaggcacaacgugaauauaguauauuuucauuauuaaugccaauuaugacaauuucauugaagauugaaaauuaacgaauuuaaugagacaagugcaguagauguuguaauauuagcuauaaagagcuuacaauauucuaucaggucugagauacuuuuuacacccccaccgcuuuauuccgcagcuagagaaucauuugaagauugaaacauaaaaugagaugacuuaugcucacugccaaaucacauuuuccuucagguuucauuugugcaauacagcgaugaggucaagucugaguucaagcugaacacguacaaugacaaggcccuagcccuuggggcccuccagaauauuagguacagaggaggaaacacaagaacagguauguguauauguagaccuuuacucuucaagcauuuguaguggcagaacugaguguauuaucucaugcugauauccagauucuuaucaguugggugugacuaauggcauuuggguaguuuucacugaagugacacuaaaauuuuccaugccacauucuguaggcaaggcccucacguuuaucaaggagaaagucuugacuugggagagcggcaugaggaagaaugucccuaagguguugguuguggucacggacggucggucccaggaugaggucaagaaggcggcuuuggucauccagcagucaggcaagcacauacaugaauuugauugcacuugaaauuuuaacauuuuuaaauguucacaaaugauugcaaaagacuaaauuugcugauguuacuuuauuguuucuguuucacucugcacgguauaccuucguaaugcuaguuuauauuuaauuauggaaugguuugcaacugcucaaaaaugacaugggguauucuuuguauaagaugugguucaggauugacaaggggcaaaccacauuuucccauacuggcuggaaggcuacagaaagcaaugauaaugagaugaugcuagagcaggcuuccugccauagcagaaaugaaucuugauacugcuuccugugcaaggagagaaaaaaggaagccuuuagcuuuagcacaucuuugcagaugcagacuuaaugagugcuaaaagauauguugcaaauaaggaguauugaggucuuagggagucaucugugggauagaucuugccaaucaaauauacugagagccuccugguaacacuguucuuuggauuaguuauuuaagaucauuagaggugaaaguagaucuuuccaguacuugcauuaacagccccccuacccccugcugucccaagcaaggucuaagguggauauauuuuuagagagaaucuuaugcauaauuuguuguaguaaauuauaaaguaauuacauggaacuugucaucuguacaugcaugauucuuuggcuaaauuuaugaguuaugauuagugcuaagucauacugucuuuuuuucaauagagguuguucuugcugaucuuuuauaaaauguauugccauuauguuauacaccuuacacagauuucugcauguuugugacuccugguagauuuaaguuugggcuuauaaauauuugcuucucacguuaccuuauuuauaucuaaauauauuucuaauuccuuauauagcuuuuuuuccccugaugucaaauuuagcuuucggagugaaaaaugugcuuauuugucauagccuaaauuugcuuauuugucauagcccgucuguugccagugagaguuguagauuccauuuucaagauggccagaguucugccuuugagccugaguuuccugagaaaaucaguuucaagaacccagauuuuaaaauaagcccauucuugacuucugagucacauaagcuuaaaauauuaauggcugcagaacucauguguguaucaggacuguggaucuguggaaggcagugugcaccacaugaagucuuucugcuauuaaaaucuuccuauuugaauuguugggauuuuaucuuaggaaaucaaauuaaaugaauucuuuagaccagaaaauagaaagaccuggaaaaaguauguauuuauuaaagagaguucacgucaaguaaaaggacuugcugcauacauuaagaaaauacagcaucauuucugauaagaauuuuuuugcauuguucuaacaacaaggacagaaaaagagauacgugauucauucuauaaaugcuacuuugcaggguucagugucuuuguaguugguguggcugaugucgacuacaaugagcuugccaacauugccagcaaaccaagugaacggcacguguucauuguggacgacuuugaaucuuuugagaagaucgaagacaaucuuauuacauuuguuugugaaacugccacuucaaguaagucacagucaacauggaucuauaaccucacuuauucugaaaaacaauuacuuaguagacaauucuauauccuuugugggaucaagucugugcauaaauagauccugggaaaucacuugagaaccugaugaaucacuguuccuauugcgaucaugcuaaaugugugcuugucagaaauccauuuuuagccuugaauauguaauuuccuuguguggaaauaaaguguuucaauauauccuuuucccaccaccccaaugccuaugacauuugguuaaauuaaucucagccucaaauugcauauagaaggcguuucugugagaugaagguuuuccccauuaguaaucaauugguauuuguucugucaacauccgugcuucaagagagcaaugaagaaaaaugguuccucagaaauucauuugguucccauuuguuuguuuggguuuagauuuucaaguucagcuuuuuaacuacagugaagaaccaaaaauugauuauuuaagucgauuuauucuuaucaccauccauuaacaccaauucuugggguauagguuauggaggcaauuaauccuccauaauuaccaggaggcaauuuauccuacauaauugaucaggggucuguggcuaguccagaccccugauccuagacagggcuaugcuuuacaaauauaauauuccccuccauuaaacauuauuuuaaaaacaagaacucugguuagaguaaacagacuuuguugguuuacuaugaaaauuuaugcugaaguucggaguggagcugcacugaugaaagugaguagggggcuggagugguuucucuucugucccaaguaguccuggaugcagccaucugguacccucagcucugagggguccagagcaaaaacuacugcacacuuguuacuguuacaugguguuugguagccagugugaggcuuggagacuuggcagagaagaggguuggggauggacaagcuccuccuaccuuugcagaaaucuaaaauucccugggagggaaguucuuuaaaucuauugaaaaaugugaaaaauuccuccuguaauucuuuuuuauuauuuuuaagaguacuguaaaaguccaauuggauuagagaauguuagggaaauauuuguuacacugguuaauaguauuucuccuacacguaggaaauguacaagaaauaauguauaaaauauuaaauugagaaguuauuuuaauaaaugaacaaugucauuuauuacuugaaauacguucauugcuacuuucugugcauauauaauuuguacaucguguuggugaaucauacuuaaagaacacuguacauugcagguuguccucucauuuauuuggauggcuacaccucaccagguaagcauuuauacuuuggggcaaauuaauuuccagauuuaagcaauaaaauaauuaaaauguacuccguuuaauauuuucuuuucugauguaaagguuuuaaaaugcuugaagcauacaaccugacagaaaagaauuuugcuucuguacaaggaguaucuuuggagucagggucuuuccccagcuacucagcauacaggauucagaagaaugcguuugugaaucagccuacagcguaagugugacaacaggagguuuuccuuuucuuaagaccugcaaaaaguucuuggaauauuugcugacuucccagaauccugggacuuuagaauugucagaagacugcuuauggaugacccugauugguuuucuuaaauacaguuaggcuaauuguuuccagguuacauaguuguuugcacacaggagacuaagacucaggccucguuauugccagauccaagaagcucaugcugguaacagauuacugacccuuuugaauuuaaggcuagaaaagcuguuaaaacaggaaggcaacuuaauauuuugaacaucucucucuguggugcagaauacuggauggaauaagugcagaccgagagcauucuuuuuaguguuuccgaccucuagaaaaugaaagguaguguuucuuguccaugaucagacaguuggcauguaguuuuuauuggcugaugcucuagcaaucuguuguguagcuguagauguuauuuuacuucaugaauguuugcaccugaguaugauaacugaacucuguauuucuuauucauuaaaaugaaaccuuuuuaugcugaaaaauauguuugccaauuuauggaaagaaaagaacaaugagaaauuaagguauuguaagcucaggacagggucaggaaugaugucugaaauaugaaaugcucugagaaagcugauggaaaauucagacuaaaaccaaagcuaauuuauuuuaagaggcagagauuguauuguuguaguuugaccacauuguaagucucuaacuccuuuaaugguuaaccauguuggcucggaguucuagguuuuucagugaacuguaauacccaguguuuaacucuuccagucagcucagcguaugauuucuacauuuuaacuuaugacagccuauuguuuucucaagcaucagaacuuuuggcugaaaggaaagaaacauaaauacaauuacauaauuuuuucacaagcacuaauuaaggaaggagaaaaaugggcuaggugagagaugaguugaugugaagaaaauauuuuuaacauagaauauuauaaagauaguucuugaacguauaaaagacaucaugucagcuuacccagagcauauguuuuaaaagcaagauggcauuaguggugugguauuaggacaugaaagcuuuguguccucuaucaaaauucauggaggaauagcuucuuuucuaugagcuuauuaucugguucuuuuucuuaccuucagggagaaaguguuauuaaauguucucagauagaaaaccaucaauuccacuucaaagauucccccagaacaaugauugacuaaacucuggagggacacaugggaccaauuuuuuguuuuuuguucugucuuacagcugagggccaauaaacauuuccuuucaaucaauucccauccuuuuaucaucacuaaauguuugcacauguauauggccuucauauuuaaaauggauuuuguuuuugggaauauaugagcucugggggugauuuauuugauuucaggggagaaauuuggaaguguaaaaaguauuacugauagggagggagagagaaauuaaaaccuuaagccauuuuaugaucucauacagcugacauuggaaauuaaguauauuuaguaagauucauucucuuuaaaugauacccauagucauaauguuuaucauucuaaaauuaucauauaauuuuauaauacucugugucuagaaaaauuaguuauuaauaguaggauaaaagacuauuuuguaauuucccagacuuuugugacuuuaucaaauuagaaguaaucgauuauaauuuacauaacuggucuuuagugcuuguucuuuugaugugcuuccuaaauuuuucuccuucuaaggagaagucagaaggagccagauuaguauaaauagccucuaauacuacccauaugagauucuggugcaaagauuuaaaagaguaucuguucuugauguuaaagcaaucaaucuuucuuucuuccuuucuuuuuuucuuuccucuccuuuuucuuucuuuuguuuuauccaacagagaccuacacccaaauggacucccuccuucauacacgauuauauuauuauucagacuucucccagaaacucccagugacccuuuugcaauuuggcaaaucacagacagagacuacaaaccacaaguuggagugauugcagaucguaagaauuuuuaucuuaaggcacaugcauacuuaguuuugauuauguuuuucuuuucucuuuuaaaaaacuuucugaauauagacuauauauauauuuauuugauauauacuuuuauguuugaacuuuuccaaguauaacacaucaguaaauauccuaauugcauuuuaucauaacugaaauuauuauauuuuuaaagaaaucucuccaacaagaauuauuugcuaauacuuuaaauaaaaauuauacaaugcauaugauuuaauaacacuuuuauguugauuacagcuucuagcaagacguuaucauucuuuaacaaggauacaagaggcgaggugcaaacuguuacauuugacacagaagaaguaaagacauuauuuuauggaaguuuucacaagguaaaaacauaagauuauuugagucuuauuucuagaaaaaaauauaaaacaaauuuauuauuuauuaaaaugucauguuaaauuggcagaauuauaacuaugucuuuuaaaaauaaaaucuuguuuuagagaauuugguuaauucaaauaauauuuaaaauaaaacaauauacuaaucaagagauaacgaguaauauuuugauuuauuuuuaaugcuuauuucuuuuuaaaauuugaaucauacuauauauaacauuauccaccuacuuuucugcuuaccauuugguuaugaaucuuuauguuauuuaguuugaaaagcuuaauuuuaguggauuauguuuuaauugauaauauuucuucugcuugcuuuuuauugaaaaguacaaacaugccagugaaaugcagaaauugauauuucuucugcuuguauuuuauugaaaaguacaaacaugccagugaaaugcagaauaauuauuuuuaucaauccaaaaguuaucaauaucuaccaaaauaauuaagauaaauguuuaugagauuaauuuuuaugugaacacacuuauucuuuaaaaacacaauucucuagaaaaucuuauuaaaaguucuaagaugcauucuagggauugucuauucuugaucaucuuaaucaauuuucuguaugucaacauccagcagauaguagaaacuuuuuuuuucagguuucuaaaggacaauucguugacaaauaagaagcacuucuuacuuagaaaauacugaaguuagaagcauuagaaauaaaaagaacgaucuagguuaggaauggaaguuaggaauagacuuuuuaaaaaaacuucuauuuuaaguucagggguaugugugcaagaugugcagguuuguuacauggguaaacguguaauggggguuuaucauacagauuauuuugucacccagguauuaagccuaguauccauuaguuauuuuuucugauccucuccuuccuuucaccugacacccucugauaggccgcaguguguguuguuccccuuuauguguaggaauugacuuuuuaauaguauuucuucauccauuggauuauguuaacaggaauaccaguuguugcacagaugcuuuaaaauuucuccaguguggcauguagaaagauuagcccuuauacauaaaagacagauguuuccaguucaagcugauucucaagugaaaauugaagaaauuucuucuaccugaguagauuuagcaguauuucuuacuguuucuacuccugaggaaucuugcuuucuuuccagaguguuguucuuauucauuaaucagauuuuugauaaggaugguaaaggacucuccucaucaagcuuaaggaagcuucaauguacauauuagugauaacaaaaaaaaaaggaaaaacaaaaaucccugaguacaaucguauaucuacuuaaagguuuacagaccuccauagugaagugcaguaaaauaaaugccucaucagaaaagcaaguucuacuuuagcaaguguuauuggcuucaacugaucuuuaucuguucuuagauguugaaucuggcaaaggucugaugaacuuuuguggcucagugaaacuuacauuugaguaacuugcuaaaaaggacuauuuuuauuuuuccuuucauaaccacugaagauauugagaaucugaucauccacuaaaccacugauaaccauuugguaacuguuauuuuaaaauuuccaacugucauggaaugcuucauuuuaucuaaaaauuuuaaaaggcaguauuuuuuagaggucuguagugauauuaaugauugcaaaucagacaauuuuuuuugacauucucuucuuuauaccauuugccuccccagaaaggcauuugcauucuuggguuuuauauaaugccuauuuuuucuccucacaagcucugucuuuucuuuccaaauucucuaccuucuucuuuguuuuuuauuuuaauaaucuuucuuuuaguuucuccuuuuuucccacugugcucuuuuuucuccuccauuccuuaaacccguucuuucuuuuuaaacagcuuuauugagaugucauauagaaaaauuguauauacuucagcuguauaaugagauguuccgauauacacauacauugugaaaugaucuccacaaucaagcuaauuaacauaucuauuaccucuacaguuaccauuguguguauguguauguguugaaucaguuuaaucuaagaucuagcaucuugcaaauugcaaguauaaaauacccccaucccauugacccacucucaucucaucaauucaaguaccaccuucaaucacucucagcuguucacauuuuuuuacugagccaaggauucaagcacucuuucuucacuuuccgucuaauuccugaauugaaguuuuucaaacuugggaugagaaugagcaauauuucaagagcaggaaauuagugacagggagagggaacuuuggggagagggauuaacuaaaauaguuuaauuaaggaaugacagacaguuauccauuccuggggauucucuugaaaagcuuuuuuugugucucccuucuauuguugaaagaugacauggauucaugugagacauuuauaauaagaaagagaacuagaauggcagagucugggaagggagaugagugacaagagggucccuauuuuuuucuacuggucugggaccaacaacacaucauuuaggaaauagauugguuacucuacacacuuggcacaaugaucuacagaugaagggcccaaucugaaauguaacuaugcauuuguuuaaacugcaguaaaacacacugaauaccuuauagcaaaaugugcuuuuagaauguguuucucuaugguuagcauucaaugacaaguguuccuggaauaauuuugucacaaauuaaaaauuuugaaauaauuuuucuggauacugugguuuuucacaugccuugucaauguuugcaucugugguuguucauauaugagccaaaaaguuuugguucuuauuagauaaaaaauauccuagcaugguguucuucuugaguucaguauuaguugauuguccugggggcauuuaaacuuuauuuuugguaaguuauguauuacuuuuauauaaaagaaauauggaauuuauauuuaucacagaugcaguaaacuuaugguuuggcggugauuccaugugggaaaaauauuuaguuuaaaaauacuuuagaaauuauucuuaugcuuacugacugagagcauuuaagggaauuucuguuccuuuuaauuugcugccaaacuuuucaaagucaucaucaagggcuuacuugaguauuugugcugugauaaguagaaacucugagcauaacuauaaagacaaggauuacccaggaccauucuuuacauuguugaaauacaaacauuuuauuaauuaucuauacuaauagaguuguuaacauucugugugucuucaguagcaaacgaaaaauaaaucaauauaaacuucuuuccuuaaaagaaaauugaauccugaauucuaucgauuuccagaguugaaucccuauagaagacaugugcuaguucuuuacuguaugagguaucuauaugguaugcagauuauuucugccugagauuggggaacaacaaacugaaaguugaauuuaguaaaauuaguggaagacaucugaaauuucuuuguagugaauauaauaguauauacaugauuuauuaaccucuacuuggguagcucuuuauagcuuacaaagucauuucaucuacuauauccucucuggucaucucaguaagaguagauagugggaaaauaagaaauuaugcaaguguauguguuuguaggaaacugagaccagagguuaaguggcuugucuaauuucauauuauuagcaaaugauuucaucaacauugccaacugcucuuggauuuucagaguaagacuuuugauuuaggaugagaauagcuuaaaaaacuucaaaaaaaucugaucuaaacuaugcagagucagcuaauuuuuuuaguguagaaauuuuauaauggaaacaaauuaucuuuuuagguucauauuguagugaccucaaaaaguguuaagauuuacauugacugcuaugaaauuauagaaaaagacaucaaggaagcuggaaauauaacaacugaugguuaugaaauucuuggaaaacuccuuaaaggggaaaggaaaucagccgcagugaguaacacauuuuuauuucucuugguaccuuguguuaagauugaaauggcauuuuucuaaacaacuccuugaguuuuauuuuauucuauuuuucucagugaguuuuaaguugucaaauuucuuggucagaucaaaacauuggaagaaguacauugagaaaauauguccacagaacauaauaaugugcuuuaacuacuugcuagaaacaaaauaagaugucaaggcaccagggaacaccauguagucauuuugaaacaggaucaaauuggagaacaccacacaaagaguugccaacauacccagugaaauagaaaauaguuccuauuuuguucuucagcaauaauuguuaauacagauuuguacaaucaggauauuaagcauuuggggacacuaguugcaacuuucaccagagcccacauuugcucacagaggagccauucggcugccuguaucaaaaggaucaguggaguagggcagccagcugaccccauuacucacaacuuucacuaucucagguuugaggcaggagcgugccaaccccauuuacaaugcuaucuaauagggaaaauuuaaaucuaaaguugucaucauaccaaguuaauuaaauucauauuaaaugucaaucaaagccaggcaccauugcucaugccuauaaucccagcauuuucagaggccaaggaaggagaauuacuuaaggccaggaguucaagauuagccuaggcaacauagugagacccugucucuauaaaaaagaaaaaaaaaaaccaaucagcugagugugguggcaugugccuguauuccuagcaacuugggaggcugaggugggaagacugcuagagccuaggaauuugcagcugcagagagcuaugauggcaucacugcacuccagccugggugacagacugagacccugucucaaucaaucaaucaaucaaucaaucaaugucaaucaauagaccuauuguccuaaaagcaaagcuagccuguuuggcuucuauaguuauuauuuuaaaaauggcuuuauuuauuuaauuuagcuuucuuccauggacaggauuuucuucuagauucaaaaggaaaauuuuuauuccacaauauagaaacaauuaguucaaauguaauagaauuuugauuaaaauccaaaccuucuguugaauauugaaucugauauuuaaguauaacaauuacaucagguuuuuaaaauaauaacauugucuaaacaacuuuuuacuuuuuaucaaaagugguuuauuuuuaaacuauagaaagauauaaaauauaugcuaucuugaaauaguugaggauaucagaaaaguuauuggucaagcacuugguaauaauuucuaaaaagaagagcaucaauuguagaauaagugaagacuuguuucuuuaauuuacuuuaauguuacuuuucuauaagggugggcucuuaaagcuugauguaggcugagugugguggcucaugccuguaaucccagcacuuugggaggccgaggcggguggaucauuugaggucaggaguuugagaccagcuuggccagcaugguaagaccccgucucuacuaaaaaaacaaaaauuagcugggcgugguagugggcgccuguaaugccagcuaauugggaggcugaggcaggagaaucucuugaacucaggaggcagagguugcagugagccaagaucacaccacuauacuccagccugggcaacagugagacuccaucucaaaauaaaacaaaaacaaaaaacaaauuugauugaaaugugugugggcuucaaauucauuuaauuauagaaauuaauauucucuuaaaaaauaacacaaggcugggcaccauggcucacgccuguaguccuagcacuuuggguggaucacuugaguccaggaguucaagaccagccuggccaacaggguaaaaccccgccucuauuacaaaauacaaaaaaauuagcugggcaugguggugcacgccuauaaucccagcuacucgggagacugaggcacgaaaagcauuugaaccugggaggcagauguugcagugagccaagaucccaccacuguacuccuaccugggcaacagagugggacucugucucaaaaaaaaaaaaaaaaaaaagaaaaagaaaaaagaaaaaaaaaaagaaaauaccuaacaaacaaguggaacaaaacucacucaaacauugcauuucagccaaagaggugaaucaagagugggaaucucacauacaccuuucacuuuucuaucucuuucucguagacauauguucaaacaugcauuuuggccaaagaagugaaucaggagugggaaucucacauacauguuucacuuuucuaucucuuucucguaggcauauguuuucauggucuuuccucaugaaguaaggaucacauugcucucaauggcucacacccuugagagaguaugugugagaaguuggcaauguuaaaauguggaagugccaauauaaaauguuuuucaugcaucuuuagcugauguugcuguugguuguuugcaguuccaaauccagaguuuugacauugucugcaguccaguguggaccaguagagacagaugcugugauauucccucuaggguaaguaaaacagaauugaauucugccauggcuuuaacagucccccaguaauaaacccuugugccugggagaggaaguagcacugcacaguuguauauucaggauggagcuaaaagacacgcaaugugugggugcucaccagcuacuacagaaaagccagugccugugugaucccucccucacaagcugguaauacacagacuguuucugggacuucucccuaagagaaaaguccugcugaguuaauguguuugauaagaccacuuacuguaaagcccucuuauugcuuguaaaguaucagcauuuuacaaaacaagccagcaccuuucuggaugacuaagguuuuuuagaugguagaaauaaccauauuauuucuuuuugagaugaugacuuuucuuuaauaguaucuauguaggugguaauaguuacaaaguugaacguuggugauggauuugaagcuuuuggccagcaaagacccacauacauccacaggaagagugugcauuauuuauucagcaaauauuuauugagcaccuauuauacgcuaggcaccaaucugugugcuuguguuaagccaguaaaaagugaguauuccagugaaaggcacugggagagaaagaauuaauaaggacauauauacuauauuauugagugaaaguccuaggaugcauaacaaaucagggcaaagggacagacagugaugguagguaguagcagcccucagugauaaggggagauuuaagcagagaccugaaugaagugaaggacaaaacaauguggauaauggagaaagaggaaagaauuuuggauuuuuuuccagaugggaauugauauuugagguacacaacaagucucuaacacuggauuagaggaaauuggauuaaauuaccagagaucucaguggucuuguaaacauuucuuugucagugagguuuccuaacguaaugcauaaaauaaagacauaaaggagcacagcaaguuucaacauaagacuauucauaaugauaauuaaaauuauuucuuuaaguugggaaacagacuuccuugugcauguaaguggggguggggaugggaagucauuuuuuuccucuaaauuuaaagguaaauauucuuuucaaaauuucagagagaugagggaaaaugcccugcuuuuccaaauucuugcacauguacacaggacagcguuggaccuccaggaccuccaggcccugcaguaaggaaauugaaauagauccucugguuuuuccuuugaaaucuuuagagugauuaucuauuugccaauauggagucaguaaaauacuucaauucauccagguuuucuaggauagagcaagcuaaauugcagaccaucuuuuuaguauauuuggacaucugaaauggaguaaaucgggaagaauauuugauuguggcauuugacauauuucuucagccgugcaagaaugauaauauuggcuagucuuuaggagauuuuuucuuaaagauaugaaccuggauuuccaucuguaauuacaugacugaaaauuccuuacgucuccugaaagcuucuuauauguuugguauaaagccacagcugagaggcugacccaagaacaacuuguugagaaccuagaacaugugcaucuuauguagcagacauaucaugagaauaacauauagagaggguaauuuacacaugugauaucauaaacucuggguuuggaauaacuugagugagaagacuaugaccagauuuaugcauugguugggagggaaaaccaagaaagugcaaggcaaaacauugaagauugcagugauagaguucauugaucaaugugaaaccccuugaguuagucgauccaguaucugaucugggccaguuuugaggauagcucuaaucucccuuggcuucuuuuaagaaaauauguaauuaacacaggaggagcucagggauucacagaacaugaaaauuuacuauucuugggucauagcaaauaauguagaccgauuuuagguuaauuacaagccagcuccucauauauagaaucaaaaugucacugggguuaccauucuuuuuuucuaguaacagugauuuauauuuauaaucaugaaauuauguccuggaugugacuuagauguuuuugagauguugggauuuuuuccccuguaguagugagguaacaugcuugaaugucacugugauauuuauuuccucuuuguucaguuguuucugaauuccuguuaaguacauguucuaauacucugagcgauuuaagauacucuucuuuuugcccaucauuuuccccaaggaauguaauucacauaaauccaaagcucauuuuucucuuuauuguacacaaguaguauaauguuugcuuuucccaauaaaccucaaauuuucaaaugaaaauuugaaauuugaaauauaauuaaagacacucagaauguacaaaguuuugaaauucucuugccucgcauauuuguaugacaugaaauauuugcuucaguauuuugcaagcagcuguagaauaauaauugucuggaaauugcacuuuuucuugaaggacuuuuuguauaucaacuuccuccuauuuuccuauguucacacuacuaugugcucuauguauuuuagggaggaccuggugcuaaaggucccagaggugaaagagguaucaguggggcaauuguaaguauauuuuagagugcauuuaaauucuuaucuauauguugaaaucugguuguucaaauuuucacaaaggggguaugugaucuugagcaagucagcucagguucagugugccucagguaauauaauuaccucugucuuaucucuggaugucauaaugauggauuagacuagccagagaaagaaaugcauaggaugcaugucauagcuguaacaauuacacauggggaagcugcagaagaucuuuaaggccuuggccagaacauggggaagcagaggggguacccacaccccacagggagcagagacccgcuagagagcuggagccuguugggagcacuacugcugcugcuuuuuucaccagucucagaaaaaaaaugcugaguggcugcguaugugcucacaaggggucaccugccccuucugccagcuccacacugguuuucuguaagacaacucaagcuucucaggggaauauuuuaugaagauaauguguaguuuuuggucauaauauaauuaaugauaaaauaaccccauuaggaaagggcaagauuaggaugcuaacccaggccugaugccaagguugugccuuuuccaucuagacagauuguaaaagagcuccagcacagggcaccucauccaugggcaucuuuucuuuccuugcuugauuuauauauccuuuagucccagaaauaagcugaagucuaagagaaaugaggacuagcuuaaaauaaaucaaauccagugaaacuuaagcauuuaaucucauauaaaucuaugaaaauuaauauaugaauauauuauaugcaauguauuuuauuuaaaaaaucuauuucuaauaggacuuuuauggaaauguaaguguucuuguaaauuuaucguacuuuucaauaguaaagggaagaaauuacauuaaugaauauauucauagauguagauucuuaaaaguuuacaaagauuauaugauugaugucuuagaguuaugaugacaagugucugacuaaaugucagcacugaaaagguauuacauuacuuugugguugucucucucuuguguauuuuaggggcccccugguccucguggagacauagguccuccaggcccccaggguccuccaggcccucagggacccaauggacucucuauuccgggagagcaaguaagcacaaagccuuucuguauuaaaugagagugguggauaaacauuuaguuaaaugaaucuuuucuacauuuugccaaaucaaauguuuucucagauaauucaacgagguuagucaccgagauagcagccucuaugaugacuguuauuuuagauacguaaauagacuauguaauaauauaaaacuguguagaaaaaauuacugcuacuuauuugacuuuauuaaacauuuucuuauaaguaaaguagauauccccuauguuaaacuauauucuuuuaagguagguauaauaucccauaauuauauaaaauuaccccauaacauuguaaguagaaauuauaacacagcauuuguaguuuaaagagugagcauuaauucaaaaaagguuuauucaucuccuuucaaaaauacccuucugugcucauucugaacgcuuacacuggauuuaugaagugaugaagauuucauaagugacucaugucuuccuuuuuugcuuaaucucugugaaacgccugagaacuguuuucccauugcucacucuagggucgccaagggaugaaaggugaugcuggagagccaggacuuccaggccgaacagugaguuggucucuaaguugcccugucaugugcuauuugaaaauuuccuuuucuagugccucaaaaggugaacccagauuaaguagcaaagcagaagccuggauauguguuucaccucauuuccauuucauacccuggucuuaaccuucaaguuggugcuauucaauucagguaucugcuuguugacugagcaucuacuguaugcuuggcaaugugcuuggcucuguucuccuguuucuauucagagucucuggaauuaaaaaaaaaauuuggaaaauaacaaagauucucucccacacaggaaguauauuauaauguuucacuuguuuguuuccuucugugcagggaaccccaggauuaccuggcccaccaggaccaaugggaccuccaggagacagaguaaguuuucuugagcaggcuacaaugauguuggaaaugaugucauaugguugccuauuaauuaagaacccuucaaaauccaguuugcaaggcugguaauauaucuuguggaaagcugcaaagcugcaaagcuaaugucaguggaccauccaacaucagaucaaucucaaggucuuugaaauaaaguggugggacuccaggggagucuuugaaauuuuaauuuucagaaaauuucuuaccauaucauauucauaaaaagaaguccagaaaaggaauuuuagcugauuaaaaagagauucaagaaucucagcaaauuguuuuaaaucuuaaaauuaaaaucuuaguugugaggcagcuuuucuguaaccaugaggguagccuugacucccauagcacuuucuacaaacucaagacauccugucuacaccuuuagaacucaaauaccacuucuaggccuugauggugggguagacagcugguauuuaguagggaauuugccuguugguagcagcuuucagguuuggucuugacuuagcaugaaagcaguacaggaaacccagucuucucuaggauaaguuaauaagaagcauggugaacaugaccucuauguucuguucaucaauaaugugaaauauuugguuccauaggagaccacaaaugcuuuaauaaaaagaacccagaaauuuuaagaguuucucagaacaaaggaacuaaugacuuuccagcaucuuaugguuccaauaauagucugagaguaguuuguauuuugauuaaucaaucaaguuaaaauauaugacuagcagcaggaucugaggaagccaguacuauaacagcugucacuaaacauaaaucuaucaaccuuaacaccuccaagacaccauugggcagagagguaggccauucagagggagcaaagauuugcccuaagauaauacaaaaugguagaugauaugccagugaacuuuauuuguucccaugccuccuuuugaguuucggggagagaaaagagagaggucaaagagaaaacuguauuuucugggauaugggauguggagguaguucugacauacacaucuucugacucuuuugagacuggcacuuuagguuuuuuuuugaauucuuauuuuacaguaaaggacaacagugagaguacaugggugacaagucagucuucuuuauuagaaaauaaaccccagaauauugcagcugagaaguggcaaugggcugacuugcuugcugcugcuacgaccgaagccuuguuuccaucacauccaccccaaugugggcuucaugcagacacacagcggguucccuagcacacuucccagcaggacuaucuuucuggacuggugcucagacagccaucaccaucaggcagcauaauugcaucccugaaaaguaagggacuggaagggacugugcucuuccauucucaaauucuaaucuguguccagcuuuguggugaggccacccugggaugagggcaagagaacuuuucaggaaacuguucucccuuuuccuucacagccuguguaccuaccuacugcuuaguaaacuaccacuaaugcaaaaaggagggugcauagcuggugggguaucaacaauuuuagaacauuagagagacuuugaguaugggaaucucagcugaaacaaaacaaaacaaaacgugaacucagugguggaagugaagagaaggaagcacaagagaucaaggccaaggguuguggugaggaaugaagacuuguuagcaggaucaaguagggagaaacaagauacagagauugucuucagcagagacgauuuuugaaaugaggcacagugcugguggcuauuagaaaguaaaaaaagaaccacauauacagguaucuguacauguguaucuaugaaaauggccaucagucuucucagcccccucacuugguuagaaguggaaauaacugcuguggcuugcagcaaaaaaugaagaauaaaauaaaauuguggcacaaaguucugcagauggcauaguggguagccuuuuugaguacuucauaauaaaucuucuucacuccaauuuacgaauauauuuccucuaaaaggaaaugguugaucagaaaguucuuagacugacuaaaggaggauuaauuauuuagaaauacaauauuuacgauaaaaaaugaaaaagaacauccuauauaguaguuggagaaacuuggguggaagaaauuuuauucaaauuguccaagcaauauuauagggaauuuuuuucuuaaguggcccuuagaagugauauugguguuacaucagauaggcuuaggaucuguuuuuuguuaaucaggccuagaucuuccggaaaacaaucugaaaucuuaucccuaaaaguuucuggaaaaaguuuuuuuuuggggaaguggaauauuuccaacaaauguaaaaagaauaauuuaaacuucuaugguaaagucaauguacuaauaaaaaguguggauaguuaauucaggaagagcuccaaauggucaacuuuugugaaaauccaagaauauggaugaaaugauuacuuucauucucugcggaaaaugagacaaaaaucucugacagaggaaugcaacaacucuaaaaaaugaccugacucagaaauccucggcuggauuucagagaucugcuguugcgagugaaugcuaacuggguagcaggaugacucauuccaggcagaggucauuuggcacuguacagagagagagaaaaaauaacauauaaaugugggcgcacgagccagagaucaagccuguggggagaugugcucuguuccugccuggugaacugaugcuuaggcaguucuggccuuuguguguauugaagagagacagagcacuacaaaaauuaacugcuuauuaucaggauugaggauuuccucucuuuugaguggagggcaguuaagacagcuuuaccucuguuuuuuuuugaaauagggucccacugugucacccaggcuggagugcaguggugcgaucacagcucacugcagcccugaccucucgggcucaagugauccuuccaccuuagccucccaaguagcugggaccacaggugugugccaccaugcuuggcuacuuuuuuucuuucacuuuuuuuagugacagggucuucuuauguugcccaggcuggucuugaacuccugggcuuaagcaauccuccugccuuggccucccaaagugcugggauugcaggcaugagccauugcauccagcccagcuuugccucuuuugggagaggaagaaagaaauucaccaggaguggagacauaaauaguccugcucuaacugucugacaguugcucaggaaaugaggaagggaguuuucuaauuagguggucaggauuuuccauauagacuucucuaugucuguauguauggcaggguaugaagacuugagagcauguguuaaaauaauuuuauuauuuauguuuaauguauauucuuagauaagggcgaauuuaaauguguaguaaacuuucauguuaaguauuuacuacagagcuuaauauuugcauauuugguaaaggaauguuuuauaaaauuugaugauuccaucuuaaggaaauuuuaggcuuuagaacaugauguauugaccaguacauauuauaaauauucuauuaaauauaugguuaaaauaucuggaagcugugguaaaagcaauagggagaaauucuuauuguuuuuuuggggcuaaagggugcugauaugauggaagagaaugaaggugcagagaacgcaccaaagggaaaaaugaauuucuaagcugagaguccaauucccagcagacaaaggaagacucugccaccauaguaucaucuuuuaugauaccgcuugcuuuucucaguaacuuuccuuuccucucaccugcauccuuccugggccagccuguggacauugacuuuuccauagaauggguaaaucuuccuuuagacuucuuuaugcuauuacaaaaacaaaaaauaauaucuucaugaagggaaucugccuuccugggagaagauuaguuuggcucuuaaaauuguuuuauuuauaacuauacaagugaaugagcauagaaauuaauuauucaguaaaaggcauaaguuaaacugaaaagauuuuuuaauuuuuuaauuuuauuuuuuuugcuguuugucuuuuuauugaaagcuuaccucccaaacagcauguugggcuaaauccuucucuucagccuucagcuuuagcaaccuguuuagcaucuuuucuuuucacuugcuuaugaccucccuaacuguaauuacuuucauuuuuacaauagggcuucacuggaaaagacggugcaaugggacccaggggcccaccagggccgccgguaagaacuaaaugugucucauuuuugugcccuucacucccacccucucaccucauuuugcuaguaaccugccuuugaagcacauuccaucugugcuguggaguauaucauugagggaacuguguuuuuauuuaccuacaucaaaaugugcuagagaaaacagacguguuaaaauacagaaucuuucaguuuaaucaaguuacacuugagaaaaagaaaaagaaaucccuaacuaacuggcuaccagcugguuggugccucaguuucuucaucccuacauuaagugguuggguuuuauaaccucggugguucgguuauuuccuguuacagaauuuuuuuuuuuuuuuuuuuuuuuuugagacggagucucgcucugucgcccaggcuggagugcaguggcgggaucucggcucacugcaagcuccgccucccggguucacgccauucuccugccucagccucccgaguagcugggacuacaggcgcccgccacuacgcccggcuaauuuuuuguauuuuuaguagagacgggguuucacccuuuuagccgggauggucucgaucuccugaccucgugaucugccggccucggccucccaaagugcugggauuacaggcgugagccaccgcgcccggccccuguuacagaauuuuaagaaucugugccuauaacauuuaaauuucaagaacuuuauuauugaacagccaucaguuguucugaggaagucaguuuuaucuacaacuaaaagggucuucaacguaagauauugggaaaauacugaaacuaaugauuuugaaacuggcaucuguauacuugcauccaggugagaucgcaguaaaauuguuugaggugauggauagccuccaugucuguguggcaggauacucaagagcauauguuaaaauaauuuuauuauuuauguuuaaaauauagaucuuuagguaaugggggauuuaaaugcacagcaaacuuucauguuaaguauuuacuauagagauuaacauuugcauaauuaauggaguaaaggauugcuugacaaaaucugaacauuccauuuuaagaaaauuuuaggcuuuagaacaugacauauuggccaguacauauuauaaacauucuauuaaauauagggccaaaaugucuggaagcugugguaaaagcaacagggagaaaaucuuaugauuuuggugggguuaagggugcugacaugauggaagggaaugaaaguguggaaaaugcuccaaagggaaaaaugaauuucuaagcugagagugcaauucccagcagacaagggaagacucugccaccauggugcccaacuuagcacaaaacuggccaccuucuuaauucuucuccagccuaaauuuucaaccucuguguuuugaaagauugucuggucuuguaguaggaaacuuaaaaaaaaagggaauugcuuucugcacauccacuuuguaaccaauuuacuaggaucauagucuuaaauugugaaacugauuauauacauaugcguguauuuuucaacuggucucaaaauauauuuuaaaacuauauaguccauaaggauugcacuguaguugucaagaguuuuuuauuucauguuaucuuuuuuuuuuuuuuuuuuuuuuuuuuuugagacggagucucgcucugucgcccaggccggacugcggacugcaguggcgcaaucucggcucacugcaagcuccgcuuccuggguucacgccauucuccugccucagccucccgaguagcugggacuacaggcgcccgccaccgcgccuggcuaauuuuuuguauuuuuaguagagacgggguuucaccuuguuagccaggauggucucgaucuccugaccucaugauccacccgccucggccucccaaagugcugggauuacaggcgugagccaccgcgcccggcccuauuucauguuaucuuaaaauuugguuuuauuuuuccugaauguguaauuaugaguuguuucauuuaaacgcguuuaaaacaggcuguauucauuuacuuuagaugggauuuucccuuugucauaacaguccccuucccuuuccauguguuguagggaagcccaggcuccccaggagucacaggaccaagugggaagccaggaaaaccuggagaucauggcagaccaguaagcggacagcuugcaugucuacugacagugguuucaccguggaaauaaauaaugagaacugcaaagcuuuguuauauuuagguuaucucugcuguaauguguuugaagcauuuguugaaaccaugcuaaacucauggauuugacuugguacuaguucaaaauuuuucucucuggguuguuauaauauucugggaugaaaauugugguuacuggguuucuuuaaaaggagaaugggauuaugagccaagacacauauuucugcgcuguauaaacacucagagcugggucagcaaaaugauucuuuuuacuuaggagugguaugcugcuuaagauggaaaaauacaugacgauggugcacagcgccuccaucccuagcuugcuaauguuaacccuuuuguggcauuauccagcuuuccauuuguucuuuuguaucuaguugaggaggcuagaacaucagaaccagaauuaaaauuauuuauuaacuuuaucauuuuacuuuuuuaauacuguccugccccaauuuauaccccauuuaacuuucucuuaugcagauauuuugguuaaaauaauaguugagauaguaguacacauauuuaguauuuccaaauuaguaucuccaaaacugaauuugaaguuucuaaaauauacacaaauauuuguaaugaguguugggcuucauauuuuuuacaagcuuuuccuuuuuuuguauuuaugaagugugaauuuauuuaagcaauuuuuuuuguccaaauagcauccugaaauauaaaaauuuaucuuaaagacaauuaaguccaacuauuagcagugacaaaaauuugucagggcucuucucuggacagaauuucuccuuuuuaaagcauuguucaaauuuuacaaacccgaguuaaaaaaaaaguaauuucagagagacuuagaauuggacauuuaugugauauggcuugccuuguaugauucauaaaauuaagcaggcaacauaaagauagaaggacuccugauauauuagguuaaaaagaaugacaaaaaccauaauuacguuugcaccaaccuaaauacuuuaaaaacugcguguacccuagcaugugacuuuaguacucucuuuuccucaauggaucaugguagaaacuuugcaagugcaauuauaaguauaugaaacuuuucuacccauucagcauuucauuuuguuuuacuaugaccucaguagugucuuauauaagaauauuacucauauaauugauggcuguagcuagaagccuaaaagaaaugucuacagcuauuacuugaaauaugaucucuaaauaucggcaauaaagaugauuucuacaaaucaugaacaauaggacaaucucagagugccaauaaauuaaaaaaaaucagaacaaucucaaaauagcaguaaauguaaaaaauccugcauuuguaaaaugcuccaaauacaauauguguuuccacaaaaauccaauacuuuuggcaaagaaauagauaacucuaguuuuucuuacgauaauuauaauuugguauacauuuauuuagaccccagcacuuccccuuuucuccuucauuuuccucguccuucaaaaguagcaaauuuccucuuuuuuucuucccuauuuuaucuuaccuuccucuaauuaaugaaaccaaacauagcauauagguauauauaggucuuagcagagagcuuggcuuaaucauuguuagcuuaugucauuagcuauuauaaucaguugauaucuucuugcuaacuuauaguaccugauauucuauaggagauguuuccaugagauguucauagaauacuucauuaguaaacacauauuuguuuagugccuacaauaugcuagccaguguucuagggucaggugauauaacagcaaacaagacaaaauucuugccuucauagacauucugggggguauauagacaaaaccauguaaauauagguucccgugauaaugaguguuaugaagaagaaacagaguaagggguuagagaaugauugugcuggugggaaggcagcuauuuuggauacagucaucuaggaaccucucugacaaggugacauugggaugaaaugagggagaaagcuauuugaucuauggaaagaggguuccaggcagaggaaacagcaugaaugaaagccuuggcugaggaacgagacugacaugugaaaggaacauccaacaggucuggguaccaaagugaagggaguuaaauggagagggauaaaauaugaggucagauagcuaggcauagaugaucauauggaccauguagcccaugauaaggaauuauuauuuuccucuaaaucugaugggaaugggauggguggcucuuagagccaaaggaguuacaugaucuaauuuuucuuuaaaaaauaucauucugguuuuuguguggagaauagacuauaauguagcaaaauggggagaagggagagcaguuaggaggguauuggaguaguuucaggcaagagucuugguuuggacugcagugguuuccauggggauggugagaagugauuugucaaugauuuagauguuccuucggugauagcaguuggcagccuggaaauauauaacugaaagacaaaaacuuguugcacucuaaggaaaacuuuuccaauaucucuuauggugagaggcuuaugacaguguagggacaaauauucuaugcuuguauuuagauguaggaucagauugaguuauuuaauaagagaaaaacccaguuucuuuuuuuuaauuguagaauauuuuuauuauuauacuuuaaguucugggguacaugugcagaauaugcagguuuguuacauagguauacacgugcuauggugguuugcugcacccaucaacccaucaccuacauuagguauauuuccuaauguuaucccuccccuagccccugaccccccaacaggccugugugauguuucccucccuguguccauguguucucauuguucaacucccaauuaugagugagaacaugcaguguuagguuuucuguucuugugauaguuugccgagaaugaugguuuccagcuucaacccaguuucuuuuaucucaaauguacaaagaaucacuggaugaaguuaagggauauauauugagcuaagcugcugacaacagccugcugguucuuagugagacugaauggagacuaaucucauggacguuccacaauaagcagcucagauaaccaacuaugaugauauaaagcaaaguauggcgguacaagggcaaucuucauauguauuuuaguuccauauguaucaugaauugcauuguaaaaagugugcaugguccauaacuuuuacaauugugaccacaaaauucacaucugugcacuauuuuggaggacaugugcuucagagagagagagagaaagagagagagagagagagauuagauuccuuuuuauagaaaagcagaaugugaguaacauggauauaaaugugaugugucauuuugcuaaugcuuuagaaaacagaacuuguucucguucaucauuaugucuauucaugcaucauuuuagaguauguuugucaguuucuaauguauguaauucauauuuuucaggguccaucuggguugaaaggagaaaaaggugauaggguauguauuuuuaaaaaaucuuacguuuauuuuguguguuaaacauugaagccuaaaacuauagaacuaauaugcuaaucauucucauuaauucaacaagggagacauugcuucccagaacaugaugcgagcaguugcaagacaagucugugaacaauugauaagugguaaaauuucuuuucuuuuuacuguaugaauuguuuuaaaauuaauugcaggaaaaugcagaguuugagucaugaaguuucuaagagauagauuucucuuucauuucauuugauaagcuuuuguucuuauacauugucaguuuuguaucugauuagaugaaguuaaugauauuuuaaagauugucacuaagauaaaauaauaacccaagguaaaauaauagcaguaaacuuaaguacuaagacaucagauauuuuaaguuaagaucuuuaagucauuuuaugaccuuaaggaagggggcccaccaagaugaauuugaucagugaaaguugauuuugguaggaaacucucucuugccuguuuuucacaggcucuucuuauuccauaaggccuguuaaguaaugaagcucaguaccugcagacuggugugggccuuaaacccauaacucacucuuagagaagucuuaaucaauguuuuccaaagugcgguacugaggaacaccugccuuagaaucacuuauguugcuuguuagaagugaguuccugcaccaugcccuaagcuuagugaaucauugacuuuggagauaaggcccagaaauacagauuuuucaaggugccccacaggcaauuccaguuugcacugaaaccugauuaucauugccuuagauauacaaaaaauuguagaauuaucuaauuauaaaaaagguuuucuuuugagugaugucaccugguaaaucucaagacuuuauuucagagccauauuaaacuuuaacaacucuuuuauauuuguaguaauguuuguggcuuguaggucagcauuuuguggaaacaguuauuuaucagggaccauuuuguccucgaugauuagacugucuuaauuuuauuuuuaggauucuaauuagauuguuuccuuagagggguugcagaauggagauggauuucacuagacacuaagagaaaacaguuucacucucucauccguccuuuauuggguuucuuacuaacaagccuuauuucugcuuguaggucagaugaacagauucaaucagaugcugaaucagauuccaaaugauuaccaguccagucgcaaccagccaggcccgccggguccaccgggaccuccugguagcgcaggagccagaggagaaccugggccuggggggcggccaggcuucccgggcacaccagggaugcagggacccccuggggaacgagguaggcauuucuggcuucuguauugggauaaaggaaggaauuugcaaauguaggaguugggacagguugaaggcaucugaaaggugaccuaggcaaacugcuuucccuggucuuguuuggacagccucagaagagcuguuaggcaacucauaggccauagagauccaugucuuagaaaaaugguauguuuuuaucagaucucaguaaagauaaugcuauuuucugacuuuuguuguuuuuaaugggaaaaacucuaucuuggcaaacuaaaucagcuacccaaaucuuauuacucucugugacugcggcaagagucgagcagcaacugaauguucuuaggcagcccuagaguuuuagauccaacuuauuuugguuccuuuauucagggucuggcacuggucuuguauguuuguuuggcucuaauuucaugguauagauaacugcaguugaaggaaaaggagaaaaacaggacuauuugauuccagauauuucaggauucuggguauccacuuuugucaaaggaguacuuaauacucuagagaaaaccuacauauuucuauaauucuacugguuuggcugcuguacuaauagggcuacuaaagauaaaauaccuuuaauauguuuuucaaugagauauuauaacaauuucuucaggauuacuguuccuaauuacuauuuaaaaauauauuagacauguuuguuugcuucaaauaauuuuuccccugccuuguagccaaauuuuuucuuggccauaaaucuagaauuacacaaaugucuagaaagaacuuggcuuaaagagugaacuucugugaaaaauuagguucugcuuucacuaaggaaaugaauuacuugaaucaaauauuaucaguuaagaugaaaauuacaugcuuccagauaauuuuuccccugugcuuucucuuuuucucccuccuuagguuugccaggagagaaaggugaaagggguacuggaucuucaggaccucgggggcugccuggccccccagguagguuugcuaguauuuuaaacaggcaaagacuauaaauaccgagagggcacaccaucccgaagagauucacaacuucauccuguuauucuuuuuuuuguuuuugagacggagucuugcucugucacccaggcuggagugcaguggcgcgaucuuggcucacugcaagcuccaccuccuggguucacgccauucuucugccucagccucccgaguagcugggacuacaggcgcccgccaccacgccuggcuaauuuuuuuuaauuuuuaguagagacgggguuuugccguguuagccaggauggucucgaucuccugaccucaugaucuucccacuuuggccccaaagugcugggauuacagaagugagccaccgcucccagccaacuucauccuguuauuauagcauaaagcauucuuauuaccauggcauauguuuuagcaagaaguucaaccuccauaacuucauuuucauguucccuuuguuaaaaaaaugaaaaguuucuauuaggcauuaacuauaacauuaauauaugaugaaaugaauuuuagugacacaaaggguuacuauuuccccuuucugucuccuuccuuccuucccuuuuccuuccuuccuuccuuccucccuuccuauuuguuuuuuuuuuggccucauagacuuuaaagaugguuauauuuccuguuuuuuccaguagucuucaauauggggcuauuagacugagaaaacauagccucacuaaaagggccugagauauugguaaauuucauucacugcucucccaaagcauuuuuauauuuuggauaggacuacuacaugucugucugaugcauuuuguuuacuagguuguaaaugauuucuuuuuucauuauaaggcacaugauacccuugcaaccaaggacagcccuauggcuaaaucuuuccauuuauguuaacuauaacuauugauccagaaacaauauugcuuugcauaggcuggagguguggagcagacgcugccuucuuuugauggcagcucaauguagcugcuuaacagagcuguuuccuucaggugcucuuuucucugugagagugggagcaaaccaaagaacucacugauaucucugguuuggcugaauuuuugcuaaaucagguuuucuggaauaaaauacuucuggcauuaacucugaugagucacugguaagaaaguuccaucacaccuugguucauauuggguauuucuuaaggaaacauuuucuuaccauacaauaguaaauugucuaauuuugagacaguggaggugccacuuaaaguauugguggcuaccucaggaguuguauuugacaagaggggaaauauauuuguuuuaacuccacacuagguccacaaggagaauccagaacagguccaccaggguccacagguucaagaggucccccuggccccccuggccguccuggaaacucagguauccgaggacccccagguccuccuggauacugugauucuucucagugugccagcaucccauacaacgggcaaggcuauccagguacguuguugccauuguaggaaccccaacucaccugaaguaaagaacuuuacggaaaugaaguuccuuaggauugaaggaaggcugauuugaagaugucuugaagauaacaacucuuucaguucugauuauauaauaauaguguuugcuaucauagcacacaacauuauuucacuguuaggauugaauuauuuucuuuuuuccccauguuucugcauuuaccaaaucacaucauaaaccuccccuuacuucucuugggacuucaaagcaugcuaguaauugacuuuuuuuuuuucuuuuccccaagauugggaacagggauuuguuaaauacaacuguaaaaugccaagaauauguauuuaaaaauuguuuugggaaucuaauuuauggguaaacuauguaauaauaugguguagacaacugaacauaguuaacugucccauacuagccauggaauuaauauuuauaaaaucugggacuuaauaauuguuuuuaaaggauuuuuaaugaaauucuaguguuugacaauuguagagggcagaagucuccuauacuugauuuugugggaugugaggacuggguagauaugccaaucuggaaauaagauagucaugcuguggucaauggcgaccauuucauuacugcacccucaagcaucuugcaaauuuaaaaaauuauacugcuguuugauaugauuugcuacuuucaaauagugcaugaguaguugaauaucuaaauaucuauauaucuauauauuuauaugcauaauuacauaugaccaaaaguaauaacaaaucuuaauguauauuuccaugcaacccauucaaaaaauugcaauuuaauucuuuauaaauuuaaauuaccaccuccuuaugggaugugagaauaacuaaaaauauauggauauauauauauauauauauauauacuuuaaccauuacauacguagauggauguguauuuauauuuuuuacuuagucauucaacuuuuaaaaacuaucaucuuugaccuguuucagguuccggcuaacacauuuucuaagucgccagugcugcuuacaguuugaauacaugaaaauccuguuucugagauguuugcgcacgugcuuauuaggaaaugagucuguauggaaaucucaccacagauaaugguuaacgaaccgggucgacaucacaaaggaggguggagacucuuuuuacuaacuugaaugagacaaaagcaguggugucaguuuauaauccugaugcauuucaguaauaauguagaaaaacauuauuuuaaaaaaguuccaacacacagccaugaggagccucaguuuugaaagaggugcauaauaaaacuacuaaccagaggagucuaugccauuuuaagaaaaacaauuaaccugguuaaagagaaaugucuuauguaaauaauaaacuaauuguggcuuguaaaugauuuguaugugauccugucgacuaaaaucacuuaacaauucuacaauaagcuucugcaucaaagccugccgcuugcucuaugccggaauaacaccaaauggaaucuccucaucucuugcuuguuagcgaugugucugauucagggcaucugucuuuuuguuacuuuuuuguccguguccucucauuuggguuuuguaacugcaauuuucaaaccaaaguuuaaaaucaccuuuucuuccuguuuugcuguagucacugguguuccucacccaccagcuguaacucaguuugugugagguacagccacagaagaugucauguacuguauauuaccuggugauaguugcuuuucaccccccgaguucaguuucuaggagccaaugaaacuuccccucaccuccucaucuuuccaaguuguucuuugaauugaggaguuugaaggcauaaacaguuacuuggggauuugcgaaaauccuacuuaguuacugcguuuacaguucuuuggcccagucucugacccuucccaaguauuugugcaaugauuguguuuacugcuggauuuuugaagguuuuuuuuuuuaagaaagugccauuucauuauuugauuaucaccaaauuaucuggaaauaauugggacauuguaacuuaucuauuuauaguuaugagauuaagacuggagugccaucaccgcgggugaugauuuagcuuuugcugugugugugugugugugccuuccaaaucaugccauaauuguaauguugaaucggacagagccuuacgugcccgagggcggggccuaccugccugagcgcgagcccuucaucgugccgguggagcccgagcggacagcggaauacgaggacuacggcgcagacgagccugcagaggagccuccugagccccaccggcgcuggcggcgcgcccugccccacggacccgggcagugaaccagagaucacgcgccgcgccgcgaggcuugggggagguguugaaauucucauuuacaggucagauagagcaguguacgucuuuucugagguguuucuuccagcguugcucauccaggaguacccuuucugauuguagagaaccuuguuucugcaggaagccuagcuccaagcacgcagucuguagacauuuuugccuuugcccuugaaaugcuugcaaaauacuuuguuaacaaaagcugcaaagagagaacaugccgugugccuuuaguuagcacagcgggcagccucagugaaacucuuagguuaagcaguuaaguccuggaacccagagcugcuguguauuucgagcgggcaguuuaucuuuugcuauacuuauuuucaauucaauuacaccacgauucaaauaauuccccuccuaaaaccaaaaaggagggaaacgucaacuccauugcaauuacuuaucuuccucuucuaucucuguuauacgccggggcauagaaugcucguauacaucucuuuaacaaccacaaaccuuaagccauguagaugaaguuagugcaucaacgggauacaguuccauauugccuuaaaccuccuuguuuuagacacacuaacauuuauaccaaauugcagauuauucugcagagagggaauugcauguuuguguuguauauuuaguaugaacuuuuuucagaauauaauauuucuuaguuaucaaaaguaguuggaaaacauuugcaagacuaugaacauagaauugcugcuuuuauauuuuaacugcagauugugaauuucacugccuuauauuauuuauuucugaaacaaaagaggcauuuuucaauaaaacuacugaaaauuugacaugg

SEQ ID NO: 16065 - RNA, 3587 nt, Homo sapiens
uuuuaaaugauuuuaauuuucugaauauuauguuccaacucaagauauugcacaaugcuuuaauauuacacuuguuauuuuucucacacuagugagauuuugauaaacauaguugacuuuggaaguaacagagaauguuuucauugguuaaauaauuucaaugaccugugaggaacugaaagcaagcuauuacauucauauaaaagauaaguacauauccauaaauucacuuggauucaaugaaaaauaauaaacuucucguguacuuaauaaaacuuaaaaggaaacaaaauuuuaaauggugcaaaaauagaauguauuucuuaaaguuuugaaaacacuuagaccuaaaagaauucuaagaauaucuggccacauuauaagccucuuauuuguaaaagcuaacacuugauaauuuuaaaacaaaaucuagauuaaauaaauauaguucugcauuauuaaaguaacaaaaucugugaugguaagguaaaauuucccuaaauaauauaaacaaaaaacaacaccggaaagcaaauguaucacguuauggcaucgauaaacauuucuguucaaauguguggaucuacagcauuuucucuagguaacacacacaguuguuaucacauuaguauggaauaaaugcugaaaaauuaagaaauacuaaugguuacuaggccaaagucaauuccaaaaaacucaauucuuauaaacuuuuauuauagugauuuuuacuguauuacaacacuuuuuuucucuuuuuccuuugcuuugugauucauauuuuuagcagaggcauagcacuggagauaaagaaggggaaauaugcuucaggugccaguugcguuuuuuaacuuccauuuugcacuuuugcuauuuuuagacuuguugcucaucagauucauuaacacacccuacuuuugcuauguuuuuuuccuucauuuccaggaaaacucaaccacagcauuaggagaaaaggcaaaaacuucacauugccugauacaccacuuauucuugcucugccacugauuuguaguagcuguguauuacugcaguagcgcuguugucucuauuaaugcuuagagauuccacaccaugaauuuuuuuauggucauccuaagauacaaugaauucuucacauuuugugaaaauuauaggcaucugacagcugguguauuuaucuaccaucuucaucaaacucgaauauuuuauaaaauacuugagaaaagaucucuaccaaagauacccucaugaaacacucucuuaucaaaaagaaaaggguaaaauuauggauuaguucaauuguaccuugaacuagaaacacugauuaugauuauauuucagaaaacaguuauaauuauuucauuaaaaaugauucccauuuagaaugaugacuggagacuuauuuacaagaaaagauagagaaauuuuaugagccuaggauugugccaggauugccugugagggcaguuuuuucaauugcauaugcauguugagaugggacuauuuaugaucuuauuuccuuauucauuagagaaggagaugaccaguguuuucuggggguuuuuugguuaauuuugcauauucucuuauuucaaaauuaaucuaauuaauuuuauucaugugucacucagauugcauuuggguuuaaacagaggacuuaaucauagcauggacagaaaaggcucaccaucuaucuaaaugacucugauugcaccaucauccucauuguucuuguaaguuccaaauucauuauaaaucuggggaaaaaaaaucuucaaauccaaauauacauacauuucuuauaguauuuuaauuuaaaucaagaaguauuuaaaaucuuauccucuaacauuuucacuauuaguauaauaaaauucccacaaguugagaaaguuauuugcuucaaauacuaaucuaauauaucaaauaauuuugccaucagagguacaaacauuggcaaauaggauacuuaacugugagucaaaaaauauaacaguacuaacuaaaacacuuuucuaauugaaaaugucauuacagucaacauuuucagaaaacaaaacccaguaacaauucuaaaaaaucacacauacacacuccaguuuucuuaguaaccaaaauucuggaaguuuaugugauguuuucacaaucauucaagcuauggcaagccuacuguaacauuucuuuuacuuuaaaaaauuaaaaauaauuuuaacaucauauaauuuauaauacauguugaaaaugauuugccaauuccccaagguguaacuuaaaaccuuccaagguuacauaggggaggaaguccaucauuaauuuuucuauuccagagacucaguuuggaugcccgugugugggcuucuaaagcugagcacaaccugugaacuagagaaaugggccagcaguccuccuuguguggcuuuuaguuauccuugugacacucagaagcauucucucuuuaauuucaguaaaguuacaugauaaaugacuuccacauucagaaacugaugugucaacucuuaauuuaucuuuaaaguuaucuuuaaagaccuuacuaaaaacauguccauauuaacagucuuuaaaaaaaagaguauauuaccaggguuucaaguagacuuuagaugcacauuuucacauaaaccuaaauucaacaguagcucugacguugagauuugaguaaugcacguugugcuuuuuaucuucaaagaauauauucucugaccuaccuguaguuacgaaaaucuuucaaaaucaaggggaaaaaaguuaucgauccugagauuucuuguacuacuuuuuccuucuggguuuuggggguuuuuguguguguguggguuugucuuuguuuugagacagagucucacucugucacccaggcuggaguacagugacacaaucauggcucccugcagccuccaucuccugggcucaagugauccucccaccucagacucccaaguagcuaggacuacaggcacgugcaaucaggcccagcuaacuucuuuuuuuuuuuuuuuuuuuuuuuuuuuuuaagacucucacuguguugcccaggcugauccugaacuccugggcuuaagcgauucucccgccuuggccucccaaagugcugggauuacaggcacgacccaccaugcccagucuuauuuuuuaaaaaagauccugacauuuuaggucuguuuuuauauucaaguuuugauuggauuagauugugagaacuaucuuuauuucacaguccuuauuauaagucuuauacauacaaguaaauaaugcaaucagaaguauaauugaacugucagucgaagcuguucuuauugcccuuacugguuaaacugguacaucuccuuuuaugaauuuguucuauauaaaaaucauuucauccaagguuuuuggcccagaacaccagaaagagcaacuuuagaaacugauuuuuaguauuuaaaauuaagcuuuuaagucagagcauuauuuguuagcauugaaccaugaucagaaccauagcauuguacaagcaauaguaaaaccucuuccagagucuccugcuucuaaguuuuaccucuugaauuuaccucaggaaauauaguugu

SEQ ID NO: 16066 - RNA, 1860 nt, Homo sapiens
uuuuauuuccuauuuccauccuuucuaucuuuucccacauuuuaauuauguuuauguuuuugugggcuucccagcacauucuagcuuuuguacauuuuacuuacauucuguaguuaaaugaauucuggcauaaacaaacagguaaaacaaguacuuaccaguaagauaauuucucugaaaacguuuauccagucacauuaguucuauuaccaugugaaguuuuaccuucaugccucuaauuuaacauaagcuaauccuucccuucuacaccaaccuaccaaaaaacuuuaucuagaaauauuguaaaaaggagacuguauuuugauuuauguucaccuuuuuaauauacuuuaaaauaaaugugaauuucaaauugaguuguguuuaaguggacagugccuucuagaaugucagaaaucuuuucuaguaucucaugggaggaaauauuuaaacacucaggaaacaauguuaaaacauauuuacuuaaguucauugcauaguuuauccaucuaugauaaaaucccuuuaaaaauuuuaagaagacacaagacauauuugaggacucaaauuugaucauauauuguucuucuaaauuacacuuauuuuccccaagugauguaucauauauauuauaucacuguguugguauuagagcccauuugcaguuaauugcuauuuccuuaccuuuagugccugucugcaaguguucaaaaaucuguuauguuuuuggaaaaccauuuaaggcuauaccaguuuguauaaaccuuugcauucuaauuagcaaauguuauguucagaaacagugcaaaauucacuauugcucaguauugcuguaucuaugauuaugauuauuucauuuuuaggaacaagaacucuaucaaaaagaagguuuagguguuaaugaagugcauuauguggauaaucaggacuguauagguauguguuuuuuaacuccaccuuugaaaaauauaggaagauguagugaauguguuuagugcuuuuucugugcuuuuuaauugacauuacuuguuauaugacuugaaacugguauuugagagaagguuacuucuguauuacugccuggaaguuauuuuuuccaccaagacuucaaagguaucuuuguuggaaguuuucuauaaucucuucuauuuauuuugaaggauguuuuccuauuuaaauaguuagcaugugaauugguuaagggggaaacuuaauugccuagucaguaaagacauuuauucaccugaggaaguccauaguuaggccaggcuccaggcaaguuugucaggguuugcccugcuuuucugugauucucuuguuucugcuguauucugugcauugacagcauccucuaacugguugcgagcuggcuucaugugucacagccagauaacacugcgcagcaagagaauagaggcucugcuuucauuuuagugguaaagaaaccuuucccuauagccgcacagccaguuuucagucuuccauuucuuucccaccccaucucuaaaauaaacuguugggcaaaccuuguuuuuaaaacaguuugauaauccugucaguaacugaugugcuggauuugaaaaacauaguauaauaauaauacuacuuuacaucaguauaaauuuucaaagcacuuucacauuucacuugguccacuccacauuuccuuaacacacggacccuuucuaaccucugagucuuugacugugugguuugauauggcuggaacucuuccccuuccauuugucuuucagcccacuuucaccucaugcuacaucuaucaaaauacucccauuuguagcuuaguucagcaugccccuccugcccuaccacuaauuacccaagaagcaucauuuucuc

SEQ ID NO: 16067 - RNA, 2956 nt, Homo sapiens
guuucuccaaccaaguuuaaauagacaaaaagugaagacugaaugaugccaaaguaacuguucuuaaauuaagcuguaacacaaaguucuccccccaaaaacacagggcauuaagcgucuaguucaaguacugccaggcuguauguagaucugucucagacaggcuucagacaacaauuacaaguacacugcuucuagugggcauuauccacgauaccaaagcagggcagggauucccuuccauuaucaauuuuuaaaaguugcaacccccuuugggauuggcugccgcagggucagugcugagcccggggcuugaggggaggaagugagccuccuccugggcagggaagcucuacauuuaguuucaacacuucuccuuucagagcucucucucaggacuauucuggcuucucaggauccauugcccuugcccaggagagagagccucgcugggacccagaaaccgcgaaagaagauucgaccuaccuguggaaccagacacaacuugguccccaaaggucgcuuaggcgaccccacugcaaacggcaagucaacuugugcacuuaaaacguaucaguuuauggaaugcuuguuuaaaguccucauuggacaugguauagauuaugggguugaugagggaguugagauagcccagccaugugaagaagucaaagauggcuagguggaaccagcaggcaucuuugcagauaggcaucacuagggagaugaugaagaaggguagccaacacacaauaaaggcucccaaaaugaucccuagggucuugguggcuuugcgcucccuagcggccaugaguuucuucuuuuccagcagggcgucggagacucgcacuuugacuugguucacauacacaggagauccggauucgcugggcacgucgggaacccgcgaguuaauagaggugaccgaggacguggacccgggggagucgguuaucagcugggcucgggucaagcgcuugccgguccuguugggcgucuguuucaaaauccgggagcgggcuucuacguagaugcggccauagagggcgaugaggagcaggguggggaaguagaaagcacccaccguggaguagaccguguagaggauguggucgguguucaccacgcauuccgacaccuccucuucggccuuagccugacgccagaagaagggcggcagcgagauagagauggagaagacccacaccagcgcgaucaugaccgccgcccucuugggaguccuuuuagcugaguacuccacggcguccgugauggcccaguagcgguccagggcgaugacacagaggugcaggauggaggcagugcaacaagugauguccgacgacagccagaagucacagaccaccuggcccaguguccagcggccggugacaguguacauggugcugaugggcaucaccaggauggacacaagcaggucggugaccgccagagaggcgaucagguaguuagccggggugugcaguuuccggguccgguacacuguggcaaucacaaaggcauuggagagcgugguggccaaggugaugagcgccaauagcauaaccagcaguacuuuccaggguagggagauggaguccugguaaauguaguccuuggcgcugcaguuuugggagggagcagaggauaaguuggcuugaggaacccaggucucggagcccgcgggcggcgguggagcgcacugagcacccgguuccuccauggcucuccucgccccagcuccggagcgcagcucuugggcauggagcggacgaaggagagggcggaaggaccguggcgaucgcagguuuguccccaguugauaguuccgugaguuccucaauuauuccuccgcccagguucacagcugaaacuagaggucaugggugcggcagccaaggcaggcgggcgccuccccugcacuuccagagcgccuagcuaagccgccgcgucugugguuguuccucuccacaccgggucuuagaccuggguugcuaagagcuggcccaccgagcccugcuccgcuccagcucccuggaggcgucuagugcaggagggugaaguacugcuugaggagaaggcuuugaccaaaugggaucucuuaccccaguugcuugaggcugagcgucuccuaaccuggacgcuuuuggaucugcagacuuugcccacaggaguuuccuagguguagagaccaaagcuugcaggccagcgagaggucccgagaucuugcauucccaccccucgccccaagcuggggcacuuuuggggggcugcagcggccgccagagcuggguggggugaagucuaggagcagcgcugcgccgcgccucgcgccggagcucugcccucccucucuuuucacucucuggccacucggacgagcugccccgcggagacggagccauaaaaggggggacacgggggcuggaguugcggcugcucgggccgcgccgccgccaccgccacccuggucccacgggagccacucggagccaugccacugggugcgcgggucuggaggaccuggcgcggcacacugggaaggggcaggugucugggggagcuggagggacgcggcgugcaccagcccgggagaagcgugcgagcuacggagcagaugggcucuuuauauagaguccagguccgguccgccagagcagugcaacucgugcggcgcggcgggugcggacgcccgcuccccaucaccuucccuuuuucucucucccucccucuuuuccccccgcccuguuccuuuccuggccaaggaagcucccgccggguccuaccgcccuaucuccccgcuucccacccugggccauccucccagcccugacaaccuggagcugcauuucuggucaggggaagaaggcguccuguucucgccucuacggacaucagagcuugcugcgcugaccuccagugagacccauguccuuagccauggucacagguuuag

SEQ ID NO: 16068 - RNA, 1101 nt, Homo sapiens
ucuuuucccauuguauucugcucaagguauuuccccccaaauaaguugagaaccauggagcagagaaaagagaccucaagaacagggugacagagcacaagagggaaaaaaaaaaaaaaaaaaaaaagacugcaacuugcucccaggaacuggagaaaauuuaaaaaaaggaagguuggaauccaucaguguucuauuuagucaucuucuccuucauccuccucuccuuccuccccuucaucauuaucuucaucuucuucaccuucauccucauccccuuauucaucaauaucuucuaauccuuccuccucuucaucaucaucaucaucuucuucuccuucuccuucuucaucauccauaucgggaaccaaguaguacuguaauggguuuggccagauaucaucuuugaugaccucuccuaacucaucagcaccugcaucagaauggucaguaaaccagguaaagaagcucucugguuccucaugcugccucuuccugcuggcuuuauucuguguuugacuugaacguuucgucaaauccuuuccagauuuccauuugauuucgguggacuucgaagauggaucaccacucucauucagaagaaauucuuuggagagaacuuuauuuucaaaguaaggauuuucaucaaaauaaaaaucuauucuguaaccugauuuaauaucuucaaauucugucacuucaacucuggucaaauaaugcagugccucuucgucuuccuccccaagcagugcagacacuuguggauggcugacaaauguuguuacccaaaaauuugggauuuuggcgaucaauucugaccucuucugaaaaaaugguuggcggaguuuguuauauuucuguucuacuuucaaaaucuccucacuggcuuguucauuaagucugucuguuucauuuuguacuucaucaauguguucaaucgcuucuugcuguucuuuuucucccuucuucagcaagccugcagaggccgaugucuccuccggucacagagcaggagguggucuugguuucuucuuuugaggcuggaguggagacuggcguuuaggcgccaugcuauuagggaagucccagaaccagaccaca

SEQ ID NO: 16069 - RNA, 37898 nt, Homo sapiens
ggggaaauucaaacguguuugcggaaaggaguuuggguuccaucuuuucauuuccccagcgcagcuuucuguagguaaguucugucuuaccggugcaccggcgcacugaggaacagccgcagccgguguaggggcucauuguuagcgcuggucggugagggguggggcgaggugggggcagcucggagccagguaugcgacgcggcuaaacgagcuggagggggaggggaugucucacugccucagcgggucuggccgguggggugaugcaggagguuuuguugaggaaguaagaaguggguguggcccacgcuggaaagaagggguggugggguaccugcgcacaagaucguuuuccaaaggacagucucucuuguuuuggggguuagaacugggaaagaagcggguggccgugaucugacaguuaucuuucaaaccugacuuaagagguggagugauaccuugcugcaacuuuaugacuuuuuuucauuguuaaaccugaagacggggcagcauuguuaucagugacacugaguugguguuugagagucacaaagauacgauuaacaauaagacugcagacacuuuauugaacaaacaccaccaccaugcagauaagcaagugcucaguaccaguacaauaguuucuuaguguuagauuaagguagcaaaucgugauucugcuagauaugcacaagaauaaaucugcggauuuccuaauuaucaguaaagccccaucauguuuauauucugcuuugaaagcacuugcacuggaagauuuacucaaguaaagcaggcgaauaaaggaauuguuauucccauugccaaacgaauucuuuaugucuaugucacuaccagaauccaagcaaucuuuauguguaugucgcuaccaaaauccaagcaaacacucuaucauauuuuuuuuaagugacacuaaauuugcagauuucuacagugugacgucauugauguuauauugggggaaaaaguauacuuggccuaugaaaccuuggugaauaaauuacaaagauguguaccuuguuguugugcacuuaccuccauuaauacuagccuaauaauagcugcauuuagauguguucacaaaacgaaugcuuuagucgucuggguucuaaaaagcuagugcauuuuuuucuuugaugcuaguuaaaguaggaguuaugacuguucaguuuuuuucuuagaaauggaauccgaggauuuaaguggcagagaauugacaauugauuccauaaugaacaaagugagagacauuaaaaauaaguuuaaaaaugaagaccuuacugaugaacuaagcuugaauaaaauuucugcugauacuacaggugaguuuuucuuuucuuuuaaguuaguaacuguuuguuggguauccucuaagguaaagauauaguacuaaucacuuuauuuauaauuuacucauguguuuauugucuuucuccuccauuagaaugcaggcuacaugauggcaggguuuuugucuguuauauccacagaacuuugaauggugucuggcacaugguagguaggcacuuaaacauuuauugaacaaugauuaaugggugaaaaugcccagaguuuaauacucuagcucuucuaaaaguauuagcucagaagccugauucuuuacuguauuucaaaugguuggucauuugaauggugaccuuuggauaauuuucuuacaucuauacuaaccuuuaaauagaugaggaauugaaaauaaauggaagaaccugugaucuaaucaugguggcugacuguucacuuugaaaaaaccuagaaaaugauaguuuuaguguuaagcaaaaucuuaauggaguauaauugugcuuaauuaugucacuaacaaagguuguacaucaaggcaauugaguauuuuaaguacugaggaagauucaaagaugcuuaaaaccauaguuucuuucuagaugagaauuuauauauucacuaugcuacauuguaaugcaugcugggcaucauaggaauacuagcaugauaaaacacaaauguuuuauuuguugauuagaggaagaauaggguacucaggcaugaggaaugcaucugcaaagccacagauggcaauguguguuuuuuagacauuucacagacuaauuucuuaggaaagcaauaggagguaaaaauagaaaauuaaggucagaccaaauuaaauuuaaaacgacaaagcaaaguuaugcaugcacuauauuuuaguagaaaguagaaacaaauuuuauuuauaaaaguaaagauguaggcuuuguugaaagugacugaaguuaauagaaggaauaauagcuucucuggaaaucugaauuuaauauugcuuaguaauaaccaaaauauccugaacagaagacugacauucaaguuaucuuuuuaaaaaacuaacacugaagaaaguaaaaaguacauuucagugugaacauuuugucugaagguuauucuugcuguuucuguugguugggguuccacagagagaaaccugacagucacaagagguccuauaaauuccaaaggucuagaccacgguaacuaugaguuuguuggaccaagaaauuaucagggccucuagcagaaauuuagguuacuuggagagaagaaaaugauugucucauuuguuuauuuuuuguaaagcugguuugguuuuacaaguaaguaugagguauacagagauaauguugaaugguuaagguuguaaagaagguuauguuaggacuggagcaguagguuuaaugaauaaaucauugaugggagaauuuucuaaguuaauuaguacaaguggcagugggagagauuuaguuuucuauggauagguaggaugcuaaaauuauaguuauccugcaacagcauaaaauuuucuuaaacuacauacaauuuuuaaaggcuacuuacaaaaaaacucacuuauuuccaaauguuuucuuuccuucaaaauauauagcuuuuggauaaaguauaccuucauaaaagauaaauacacgauaaauaaguuacuuguauuuauaugaacuuuuacaauuuuaaaaaguauuauaaggacuuuauguacauugauacugacaguacaaauguuugacuauauuuugaaggaaaaaugcaauuuggcauuuguuuuaugucuuuucuugugauauauuuuguuccccuuauuuagauaacucgggaacuguuaaccaaauuaugaugauggcaaacaacccagaggacugguugaguuuguugcucaaacuagagaaaaacaguguuccgcuaagugaugcucuuuuaaauaaauugauuggucguuacagucaagcaauugaagcgcuucccccagauaaauauggccaaaaugagaguuuugcuagaauucaagugagauuugcugaauuaaaagcguaaguauuagcauuuuaacuauguucaacuauguuacauaauauguaacuacacugcaaagagagaaaauaaaaaacauggcaguauugugagaaaauauuaauuuuuuuaccaaauacuuuugcuuauaguuaacaagagacuaauguaaacucuuuucuaugcacguuuccacaacaguuuacuuauuuuaaacugccuaaaaagauuuuuuuaaaauaacuuauuaguauuuaauuuuacccacagaaaaaagcaauaucccauguuuuuuggaaaauugaaugaagcauuaucaaauuuaaguagcuauguucuuuuucuuaaauuuugacucaaaucuuuuauuacaguauucaagagccagaugaugcacgugacuacuuucaaauggccagagcaaacugcaagaaauuugcuuuuguucauauaucuuuugcacaauuugaacugucacaagguaaucugaaaaugucaaauucaaauuuuaaguaaaggauaacuuauuacaacuuacuuccuaauauuaaaucauauauaugaaguggaaauuugaggcaaaagacauuaaaguugaucagaugagaauauggggagaaaaugccaccuaaauguaaaugcagagaauaucuguuauacuagcuuuuccauguauaaagaguaauccagggaaaugagcaugaacauuguguaugugcuacuaguuagauucaggaaacaucuaaaggaaaguagcugcuucacugaguauuuguaggaagaaggauaucagauauuuaagcuagagcuuuaaauaucuagagcuuacauaaacuuuucuuaugcuaugguuucauagcaccaaaauguacauuaaaguguagcuauguaacuugguggucaaguaaacuauauaucuguguguguguguguguguguguguguguguguguguguagcguuaauugguaguucuuuaaaauaaaaaaguaaacugcuguagaaacuauuucuugcucacuugguucuucauagucuggauuuuuuuggguaggaccaagacaaucucuuccuaagacauuuuuaaccuggccauuccuuagucuuuucucauuuuccagggccuuuggauacacccucagucugcccucuggccagguguuuccauucucccacugccuuguuucugcuacaacugugauccaauuuacugccagugauaaacauauuaacacuauuggaagaauccccaugaugguuuccauagcagggauuggucacuggagaguauuccccaggauugagccuggagaaaauaauuauaugacucagaaauaauuugagaacccugaauuguuacccauucagaugauuucugaguccuaguaauugucuucuccaauauguccuuugcucuaucagguuacuuuuuagaacuauuaucccuuucuucucuagaaaaauggauuccuccuugcuuguuagagaaaauuuggcaaggcuucuuucucuccauucugcuugaaaauuucuugagguauuguggccucucaauaacaaccauaaauuuuacauguuuagaacauguaaauauugaaacucuuaaauugaguuaucuguaaaaaagacgaacuuuaucuauaccacuuuaucugcaaugugguaguaaugcacagugaugcaauguggucaaaugcauugcacaguaaugcaguguggucaaauuaugauuauuuugagcacaguugauggcuuggcugucaggaaauaaugcagcaucccugaaguccuaugcagagucuggugugugaguauuuuuauagggauggaggacauuucaguuuuuaccagauucuuaaagaaaucucugaucucaauacuaagcuaucugauuaauuaagcuucuuaagccuuucucucuuuucuugugcuaaaauacacaauacaugaaauucuaccacuacuuaguaaauguagauguaagcacuaucaaagauauuuuuaaaaauuuauaaacuaccagaagcuagagaucaucucuuaagcauuuuuauacgcuaaguaccaagugcauagcauagcucaauggcucccauaaauguugauaauauucuguaagauaugugauguauacauuuaauauuuauaugucaaaugcuagggguaaguuuaccaauuuuuuugguaaucuguccauacucagaaagguaauuaugauaguuccucaguuauucugcauucuuuuucaggcugguauagcugagugugacagcuaaagauuaaucuguauuuauuauguuuuuccccgaaaauccuuuugauggaagaugcucuuuaacaaaagaugucauccuucccuuaacuaaaugucauuaugaaugauacuuauuauagcauguuguaagagacugaugcucuuggcacuuuuguaacaucuagaaugcccuccuguuucuaacuguugugauuggccuuugcuguccccuguugguaacugcuuuguuacacuucuguuacuucugaaaguggacaguggugauaaacuaaugcaaaauuacgucagcuacauauugcaaggaaacuauuugguaugcauuguuaucagaagagaguugguuaucugcauaaaaagugagagauugcuuacuugccuaugaaauaaaauacaugagccuuggaauaaauauuuuugcuuaagucuuuuugauuuuuuuuucuagguccugaugaauacguaucuggguggucuggguggugggcauuuuacugccuaaaaaugacaauuaucuuuugcuuuguuagguaaugucaaaaaaaguaaacaacuucuucaaaaagcuguagaacguggagcaguaccacuagaaaugcuggaaauugcccugcggaauuuaaaccuccaaaaaaagcagcugcuuucagaggaggaaaagaagaauuuaucagguaacuauuaagguauacuaauacuuucugugguagguaguacuucaaauaaagauucgggauaauaauuuauagaaaaauauuauuuauguagaaugguuaaaaucuaagauuaaauuguaaaggagguaagacugagaaguaaaaaagucucuacaaccccaugcaaauuugucuuuuuugcuaacuaaacuuucguuaacacaugaaaaacaacucuaagcaagagaauuuuuuuuuuuuugcuuuuggaaauagagaaugugcuuuuacccuggggaaauaguuauauaauuuaagagaauuugaagaaguaguuagauaauuaucuugguaucaucuucaugucugcauaucuuacuuggggacaaguauuuccuaugaauugacuuuuaaaauauucuuauuuguaagaucacuuuuuuguacuugucuuauuucuuauaaauuuaaucauaguuucaaaauuuuuacagcaucuacgguauuaacugcccaagaaucauuuuccgguucacuugggcauuuacagaauaggaacaacaguugugauuccagaggacagacuacuaaagccagguuuuuauauggguaaggaaacggaaacaguuuuuaaauguucaucuucuauguaaguacaucuguguuuuuuaauguaauuacauguaucugcauauauguuuucaugugugugauaauguuuagcaguagaguagaaauacauauuaauauuguucuuugaaaaauuggggguauuuucuuucuguuuagagagaacaugccaccacaagaugcagaaauagguuaccggaauucauugagacaaacuaacaaaacuaaacagguaaguuacuuucaaucugcuugauuaagguggugauagucuuuauuuccuaguugguuauuuaaucuuucaaaauauuuuuagucaugcccauuuggaagagucccaguuaaccuucuaaauagcccagauugugaugugaagacagaugauucaguuguaccuuguuuuaugaaaagguauguugaguuuuaauuuuuaaaauuuguuguccguaugggaagauuaauggcagaauggucuuaaagucuuuuacugaguaauaguaauuaugauuaaauuuuuauucaguuuuagaagauaaucucuaaauguugucaggaacaaaggaaugaguggagaaaauaacuuuguuuugcuuuuucacucauuaaaaauauucauuaaaggagcuuuaaaaggaaaaaauauuaagucaacauuaagcuuaaaagacugauauuugaggauuugucacuuacggguaggcugucugcuaagaaucucuuccuguuuuguuugagagucuccauaacggguagaaggaggucugggaacaaauauuugcuccagauaguucaaggggagaaucgcugucagugggauagaugauuauucuuuugcuugagucuagugcuucaagaagugggacagguuagguacagaugaauuacuguucaucacauccaguguguucuccuucccucaauuugcuuguuuauucccuguuaagaaaugggaauguagccuguagcucagcuaaaggagaguuauuuuggccuauucuuaauucugaccaacauuuguaauauuuauauuggaaaaggcuccuuacaguccagagaaucauuuugcaaauaaacuuuagaaauacgauuguuuuucauuacuaucuuuuauaauuacauuucuauuauauuuagacuugacuaaauauugacauuaaaagaacauuuuguuugucaagguuaagcuuuaaagucuuaucacuaugauuucaucuuguucaucucuauuucaaauaccuagcucaagaauaaaggagauuuucuuccgcuccaaaaaauuaaaaacaaaaacagaaaaacugcagccauuuucuugguuccuguuaucgauagacaaugcuagguacuguggagguccacagaagugcuauacccugguucuuauccuuuagcuauuuguaauuggaaauguaguuucaucuguauacuuugccuuucccacagucuaacccuaacuccaauuguuacugauuagauaaugaagaaguaggcgaucaccugugucacuuuugucauugcccagcacguaauuuuguuagcuaagucacuuuuguauuggaauuaugucacucuaaaaaaugucuuuuuaagagauuuuuuucaauaaaaaguauguauauuauuaaaaauccaacuugagaugaaaaaauacauugaaaauuuuuuuuuucaaauuuaauguuaaaauuauuuuguuucacggguaaaagacaaaccucuagaucagaaugccgagauuugguugugccuggaucuaaaccaaguggaaaugauuccugugaauuaagaaauuuaaagguauuuuaauucuauaucauuauauaaagcaaggguuccugaucugggaggaucaguauucauggagcuuuuucuggggaaaggguuuauaaauaguucauguaucuccaacaguguuccacauaccccaagagcugugggacuacgagugggaaguuggugcagaaguccuagacuauguuucuccaagauuaaggugguagagcaaggaucaacaaucuuuuaagagaaucaugaaguaauauuuauuaugcacguguuuaagcagauaguuggccuggguuugggaauacgugacugggggaacuguugcccccaaguuuuguuuuuuguuauguuuaaucauaugauuuugguaagacaucuuaaaaaaaaaugagagaguaaauugaguuagggcagaggugaggacauaaauaauccugaccuccugacauggcagagcaacuuuguguggacuuaaaggaaauaauuuuaguuccugguacacugugauuuuuagugguuauacuauuauuauaauugaguuaaaccccuggcaucaugaugugggucuuuucaauuuuauguucuuuguaaugccucccucuuucaugaccuaugcuuuaaguauuaauuuuuccuaauccuggcuguccuagagaacagugcauaauugugucaaaaagauuguucucuggauuuagaguaacuacucucuuaaguuaugcaguuacuaguuuugacuuauuuuuggugauaaaauagccaucacaguaacaaaauacuuaaaucuuuuuucuugucaugaggcauacucuauguugaauucaaacuuucuaacccuuuccaucuuuaagugaaauauauuuuagcaauugauuaauacauccacugaaagcaaauuggccagauuuaugguuaugacccuucccauuucucuaauuaauaauucaggcaguuaaccuuugcuggggguuugugagucuacauauaauuauaauagaaaauuuuaugagcaauccauguauagauaagacuuuaguauauugaacaguaagacagauuaguaguacuacuauuuaugggacuuuauuugauuuucuuuuucauguagucuguucaaaauagucauuucaaggaaccucuggugucagaugaaaagaguucugaacuuauuauuacugauucaauaacccugaagaauaaaacggaaucaagucuucuagcuaaauuagaagguaagaguaacaaaaucaguagacuuguauguuuaguuaagaaaaccacuugauagcuuaagaaagcagacuagccaccuaagaauuaugaugugaaacugugucuauguucuuuuaucuugaauuuccguucaguuauauaggguauaugaaaaguacugaauccgcagcaaaggaaauuuauuuaccuaaaaggugcauaaaagaaagaguggagggaaaaugcaauggaacugaguuuuuuuucucaguuggcuugacaaauacuuucuggaagggauacaaaagcuguuuuuauaugacagcucucaucuuuuaucaagcguuugguuuucuacugcauggguacugugauacauguucuagggauauauaaguggauaaaacagugucccaaggagguugcaguucaguguggaagauacacagagauauauaaaugcaaugcugaauagaauguggagauugucaugagagccacauaaaugaaaugcuaugagaauucagaagagggagaaauuaaggaacuaauuugguuuaggagaaauaaggaaauauuuugugaugauggugaaguuugaagaaacaaauuaggauuuaaaugggaaauaauagaguauuucagaugaagaggauaacacagacaacgaguaaaauguuucaggaacaagagacugucuaguuaugcugcagacuguaacauggguagugugcaaauaggaaauaagacuaggcggacuuugaaugcuauuagauuuuuuauuuauuuuuagaaugcaggguaccauuaaagauauuuaaacagaucauuaauaggaugaucauuguccagauagagguugccagauuggauguauuaauuuuuaauuuguuuuaauaggacugaggagggacuuugggacaaagugaggcuugccuuugccagggacuuugcugaaaguccaauaucccaagaaugccucagucccaggcaaacggggacacacacaaaaaaacauuauuuugguugggaacagauucuuauuccuagcguuugguggaaaguguuuacauuucauauuuucuuggcaucuauuguaacugguaugauugagaaaaucaucuuuaucaaauaugcuuguuaauaguacucucaauaccuaauuuaauguuuuaaaugaaugcuuguugucuacacuauaccaguaauacuuuauuaauauaauaaagcauauagucagaacacugcccaaaucacaagagugcugcacaaugaaauaacacaagugacugcauacuuguaaccaauagccagaucaaaaaauacaacauuacuaacaccucaauaaccuccuugauccuccuccuaaauaccucucuccuuccagauguaaucauuauucugauuucuaacaccacagaaugaaauaauacaguguguauucuuguauuugcuuacucacuguuguuuauggaacucauccauguuuuuaugauauauagucuguugauuuuuauugccguauacuauuuaacuaguguaaauauaguauaauuuguuuauucacauguacauggauaacaguuuuuugucuaaugaauaaugcugcuaugaauauuuuggugucuuuugauucacauauguacaaauuucuauugaguguauuccaagagugggauuguuggguuacaggauaugcauguguucagcuuuggaagauggugccaaacagucugaaaagugguugugcuaaccuuagaccagcaauuauguugcuccugcuccuguucuuugcaaucauuguauuggcuuuuaauuuuaggcauucugaugcuaucuagugguaucuaccucguugugguuuuaauuugcauuuugcauuuccuuaaugucuacuuuugaacaucauuucauauauuuauuggccauguggauacucucuuguaacauacugcaacucugucacccagguugcagucuugcuaauauuucuguugguuuuucuuucuuuuucucauugauuuuuaagagguauuuauaugaucuagauauaaaucauuuguuggaauauguguuuguaagggaaaacgcauaauuauuuuucuuucccuuuuuaguuucuuagcugagacacucuccugaaaaugcaagaacgauuaacaauagaaaaacaagcagaaguuuguuaacaugugcucuacccaucaccugggcggguucaguucagaaguauuucuuucucuccaagcaguggauuugcuuaaaugguauuuuaacaaagagccauaaaucuuaaauauuggcaagacaaaggagagaacaguuccaaucuuuaaaagcaggaaaauguggaaaacuaguaaaaucuauuuccagauuccucuggugccugcuagugcuuucugggccaaaaagcaaguguugucuccaguaaggaaagauuuauauccugccaucaggcaagauauuuccauauuuuuuagauuuaucauuuuacuuuucaccuucugauuuauaucuuuccugaguuuaauguuuacauauguguaagaucaagugucaggguucauuauuuuuccccauaauggauauccaggugaccuggcaccauuuauugaaaagauccuccuuuaccucacugaccuguuguaaauuaggugauucuauguauggugucuggcuuuggauucuuuucuguucuauauucauuuuugucuuuuucuuuuuuugagacagggucuugcucugucacccagauugcagugcaguggugcaaucacagcucauugcaaccuccgccuccugggcacaagugauccuucuaccucagccuccuaaguagcugggacuucuaggcaugugccaccaugcccggcuaauuuuuaguuuuuuuguagagauggagucuugcuauguugcccaggcuggucucaaacuccugaguucaagcaaucugcccaccucagcuucccaaagugcugggauuacaagugugagcuaucacaccaggccuaaugcucucuuaguagcugcacuaagucuugauaucugucaguguaaauuuuucaacuuuguugaaaauucacgacuauuuuggcuauuccuggccuuuggauuuccauauaaacacuagaaucuaucuuuugguuaccacuuuuaaaacaugggauugugauugauauuuaacugaaccuauaaagaaauuugggagaaacugacaucuuuacaauuaaguuuuacagcucaauaaccuagcauaucuuuucauucauuuaaaguaaugagauaauuauuuucuguguagagaccuaguguaucuuuugcuagguuuauucuugaauauuuuuuuaaugcugaucagauauucuugauauuuuuugaugcugugauagugaaugguaucuuuuuaaaaaccuuuucuagccugagcaacaaagggaaaccuugucuacagaaaaguuagcuggguguggugguauguaccuguggucccagcuaugcaggaggcugaggugaaaggaucacuugagcccaggaggucgagacugcaaugagccaugaucacaugaucaugccacugcacuccagccugggugacagaagaagaccuugucucaaaaaaaaaaaacuuuguuguuaguuuauaaaaaauauaauugauuuuuacuuauuuaugcauugcuaaauuuacugaguaauucuaauaguuuuccaugcauuuuuuggauuuuuacagguacacaguuauguuugaaaauaguauagcuggccgggcacgguggcucacaccuguaaucccagcacuuugggaggccgaggcaggcagauugccugaggucaggaguucgaaacuagccuggccaguguggugaaaccccaucucugcuaaaaauacaaaaaaaaaaaaauuagccgggugugguggcaggugccuguaaucccagcuaaucgggaagcugaggcaggagaaucgcuugaaccugggaggcggaaguugcagugagcugagauccugccauuacacuccagcagccugggcaauagagcgagacuccgucucaaaaaaaaaaaaaaaaaaaaaauauagcuuuuuuccuuuugaauccuuuuaacuuucuuuucuaugccuuguuauaauugcuaugaccuccaguauaacagugaauagaaagggaugauaggugccauucuugucucauuccuuauuuuaagggaaagcugucaauauuuuauccuuaguaugaucauuacuguagaguuuugucccuacuuuuugucagauugaguaaguucuguuuuauacugaggcuacuaauaauaguuuuuuuugugugacuggguguugaauuuuaucagauguuuuuucugcaucuauuuaguuaauuauauauuuuccgucucuauucuguuauuauggcaaauuacauugacuuucaaauguuaaucaaacuuugcauuuaggaauaagcccaauuuggauauaauuuuuuaucuccuuugucuaucaauugcuaauauuucguuuaggacuuuuguauccauuauaaugaaaggaguggaacuguguauuuguagaauguuaaauauauuguugaggcguuuuguuuauagacccuuugagagaauaaauuacaaacuagcauaaggugaaauuuuuauguuaaacuagaggucuuguaacugacuuaaguccggcugcuugcuacucagaggcaaaaaagacaagaaaugaggugugaugaaaggaaagcaauuuuauuaaccaaaugcuagcaguuggagaaugcccaggcucuuacuuucaaaagacuauucuguaauuucugaaacaugcuuucccauaagauaauuuuuucuuaauuggaaaugacccagacaucucauaagcaucaauuauuuaauucaaaauaauuugaaaguccacuacaggcauuuaucucauuuacaugcccugagcuuuuuccauuuuuaaguuuuucuagauuacuucugaaaacugaaauguuauacaaagcuagucauuauuugaaguuguuucccuguuaaccauuuuuacagucugaguaacagguaaacaaccuaaguaagaaucuuagaguuaaauauauuuugccgauaacucagaagauugagcuguuuucauugaaccaccaaucuaaauuaaauuagucuuacuugucaaaaaaaaucacacaaagauuagucuguuuuugacuguguuuauagucuuauaaccuugaugucaaacccugacaucuuaauauauagacauagacaaauauaaaaccauuuggucaauaaacucagacaaaaauguaugcugauaauucuaaagacauuuuauuuuuauuaauaauuuuaaaaucacuuuuauuuaccaaagauucauaugaacuugaaaagcauuaggacuuacuuaauuuaugaguacucauuuacuuauaagccaauuugguagcaugcuagauucaacauauacauguauguacauauaaacaugucuaaacauguauacauacaggcacaaagauccaauagcuuuuaccucagaaucuagccauaagaugacaauacaaacucaccacuuuauaaaagacagcugauccuaauuauuuuucugaugaaauuggaaccuguucacauggcuaaaccuuguuugcccugauagguaaucuaaggaaagcugucaaccaaaauuuggguaaaaaagucucuauggcaauuucguuuuaaaaaccucuuuuauccuuuuuuuccccuuuuuucuucaguuucaaaugaguuacuaaugauucuguuauaaucauaacuggcugaccuguauaagaaaaauaaaaaaacaaaaucuccaagugagauaaaacagugaguuuuaucucaacucaacuagcuuaauaacagcacauucaaagcaggcagaaaagaaaagagaaaauagagagcuagcuuuagaagacuguuuaauuuuguaguuaaagauuaaccauuugagcucugaauuuuucuuacuggaauuugcccauaguuuuaaaaugugcagaaaaacgggccauaauguguaaccagcuggagucccagauaguccaggaaagagcucacaugcuuucuccccuaacaaagcuugacgcagauacaagaaauauucuggaguccaaaagaggaugacaaaaaucagaggccagguuguuggaaaccauuucuucccuagcggggagaggagcagccuaucuugcugcuuucuagucuugcugggcgggacggagacaguuucaaagcacccuuggaaagagggauaacgcuaaacagagacacaaauacaggcggauccaaugcagauggagcauuccaaacccauccccaagaaggggagacuggagaaaaguccugagaucuugucucaaauccagacagcacugcagagugaccugcauuggguccagauggcaaagagacccaaauggcaccacagaugaccuauacuagguccagauaacuagaaagugcagauggcuaagauggaggauuucccaguacacucugguuaauuuauccaacccuugaauucuguugaccuccaagaugccacuucccuuucacuaacugaguguuacagcagcugaugccacaaagggaagggaaggaaaaauccuucagacaaggguggucucccuagcugcugggaguuccuuaaggucccagcugcagggucagcuagccaugagcagcuggcauuugcaaguggcuccugcguuggccugguagccugagugggugagccuuggccugcucccacagccaauugcuccacuuguuggaaaccaggcguacaggcugagccccucaaaacacacaguuccucacacagggcaccacauuuguaacugacucaaguccggcucuucacaacacagaggccaaaaacaugagaagugaggugugguggaaggaaaacaguuuuauuaaucaaaugcuagcagcuggggacuggccaggcucaugcccucaaaagaccauuucaacuuuuugggcugagugaagggguuuaaaaaggaaaagguguggaagagaugcaggaguggugcaggucugaaugucuuguugugauaguuauauugaguaauugcccaucuggagguaugguuugugucaucuugacuucagcuggguaaugcuaggcuaacuguucgaaacuccccccaugcaagaggagucugcaacuccaucucugcuugguuuguuucaaaacuggccccugaaauuucuaagcaaguacguaauuagauaagugaacacuguucauggacaugccuggugggaaagggagaaacuaaggguuucaaaguaugcuuccaggcugaaagcaaaaaggaaaaaaaaauguucuaaauugcauuuugaggguuggauacucggucuaugaaaagugaugaauuagcuucucuauuaguaagacuuuauaacaucuauauguuuuuaaauuuuuacuuauuuauugguaaagaagcauuuaaauguggcaaggucucugacaaaguucuuaguaacaauguaggaagaugacuauagugcaacuuugugaaauugacuugcuaaaagcaaauuguuaagcagcuggcuuaaagcuuuuaguuucucucccuccuugauuguuuuuaagaacuaaauacucauauaguuuguaauauguucuguuguuuaggcuuaguuuauuaugaucaaauauucuugcuuuuuaaugacaacaaauacaauuucagaaacuaaagaguaucaagaaccagagguuccagagaguaaccagaaacaguggcaaucuaagagaaagucagaguguauuaaccagaauccugcugcaucuucaaaucacuggcagauuccggaguuagcccgaaaaguuaauacagagguaacuuuuccacuaaaguacaauauugcuuuuuuguucauaaugcauuuccgaagguugaugaucauauuaaauguuuucuuuuauuaaauguguaugauauuuaguagaauaguuuauuuaaagguuuuuaaaaucauuuauaaaguggugaucaguagcagucauacguucaguaagucaggcuaaauuauuuucuaucuucgauaguguuucuagauugccgauagacuggugcuaugggccaaaucuaguucuuagccugauuguguaaauaaagacuuacuggaacacugacacacucauucauuuaaugucuauggcugcuuuugcauuauaagagcagaguugauuaguuguauuagagaccacuuggccugcaaaguuuaaaauguuuacuaucugguccuuuaccgaaaacuguaugcugaucucugaacuagcgcagugcugucccaagcacuuaacaguuuccuguggucauacucauugauaaaaauagaaaaauauagccuagacaacguacaugaauuuguaacauacugagucaucauuccugguggcuuuucggaaggaaugaucaaguaggauacuaaagagcuauagcugcaguucauggccauaguuuccuuaccauuucuuuucagugacuuguaguaaauauaguaaaggcuuuauuaauucagugguucucaaacauuuggccuuuuauacucuuaauuaucagugccccuaaagagcuuuuguuuauguugauuauaucuaucucuauuuacuauauuaggaaguaaagccaagaaacuuuaaaaauguuuauuaauuuauuaaaaauaacugagggcugggcacgauggcucacgccuguaaucccagcacuuugggaggccaaggcgggcagaucacgaggucaggagaucgagaccaucuuggcuaacauggugaaacccugucucuacuaaaaauacaaaaaauuagccgggugugguggugggcgccuguagucccagcuacuugggaggcugaggcaggagaauggugugaacccaggaggcggagcuugcagugagcagauaucaugccacugcacuccggccugggugacagagcgagacucugucucaaaaaaaauaaaaugaaauaaaauaacugauaaacucaugugaauauaaauguacuuuuaugaaaaauauguauuuucugaaacaaaauaacuacagugggaagaguagcacuguguuagaguuuuuacaaaucuaaugauuggcuuaacagaagacuagauucuuaugucugcuuuugcauucaauguauuucauuauuacaugucauacagucucuggaaaacuccuuauauacucaugagaaaauaaaagugagaaagguaaauauugucauaguaagaucucuuaaguaguagauguagauaacaaaugcuagaugauaaggauccugauagguugagucauagauuguaucaaaccagcaucuccucuuuuuuuucuauuugaaaauuguacacuaauaggauuguaagggaacugaaaaccauauggaucauuaaagaaaugcaaagcaaaaccauaauuagauacuacuucacacccacuaggacggcuguaauucaagagacaauaacaaguguuggcaaggauguggagaauuuuagaaccuucauaugcugcuagugggaauguaaaauggugcagucauuuuggauaagagucugggaguucuucaaaagguuaaacguagcuuuauaugauccaauaauuccacuccuagguuuguaguuaagagaauugaaaacauacauccacacaaauauuuguacauaaauauucauagcagcauuuucauaauugccaaaaaguggaaauaacaaaauauccaaccgaugaauggauaaagaaaaugugguacauccauacaauggaauguuaaucaacaauaaacaguaaugaaguacuaguacauguuacaacauaagugaacauuuacaacgugcuaagugaaagaagcucaccacaaaagcccauauauuuuaugaucccauuuagauaaaauggucagaauaggcaaauccauagagguggaaaguagauuagugguugccaggggcugggagcaguggggaguggggagugauugcuaaugggugugaguuuucuuuuuagaagacgaaaauauucuaaaauuggauuguggugaugguugcacagcugugaaccacugagcaacuaaaaaccauugaauaguacacguagaaagaaaaaguauagaaucuaggcaguuucuuguggauacugcuuguccagcagucccuucaagggaggauuguuuuugucucacaucucacuuaccauauggcugugugcucucuguucuguguccagaccauuucuuccucuuucuugcaaaaggccugcucuuuugauacuucugacuuacucucaucucugaauguccugguaacuccccaucauuccuugaagauacaaggcucuggaucaaccagaucccaacaacugucauuguuuuuguuggcuucuacaccccuguguauuaccaguccuacagcuggccuucauuuuucuaacuucuucgugucucaugaccauuuccuuaauuuuacuuuagccaccuacuccuuauauccucaauucugaccuccaaaaucgcagaugcuaacauuccacucuaugaucgugaucuuuuucauuuuccuuguucauuaaucuuauuacagcaguuccucaguaacaucuuuaccacuaaucuuaaaauaugugcgugcuuguacgugagcacagacacacgaagucuuaaaugagagggaaaauuuauccuggaaaaaaaauuucuuggccaagacugaaauguagaaaguaggauagauuuagucauuguaauucucaagugcguaaugaggaccaguguguugaaauuauaauagauaaaccaauauaauccaaauuaucugcaaauauuuucuaauaacuaaagcuguccugaaauugaagugaaccucuguagacuagugagugcuuaguuacuaaaaguauucaagcaaaacuugguucucuauuuaauugagaugugcuacagcagggguuagcaaacuuuauguaaaggguuagcaggcuuuccaggcuagaugggcucuguuguagcuuuucaccucugccauuagagcaugaaaauaaaagccauagacaauauguaaacaaauuggcauagccauauucuaauaaaacuuuguuuacaaaaauaggcaggcagcaggccacauucagccugagccuguaggcuguaauuugcugauuucugcugcagcggauguuccuucaucauuguuugggguuuguauaggaugaauccuauagguucuuuuuuuuuuuuuuuucccaacaaugcuuuuggaaaaagaauuucuacagguucugucucuucuuauggaggacacaagauaggcauuugucauuccacauuuugcuaaguaauuaguauuugucuacauuugaggagaagggaauagaguuuuauugauuaaagaaaggcugauuuucagaaacacaggauacuauuuuagaugauaagaauuuaauacuuguuacaauagcucugauggaagagaauguuaaauucuguuuuaaguaauuuugugugccuucccuguacuugccaucaguuugagcagaaugcacuaggcuuaagaauuuggaguaaaauaacuacacuaaaaaaauuauugaaagucuaaaauguauauauaugccuaucucuuuuaguaugccuuuguauaucauauguuauuauuuuauuuuaaaaguuauaauauuuguaaaaacuagugaacaggcaacuaauuuaaaaacuaaaucaugguguucuuuauuuuguuuuagcagaaacauaccacuuuugagcaaccugucuuuucaguuucaaaacagucaccaccaauaucaacaucuaaaugguuugacccaaaaucuauuuguaagacaccaagcagcaauaccuuggaugauuacaugagcugguaauuacuuuggccccuugcuugauuggcagggugguaugauagaauuaacaugggcuucugggccaaauaaaucugggauuaaauccugcucuuuuacuuuaaagacuuuccaucuucauauuauuuuuucagcaucaguguuuucaucuauaaaauggaaagggggaagugguugcaauaaugcauauuuuuaaggauuguugugcauguaguuucugucauaucguaaucuguaccuacaaccuauaaauauucuaaggauguaaaacgucuugauaaucauguauugccauacagauaucucucuauuaagagagagauuuuaaagguuagcauucuuagagcagauaaagaguagaugaauuuuuucacauaagugguguuaauuggaaagugauagcuucuggaagagauugguuuuuacaguucauguaguucuggagguauucaaagguguaguauuugagugaauaggaaugauggauaagugaagaaguucgaugaugagugugcugauagggaacacaagggauacuacaaaagaaaaugaaugacauuucagagaaaggaaauaaagggaugcgauacauuauaaccaucaaccgguggcuauaucuuuaaugucuuaggggauagcuuaaauccguguugucuuuugcguuucauuuucauaauguaauccuugaucuuaauuagaacuggucuuaaagauuuuauaacccagccucuuaccuacuuaauauaguuuuacuauauauugccucauuuuauuauauguagaauauucuaaagaaugauugcuaacuaaaauagcgauaauagauauuucuugugauacuagguuaauuauuguuaacaaauauuuguggagcucuuuugugccaagcauuguucuagguguugaggauauauuaauagcaaaaaggcaaacaaagcacaaauguauacuggacagauuuaagcucaaaggccaaacuccugugauguaauuggcuuucugauauuucuagcaagccauuauagaacauuauuguuuaaaaaaaaacucaaaaucuauggccggccacaagcugauguuugcuaaauucauauaaaauaacccuaaccacuuuguauuuuaaaugccaucuuuucaaacaaagauuucuugucugcauacaaauauuuacuuucagaaagaauuccccaaaauuaaauauccggugguggcauaucuggaauaagugucagcuauaucaugaaaacuaacuuggguucuguuugauguaacacuuuuaaguuuauaucagucuaaaauacaugaaacugaaucagacuuauuuguuaaauuguaauguuuuaaauaaaaauauauauauauuuccuaguuuuagaacuccaguuguaaagaaugacuuuccaccugcuugucaguugucaacaccuuauggccaaccugccuguuuccagcagcaacagcaucaaauacuugccacuccacuucaaaauuuacagguucgauaagcuuuauauaugaugguauauguuaagauacaguccguuuuacagcuuuuauuuuuauagcaucuaguuaucaagaaaggucuuaagaacuuggccauucuuauuuccacuagacaaaacuuuucugauauucuaauaagagugugccuuguggcuuugagagguugguuauugaagaagcuuacgaagcuacucuuaauaacuaggccaaaggauccaguuugaauagcuggauaaaauuucucuuaugaaucaagguuaccuuuuauuuuuuauuuuuauuuauuuauuuauuuauuuauuuauuuauuuuuugagacagagucucgcucuauugcccaagcuggagugcaguggcgcgaucucgggugacuacaaccucugcuucccagguucaagcgauucucgugccuuagccucccgaguagcugagauuacaggcacgcaccaccacaccuggcuaauuuuuguauuuuuacuagagacaggguuucaccauguugcucaggcuggucucaaacuccuggccucaaaccauccgcccgccucagccccccaaaguucugggguuacaggcaugagccacugcgccuggccagcguuacuuuuuguuguguuuugucagcugcuagugagcagcuucauuuuguuuguuaguauacaauucauuuggaaauguaaauuuucaaaaauaucagaauagcaauaugagguacugcuagaauguauuauacuaauaacuaaacuaagaggaaagauuuuuugcugaugaggcaaaaguugguuucuaguaacuguccuagaggcagcuuaauacugguagaaaacaugggccuuggagacacugggcaugaaucuuagccucacuacuuacagucugugugaucuuuugcaaguuaccuaaauuuucggugcccauuucauuaucuauaaaauuaguaaagcuaacuaccuccuaggaugguugugaagauuaaauuaguuaauauagacguaacuccuaauacagagcaugacacuuaguaaaucagaaauguuaguagcaauuguuauuuaaauaaaacaauaaaaaacccaugaguaauuaacuauaaaaaucaacugauaaaaaaauuagcugacagaauaagaacagugguugucagggaagggaggaagaauggggaguuacuguuuaauggguauagaguuucagugguauuugcaccaccauccaucaccagaacuuuuucaucaucacauacugaauguacuuaaugccacugaauuguaccuaaaaaugguuaaagugguaaauuuugcauuauguauaauuugcacaguuugaaagaauaauggacaaaauaaugagcugacaguagauacuaacuggaaagaggugauaguguuuuaaggauugaaacaauauaauaaauuacaaaggaaaaacaaaaaugauccaguuuguucaugcauugauucaaaacacauuuauuuagcuauuacuagugucaggcccuguuugaguugcaauccagaagacgagucacagaugacaagugaaggggcuugguggagccuucuagaagaggccagugucagaagagaacugaaacgaggccacaguguggcuagaggucaggaaggggaaggagugaggcccaagguuugcugggcccuuaaguuuuacccuaagagggugggaagcuuuggaagagguugaagcagggaagugaaaugauccaauuugcauuuuggaaacucuaaccacagugaguagggcauacuaagggggaugcgggaaguccuguggaggaaaccagaguucacauuaguguugagucagaaauaagaauuacuuuauucuaaaaacugucagcagccguggagaaaggacauugaacugcuuucuucccuuggcaauguucacaguuuuaaauaugaaaggaagaagacagagaaggcacaaaaggaggaguggggaaaccuugaugaaauuacaacacauacauguuuagaagcccaauacuuuguuacaggaaauauauauagacaauguaucucaauccuagaggugaaaaaauuagaauacuuaucuuuuuauuuaaauaggagauuacaugagagauucuaccauuuggaaccuaaagcaggccuuaguuaaauugagguuuauucagaccuuguuuaacuugguuaaucagcuaaucaggaggucuuuuuguuucaccuucuuuaucagcucagaauaaguccucucagcacuccaucuguucaaagcauuuauagguacacagagagauccuccaauauaagggaaggaaugauggggcugguuguauaguacaucaacugaaaguuugcuggggaagacgcugagguucugaaaaauuaaguaacuuguugaacaucacucaggacaaaguugggggcuguauuaaugaguucuuacacugcuauaaagaaaagagguuuaauuggcuaaugguuccacaggcuguacaguaggcaugaugcuggcaaucugguuggcuucuggggaggccucaggaaacuuucaaucauggcagaaggugaaagggagcaaaugucacauggcuggagugggagggagagagagaguugggggcagaugccacauacuuuuaaaugaccagaucucuugagaacucucagagaagcacugaggaggaaaucuacccccaugauucagucaccucucaccaggccccgccuccaacauugggaauuacaauuugacaugaaauuugacagauccaaaccauaucagggacauugcugaaauuugcauuugucucauugacuuuggagcucuuagcaccuuagcacauugcuuccuuuauaauauaacgcuaaaugagaaagaagaauacagauauagccggaugguaguggcaugccuguaaucccagcuacucgggaggcugaggagaagaaucgcuugauccugggaggcagagggugcagugagccgagaucaugccacugcaguccagucugggaggcagagugagaugcugucucaaaaaaaaaaaaaaagaaaagaaugcagcuauaauuauguguguguauauguacauauguaaguaaagagguauaaggaaaaagaauagaaaagaaaaaugaaaaauauaauuuuauauuuuauuuuuauauauauuuuuaagcuuauaaguuugcagauugcauauuaagugguuuuuuccuccuuaaauuuucuuuuuaagucaaaacuaguuaaagggggagaccuuggaaguuugucuacauuauuuuuuaagguuuuuuuucuuugauuaaguagagcaaguccuuuuaaaaauauuguaacauuucuaauuaagauuuaagauaauuucaaaauggggagcaguugacuguaccaaauguaagcuaguuucuuagguauauugauuaacuuuuauuuauauauuuuacuuauuuagguuuuagcaucuucuucagcaaaugaaugcauuucgguuaaaggaagaauuuauuccauauuaaagcagauaggaaguggagguucaagcaagguaaguaucuuaaaauauuuacgaaauaaauaaaaauauuuuaaacuuucuguuuuuuugucuuuuuaccugugagggcugcuuuuccuuuacuucuaggggcgaugcugcccuugagccaaaaagccaucuuaacaccugccuuucucuucccgcugccccucacaugugacauauccucuuuagaucucuuauucccagucuucugccuuuccuuucaauguccugugcuucuaaacuucuucuuuaauaacaaaaacauugacaugggguagcgaaugaccacuauguauuaucacaaaagaaucagaaauuucugagucagaaugugauguaaauugcuaauauguuuagaaucauucagcaaggauuuuuacuaauggauuuuguuuucuuuugaguuauucauuucagaaacagaauucaguaacaaaugaauuucuggaauuagauuauuuucuaaauuuaccugaguucuaaauuuauaucguuuuacaucucuggauagaaggcaucuuaagcauuaucuaaauuuaccaucauuaauugucauucaauuaaaucuacuuccauuagauuuuugccuucaucacucaccagaauaacuguaaucaagaacacuaaugaccuccauuuuuuugccaaaucuaauucuuagcuuagauuuuggauuacuuagcauuugggacaacugauuuuuuuuuucgcagugaagcuuuuuuccgcacuugguuuguguuuuucucuucucaaacuguccauaccuauugucuucuucguguuacugaucucagugaagcacugcuccgggcuuaguccucagcauucuuucaucuuuuucuuaaacucauucauugguguucucuuucaaucuugugguuucaaauaacauguguaugcugacaauucccaaacuuguauuuccagcucauaccucuccuuugaauuccagacuuguauauucaacaucgcuucuuagugucuaccaggcauuuaaaacaauauguccaaacacaacucuugcuccauagcuuuucccauuugaguaaauggcagcuucauucuuccaguugauugaacaaaaaauuggugccucuuacucucauacacauaucuagccaaucagcagaucuuguuaguucuacuucaaaguaucucuagaaucuauuucucacaucuccagcauuauuauuuuggucaaggcaacuuuuguauuuucaccuaaauuacuuuaauagccuccuaaaggaauucauuuacucaguccuugcccuccuggucuauuuuuuuaaauuguauauugacaaauuagaguuguauauuuuuaugggguacaaagugguauuagcuuuuuaaauacaauaugaaaugauuaagcuaauuaacaucuauuaccucaauuauuuguguguaaugagaacauuagcaauugacucucugcaauauugaaauguauaauauccaauuauuauuuucagcaugcuaugcuaaucaucuaaaaaaaaucaaacuuguuucuccuauuugaggcuuuguaucccuucaccaacaucuccccauuucucucaaccuccagccuuugguaaccaccauugucaaagguaguaugagcucugcucuaugaguuuaauuuuuagauuucgcauauaagugagaacaugagguauuugucuuucuguauuuagccuauuucaguuccuccuggcuuauuuuaacaugacauccuauuuuccucuagauauccucaugugucuucucaguuaggccuuccuugcccacacuguaaaacuucaacucccaccuuucaaucaccaguguucuccauuccccaccgguuuguuuuucucuguaucuuaccuucuaacauguucuguaauuuacuuauuugguuuguuguuugugucccucugcacuugaaugugagcuccaugaagauagggauguuuuucugauuugcucagugauauuagccccugcauccagaacaguaccuagaacagauagggauugaauuuauuaguugaauugaguaaacugucuguccucagcucuuuugcuauuguaaguuguuaaggaugacacauuaaacagacauuguuggacucauuuuaaguuuuacuguaauuuccuaaucccacuaacaauaauuagaauugcauaaggcugucuuauuaacuuaccaaaaauaagguaugugcauuaccauguguaucaacucuucaauaaauauugguuucauuauacauuuccuuuuaucaaucuauuugaauuaccuaauuuaauugcuuucguagaaauuacuugguuaauauuuauuauuuauuuguuuuuuggcuauauuuuaguaguaucaagguauugagacuuaauagagguauuuauuuacuuguauguuuucagagaauguagaguagucuuaauggcauuuuaacauuuuuuuccuuggaguauaaugaagguguaagcuuacuuaagucaagggccaagugauaaagcaauggcuggcccauauuuucugaauucaauuaaauuaucauuuaaguuaauuaugauagaguugaaaaaaaucaaaugccucaaagaaaguaacaugcuuuaugaaacuaauaccauuuaugcuuugccuguuucagaguuuaggcagugaccaacuuuuaaggaggcuauugagaguaucuagaacagucaugggguaaugagaauggucaagacacugguaacuucccauaaaacuaacaaaucacaacucugacacuaucucuaugaaacugaaauaaggcuuaccuaaaccggauugcaagaguuuugccagaacagagacagugggggcaauaauaaacucauucaugcaaaaauugcuaaaucuaggcacaauagagaaaacaacaucugugaauugaauugacucuguaucauagccuuuagucauccuuaacuuuuuuauuuuuccuugagaccgugucucacuauuuugccgaggcuggacucaaacugcugggcucaagcaauugucccaccucagccuucugaguaguugggauuaaaggagcaaacuacugcaccaggcuuguccuuaacauuuuggaaagucuuuuucuuuaugcuguuucccuguuuagggcauccaacagauuguuauauauaucugaaguuuaaacuuuucuuacauguugauauagaaacuuuagauuuauaccuuuaaauuauugaaugcccaucaucauaggucauugggaauggacuguuacucugcuaucagaauuauuuuucuuccuucuacacucaaaauaggcccagaaacuuuuaauguucaugucaguauuuccuuuagaauuuucucaaccuaaaauccuaauaaauuuagaaucauugugugauaguguauaaauaguauauucuaaacuucucuuuguucuacucuguagguauuucagguguuaaaugaaaagaaacagauauaugcuauaaaauaugugaacuuagaagaagcagauaaccaaacucuugauaguuaccggaacgaaauagcuuauuugaauaaacuacaacaacacagugauaagaucauccgacuuuaugauuaguaagaauucuuuuuaaauuuaaaaagaaaacuuuuugccauaauucuucagguaaauauuuaguaaacuuuaauauaaccuagccauuuauuguuuuguugcuuuuauuuguuuaauugcagugaaaucacggaccaguacaucuacaugguaauggaguguggaaauauugaucuuaauaguuggcuuaaaaagaaaaaauccauugauccaugggaacgcaagaguuacuggaaaaauauguuagaggcaguucacacaauccaucaacaugguauuuaacaguuuuuuuauauuuguaagguuaaaaucuuuguuaauagugucaucuuagagaaauauaccuauaauuuuagggcauugguuauuggugucuuuaacgagaucaacuaaauaauuagaaguuuauuuaaagauaaaggaacaaaaccauuucuuaaaacaccguuaacccaaaggauauaggacaucaacucaaguuccgacaucuguaauacaaaauguauuuuucucaguauuaacguagucugucauccuuaucuccaaauacuuggauuauagcaggucuaagacuuugggguucaggcauccugaaaauaugagauguuuacuuuauucauucuccuaaucauuuuguauuguaugcccugugugagaaguugguuuuuuuguuuguuuuuuacuguuaggccuaccuucuggguugguuuuuacuuguccuugguucuuuuuaggguuuuucucugccuuuaccuuauccuauauauuuuuuuguucuuaauaacuguuauccuaguuaauuguaauuuaucuccuccucaucucucucucuuaaauuaucuuaaaagauaauucaccagugaucaagaucagggcuauagggguggagaugucaggagcauuagggucuuacugucuggcaguauaauuugugaugcucucuagugggcagugaaucacagugguuaagaggauagauucugaagccagacugucuggcuucaauucuaacugucacuuaggcugugugaccuuguacaaguuacuuaaacucucauugccuuagcuuccuugccuuauaguggggaugaugauaauacuucagcauugaugugaagauuaaaugaugcaguacuguauaaacaaugaacuuagaacagugccuggcacauaacaagugcuauguaaauauuugcagaauauauaaaaaaauuauugaauuggguucacuaauugaaggaauaaauacagcuugaccuguagacugugaauuuuuugguccuuagaauguuuugcauuguuuaauauuacaguggauuuuuauuuuaaaggcauuguucacagugaucuuaaaccagcuaacuuucugauaguugauggaaugcuaaagcuaauugauuuugggauugcaaaccaaaugcaaccagauacaacaaguguuguuaaagauucucagguaagacuuaauguugguucucucacaguagaguucaauucuuuuuuuaccugugaaguauuauauugcaaaugaguguuauauuuuuaaucaccucauucuucaaaggauuugaagucuuuuaauaagaauagauuuaaaaauauaaaccaugaucauuguaauguagaauagaaagucaagaucaaauaguaauaucuccagcaauugugaaugguuuuccuauagcugaaguagagaaacaguaauaccuuccuuggaaaucacuuggucgugaucaaaaauugaccugaaaauuuggcucagaguuuccuuguagcaaagagggaguugcaguuauauguuuuucacugucuaugagguaagaucauuuuuauucuucuagagaagccgaccuuuuccuaucacugaaauuggaaaaaaaauucuuaagugggccuucauauuguaaaugccauaaguauuauaagcaacauuuuuauaauagauauugcaacagcaaacuaaaagacguuguucuauaaaaacuaaagcaauggcaccaaaguauaucuaaaagauauucuugcuuggaaccaagaugauauguuccauguuuacagauuuuugaugugaguccaccuuaaucccaggaguaaaauagacuuuguuaggaggaaugauggacgacaugcccuauuugacagucaugucucuuuguaucaaaaguauggcagaucaaugaguuguaaaucagcuugacaauaucuuccaugucaaggcccuaaaguagauauauucuguguuuaaagcaaaccauguauuuuagaagaaaaugagcucauuguaagguuggcauauccuacuguagaaacucagaggacuacugugagacaaagcuagaugguauuuuuguuuguauauuggugggcuuauuuaaaaaauauauuuuuuuaaaguugaguauguuacaacaagaaacgaaugguaagucccucaauggccucaaaguuuauggccauuaauaggauuuuagccuggagaguuuuuagggcaggcuuuacuaguugcccaguauaaucauagaaaaagcacagcauucugaaaggagucacuuugcugauuaugaacccaacucguuuugcugcaguugugaagaaauuugauauauauaucuuaacguugucagcaguuauuugaaauuugcaaggauaucauugaaauuuauaauuacccaaguuuccaaggaucuggcauuuguauuuuuaagaaucuaaaacuuaaaguauaauaauaauaauaauaauaauaauaauaaucucaaaaaaaaaucuaaagcagaauuaaauauuuucauugauuuguguuuucucugacuuggcauauagguuggcacaguuaauuauaugccaccagaagcaaucaaagauaugucuuccuccagagagaaugggaaaucuaagucaaagguacugaaaagauuauuuacaucacaauuaucuggcaacaguagggaaugcacuauuuucugaauaaacuuaccagauaacaauuucuuuaaguucuaaaacuuuuuaggccauuacagagacauugcugguuuuuuucguuuccaauucuuacuauuuuucaccacuuauucguuugugaauucuacauuuccaaguacagcuggagaauguaauuguuuucuggccugccacuggcuacuuuuccacugacuuuaucucgcuaccucgaugaguuugcguuagccucaugggugcccuuuguccggggcuccuuuugccuaccuugaugccuugggcucccaggcuaacccuucuuucucuacaucaguguaaccaagugggugcaagcacacauugucccagggaccuguauucauucaagucauagaucugccucuucauuaacaacugucuuuggccaagugacuugccuaguuucccugucucuaaauugugccuauagacagugccuauuguaaaauaaauugaggauuaaaugggaaagaauauauaaaguacuuaguacauuuauccagcucagaaucauugcuugauaaauguguuuuuauuuacuaaauuuuauuuuccuccuuagaaaaucuggcuuguaaguguuuuucaaauaacuggcauacaauuuugccaaauguuuucauaaaauucuuuuuauauuuguuuagccuccacucuucuaaaacuuaaauuucuuguguuuuuauuagacuuucugugguuuuguucuucuuaaauaagcaguuccugacuucauuuaucaacucuauuuucauuugcuuuacaacuugaguacuugugauaaccagaaacuuuucucuaugauuaaccauauuuaugguuuaucauuuaaugcccaugacaauguacuuuuauaauuucuauaucagaguugagaaaacagacacauagcauuaccaguuaguaacacaucuucaagauauguuaaagguaauauuaauuucauauaacuaauuauuuacuugaaauagcugaaaugauuggaauuguguaauuggcuuagauauaacuauucuauuuaaaagaauugcuaacugaauuaguuuuuuacuuugaagauguuuuaaagcuuguaaauacuugaggauuuuggacacaagcuccgcauaguucuauaguauaugugcuuggguuuaaaguuguauugcuuauuuauuauuuccaauggucuugucugaaggguugcauaauuuaagcaaccuuugaaacuguauacauacuuuguacuuauauaaaaauuuauuauaauccaguaauucuggggaaaacaaacuuaaaacuuacauuuuuuaauuuuauauuuucacaaguugggaagaauuuaauauuuugucuuaauugcaauauuuuaauuaugagguuauagaaagauuuaaaguaaagcucauaucuucugauggaauaaccaacugaaaugaaaacuagaaaaagauguuuugucauguuaacauaauguaguacacauucauugagauuuaauuaugauuuuaaauauguauauuuaauauauauguuuuuucauuuuauaugaaaauaacagcaacuuuuuuguguuuguuuguuuuuuucuuagauaagccccaaaagugauguuugguccuuaggauguauuuuguacuauaugacuuacgggaaaacaccauuucagcagauaauuaaucagauuucuaaauuacaugccauaauugauccuaaucaugaaauugaauuucccgauauuccagagaaagaucuucaagauguguuaaagguaauauuaauuucauguaacuaauuauuuacuuaaaagaaauaguugaaauaauuggaauuauguaacuggcuuagauauaacuguucuauucaaaagaauugcuaacugaauuaguuuuuuuacuuugaagauguuuuaaagcuuguaaauacuuggggauuuugcaaaagugccuugggagaaauaaucuugucauaauacuuuagugggauaucuaaaaaguaacuuuuauaauauaauguaaucuggaaaaauacuuuaucaauaucauauaugaaaaccugcuuuguuuuucuuuuaaaauaucuuuguuuuaauaguguuguuuaaaaagggacccaaaacagaggauauccauuccugagcuccuggcucauccauauguucaaauucaaacucauccagguacuacuucuuuaaaaauuuguuuauuacuagauugguaguauaaacagucuguuaccuauuaauauaacaaagacagaaucuaaauuggcuacccuuugucagccugccuuuuuccuuaaggaaguuccauuauuauaaauaguaaaguaaauaaacuuuuuuuucuuuacuucugguauuuauuuuuacuuauuccagauaacggguuauaaucagugauaaauuauaagaauaucacuuugugcuauuaaacaaaauguguauuuacaauggacuuauauuuuucuuacugguacuaguguauuauugauuuauuuuauaguuaaccaaauggccaagggaaccacugaagaaaugaaauauguucugggccaacuuguuggucugaauucuccuaacuccauuuugaaagcugcuaaaguaaguaugucuauucuuuacauuaauuuuuacuguuuuauauagugaauucgacacuuaaggaaacagguagucugaagaaaaguugguccaaucaucagaucaguuaugaaacauguuucuacauuuagauacuuaacaugugcauuuugacaaauaucgauuuacuugauuuauauucuucuucugcauacaguacaguucaaaguagaucaucacauaaggugcauucaaaagauugcugucacgucucaacuggaauacauuuaauauaggaauauagugugucuuuuaauucagcaccauuauuaauacagcuuuugaauucauuccuuuuagccaguuuuuuccuuagagacauuacauguaauggcuuuuuugaagcuguacacagcaaucaacacaauucucaaagcacaagucucaagcuuuuuagcuucccaauguccauuuauaucuauaccaugauuuuucaaacaccuaguuauuucuagaacccugugaaugcuuauugaccaacugauuuagccaacaagcaguuacuaauuauguauuucaguuacaacauuaucauaaaauuaugggaaccuaaacuaucaauacucguagcucucuggauacauauaaaauccaucuaaguugccaagaacuugaauacauuuuuugaaggaauuuacuauauauucacuauauuugcauuuauaugauaugagguaccuguuuucuuaaauuuucucaaaugcuaauggcuaaaucaauggauuuaguaauuaaaaguggaccaaauuuguuuuguaauugcucuguauuuuguaucuccauguuuuaaguuuauacuaauauauuauucaaagccucuuauagcuauaguugagguggauuauuuuuauaacugaaguuguauguuccuugagggcaaagaugucugccaucuucauaaguuagauguuagcugagucuuaaaucauuuuuaaauacauggauuuuaauauauaucuaauuauuauauuuauauaauuuguaaugucuucuauuuauuagcuuauuaucaucugagaauauaaaguuuccuaauaaauauauuuuguauaggaauuuaccuaagacuggcuuuauuuaagaaaaaguaaagagauaaagaaggccuugaaggcucauauguauguuuauuaguagcucuguuauauuucucucauagaaagauugaguuauaucucaugauagguaaugcuuaaggccaagcuucguguuuaaaauucuuuauuaucucuaauaguuuauaaaauaauuucccaacuguaagaacaagagagaaauaaauguauuauauuuagaauacaucaaaauacaucuacugaugugacaguacauuuaacuaaaaaauugcaaaacagauuuguguuuuuuaauuucagacuuuauaugaacacuauagugguggugaaagucauaauucuucauccuccaagacuuuugaaaaaaaaaggggaaaaaaaugauuugcaguuauucguaaugucagauaccaccuauaaaauauauuggacuguuauacucuugaaucccuguggaaaucuacauuugaagacaacaucacucugaaguguuaucagcaaaaaaaauucaguagauuaucuuuaaaagaaaacuguaaaaauagcaaccacuuauggcacuguauauauuguagacuuguuuucucuguuuuaugcucuuguguaaucuacuugacaucauuuuacucuuggaauaguggguggauagcaaguauauucuaaaaaacuuuguaaauaaaguuuuguggcuaaaaugacacuaacauuucaaaguugua

SEQ ID NO: 16070 - RNA, 7004 nt, Homo sapiens
cggaagcgcagagaagcccgguauaaaaaaaguacugaagacauuuuccccgcacaacugcuaaagcuccagagacacgagcguguguggcagcaagagccgccaguucgggaccaccgcagcugggguggcagcggcgcaggaggggucgcggggagggaguggugagcgcaggcggcaggggucugggaaagacgaagucgcuauuugcugucugagcgcgcucgcagcuccuggaaguguugccgccucucgguuucgcucucgcucgcugcgcuccuagaaggggcggccgccuccaggugacacagacgggacucucgcuugcgcuuuccagaugcaucagagauacuuuuggugcggggcugcucugcggggcgcggugcgcggcuggggacuguaagggccgggggagggagucuccgaggaggcccggggucagggaacuaucgggggagggggcgcucuuuuccuggcgggccucugcucuccgccgccgcgcgugcucuccgccgccgcgcguccucaccgcgcuccuuucccuuucuuuuuaggacugaccagggccaaguggcgcucggcgggcacuacauggcggagggugaaggguacuucgccaugucugaggacgagcuggccugcagccccuacaucccccuaggcggcgacuucggcggcggcgacuucggcggcggcgacuucggcggcggcgacuucggcgguggcggcagcuucggugggcauugcuuggacuauugcgaaagcccuacggcgcacugcaaugugcugaacugggagcaagugcagcggcuggacggcauccugagcgagaccauuccgauucacgggcgcggcaacuuccccacgcucgagcugcagccgagccugaucgugaagguggugcggcggcgccuggccgagaagcgcauuggcguccgcgacgugcgccucaacggcucggcagccagccauguccugcaccaggacagcggccugggcuacaaggaccuggaccucaucuucugcgccgaccugcgcggggaaggggaguuucagacugugaaggacgucgugcuggacugccuguuggacuucuuacccgagggggugaacaaagagaagaucacaccacucacgcucaagguaacaccacccgagaugcacuuggguccugacccagucugggccgggugugacggggagcgggcagaggggcaucgguuaaaugccaugaaucuguggccaucacgaguuugggcgcgcguuauuucuuugauuuuugauuuuuuaaaccaguaaacugacgugcguggacgguguugaguguuucaguuuacuugaugcuuuggcgcuacaacucuucucccagguccuccucugcccucucuucucuucuuucuccuuauguuuuaacucuuggcuuucccuguuggagucuuguccagaguagauucugauacuuggcagaaugaaaugauguaaauaauuuuugagucauuauauuugagucuagccuuugggaaaauaacagccugaagcagaagugagucaaugaguuuuuuauuguacuggaaaaggugaauagauuucacagcggcauucagcugacuacguguuaaaggucuaucuggugguucuucgugcugguucauauguuaaggguauaguggcacccccuccccacccuccacuuuaguucaagacggguuuuauaugauuaguuaaaauugucugaggaggcaggcuccuggaaugucauaauuuaguuuauauuugauuguaacugcagggugccccuggagggacacacaagauacugauaacauugauugccgcaggcggagaggaauuggguggcuuggaacaagggcgagaggcugacuaaccuaccgcugaaugcccuuccgagucuuuugaauguuguuuggauacugugugaauauugugccuauuagaccguuuucaaaaaguaacacuuaaaaagucagacaugacaacaaaaccucuuacuacugugcuacgucugccaaaagccucaaacuauuaccucuagucccuuucccagacaguaaaacuacucguuaaaaguauuuuuuuucuauuuucagaagaccguuuaagccuguagguaguguuuggcugaaacuugacaaaacaaaagggaaagagcaaaauaauucucagcugugaagaggauguauuuauuuauugauuuauuauuuucuagguuugcucauuuuguuuuaucuuuuaaauuguaggaagcuuaugugcagaaaaugguuaaagugugcaaugacucugaccgauggagucuuauaucccugucaaacaacaguggcaaaaauguggaacugaaauuuguggauucccuccggaggcaguuugaauucaguguagauucuuuucaaaucaaauuagacucucuucugcucuuuuaugaauguucagagaacccaaugacugagacauuucaccccacaauaaucggggagagcgucuauggcgauuuccaggaagccuuugaucaccuuuguaacaagaucauugccaccaggaacccagaggaaauccgagggggaggccugcuuaaguacugcaaccucuuggugaggggcuuuaggcccgccucugaugaaaucaagacccuucaaagguauauguguuccagguuuuucaucgacuucucagacauuggagagcagcagagaaaacuggaguccuauuugcagaaccacuuugugggauuggaagaccgcaaguaugaguaucucaugacccuucauggagugguaaaugagagcacagugugccugaugggacaugaaagaagacagacuuuaaaccuuaucaccaugcuggcuauccggguguuagcugaccaaaaugucauuccuaauguggcuaaugucacuugcuauuaccagccagcccccuauguagcagaugccaacuuuagcaauuacuacauugcacagguucagccaguauucacgugccagcaacagaccuacuccacuuggcuacccugcaauuaagaaucauuuaaaaauguccuguggggaagccauuucagacaagacaggagagaaaaaaaaaaaaaagaaaaaaaaaagagugauccagcccuuauuagggauguguuuugugcaaugaugauaugcuccugguuuuaaguuuggcaaagcuuauguaucuuuuaauagaugugggagcaugaucucgaaaggauccuuuucccuucucuuauucuccuacccaauuggauucuauccugcaaaaaaagagagaccugucauuagaagcaaccagguucuccugauacaagagaagaaaugugugaugacaauauggguuugcuguaucugcucccauagcuuugccauaggaaaaaaaaaaguggaaaguuucuuuuaagauggaauucauaaaagggaaaauacggaggaaaaaaggucucacuccaacuugugaaucaguuuaggaguucagauauuaauaguaacaauacaggaaaaaggggaacuccaacguugggauuacugucugaggcuuguagcaagugcuuucuguggaaugaucuuguuuugcuaacaaacggcuugcuccaaaugaacaguaguagguuggugcaguucucguaacaaucagcagaacuuaugaugacacaauccauuaauuccagcugcgugcauagaucacauuuuuaaaauguaaaaaugcaagcaaaaacagcuguaacaaagaaagugugcucaaggaccaaagauuuaacagauaaaaauacccaauuagaagagauauaguagacuauaugaagagagauuauauuuguuacacaccaauauacaucaaagugccuguugccuucugaaaauuugaaguggcaaaauuauuuuaugguuuaaugauuauuuuauuuuaucagggacugccucaagaagaaaauaacauaagcuugugaaugguggagaaaaugcccuauuuuuucuugcaaauacuuguauaaaguuaacauuuguugaucugauauuaucauagguacauguguauguguguauaaauuauauguguguguguauauauacauuuuauauauacauuuuauauguauauauacacaguagauugacuaugaucuagaauaaugucucaaauaggaaauguuuaaauacuguguguuuuuauguuuucaacaggauaacaugagacgugggcauauugcaaugaugaauuaaauccacaucuaaaaaaauuaaaugaaggagggaaccaaguaauauauuucauaggaagagcagaaauuauacuguuuuagugggauuuuuuuuucuuuuuuuuuuuuucuuuggugagccauaaaauuccacaaaugggagaauauuuguuuggcagagcacucuuuuuuauauugaacugccauuuugacaguuggaacccauuuauuaaaaaaaaaauugcauuccucuaugauguuuaaucuaguggaucauggaucaguaauaggcuacuuaaaucccugacugcuaaaaaggauuuccggugaucuaaacacuacuugcuaauguuuaaaugaauuuuaaugaaugcauucugcauuucuggaccacuagaauuuaguaaugugaaaugacccuuuuuacagaauauuugcacaauugcuuaaaauuuauauaugagauauauauuauauauaacauuuuauaaaucaugucaauaugaaacaucuuugaucugguugucacacugcauuuaaauauuuaguacuguacuuuaaaucgcuuuccauuaaaucaaauccaacuuuauuuucuuucuuacaaaaauaccaguuauaccuuugugaaaugaacuggcauuacuauuucaguucaauaacagcuaauccuaaaaccacccuuucuccuagccaguaguuccucuagauacuggucucugaaaaugcauuuguuaaaaacaaaacaaaacuaacacauaagaaccuucccuuuguguugugaaacaaccacauaaucuccacaaccuuaguggaugacugcuugcuaugauaauuccucgaagacccaauuagaagauuuucaucaucaguuaaagagagaccacgggagaaaaaaauauccuccuguuggcaguauaauuuguuuguuuguuuaucuagggauccucagaugcuuagugcuagguuaauccagguuaauccgucuggacuaccuuuugugcaucuuucuuugaagccuuaaugggaaccugauggguuugcuguagcagcuuccuugugaauucugucagagcugcaacagccgcugcacugccacucaguuuucuaaggaacuccuccuacuaccaucuuggcucagucucccucacuuaagcccuggguuugaaaaauuaauugcaacuucccaggaaacauuguucaguuugcagauuaagccuggcacucaccuaucagaaaccagagcuccgccugcuuaguuguuucaaaguuuucugaaagaaaacuaggggagcacuugugaacacaggagcagcuggugaucugcuuucuuacccuaacucuugacaaaugagucgucuacuauuuuaaagagucuggaggucucugacucugccauaacaauaaccugcuguuaauuuauaacacagauuuuuguuuggaagagccuuauuugaaauacacuuugauuuauuuucuuaaauauuuauauucuuuucuugcuuacuucaggguugguagcuuaguuggaagugccagcaccuggcaccuauucauauagaacaggcuguacucaagacaacuucuagcauuuacuuuaagacuuauauaauuuauuucuauuuuguguguacuauagucuugugcauauguaguugaacacacagugaaauauaugucucucuuuguggaugugcggccuaaaaauuugaaugucuggugagagagagccauguguauaggucagagaaaagaacagcucccgacucccuauuagcgccugugauuuguuuccuuuuguguuuaucuggccuagugugcuguuucuuuaaaccaggaagaaguuuugucuuuuggaggcucuucucaccuguccagccuggcaugucagagaacacauagccugugacaaugccguuuuuaaagguuuacuuaauuugcaguaaauccagcugccucaagaacuccuacaccaagauggacauuuccuuuccagaaaugggaucaaguaucugcucacuuugguauuggauggacuaauaauguagcuccaaaaaugcaaggauggaagaauauguguaauccaaaccaaggaaggaaaugaaaagugaacguacuguuuuuaccaccccuuucuguuugcuuauuguugguugcuucacugugcauaaaguuguuuucaaugcaacgcuuguuaaauaaauauugugaacuauuuuguaaaugaaauguauuauguugaaagcugucaguucaaaaauaagcuuuuuuguuguuguugaagaugaaguguguuaggugaaaccaaaaagccaaaaaaaguaauuucauauauagcaucuauuugaauauaaucuuucuuuaaaauuucuuuuagcauagcauuuucagugcuaagaaagaaucucuauguuauauuuuguuaaaauaauggcuuucuaacaaagcaaaugguaaaguacaaaguuggaagaugucaaguuaacgagacuugcugcaaagccuugcagaacggaggaggcucugccugcuggcugucucucccuccaaccucucuacaaucaugccugcuuugagguguucuguugcagcaagcugcaccuugggucacucuuuuggaauauuuugacuauaggcugcgucacaggcagaaaaggaguugauggaaaauggacuaaaaaacugacauguuugaaucagugcuagagggaacagauugugaauuuuguuuacagcauccaauauuuggauuuuuuuguaaauaaaaaaguuauuuuuuucuauugau

SEQ ID NO: 16071 - RNA, 2351 nt, Homo sapiens
caguagugcacaggacaaucgcacgacaaaaaaacaucuagcccaaaaugucaauaaugccacuauugagagaccauggaaauaucuaauuuagaagcacuguguuuucuauuaagaaugagacuggcugcuuugcauauugcuuguuagaaaaagaaaaauagcuaaaaguuuaauaauuugauucuuacaccaugucaauuuucuauauguuaaaacugcugacugaaaguggcugcaucacaauguuuuguguuccgagaaggauucaggucuuaguaugagugcugagaucuguuagugacaacugccaauugcacuugaguggaccacuaacagcaaguauaccauauauuugcuggucugcuggaucuuuaaaaaauuguacuaggucauaaauauauaguaaauugcaguuuuauuugucuuuaaauagauacaggcaaaauaucugaaaggaaggacaaucauuggcguugcagcaggcagguuucauacaguccuauggacuagagaagcuguuuacacuaugggacuaaaugguggacaacuggguaagaaauccuuaaugacaauaucuggaaauuaaauuggacucuuuaaaaaauuaucuuuucuuuuuaauuuuuauugauuagaaugagauuaugagugauuuuuuguuuguuuguuugagacaaagucucacucugucauccuagcuggaguucagggugcgaucacagcucacugaaaccuugacuuccugggcucaaacgauccucccaucucagccccccgaauagcugggaccagaggccccuaccaccaugcugggcuauuuuuuguagagaugggguuucaccauguugcacaggcuggucucgagcuccagggcucaagggaucugcccaccuuggccuccccaagugcugggauuauaggcaugagacacugugcuuggcuaaauaggacucuuaaaagagcuauuuugugauuugcuuauuuguaucauuuuuuagguuguuugcuagaucccaauggagaaaaguguguaacugcuccucgucaggucucugcccuucaccauaaagacauugcucugucuuugguugcugcaagugauggagcuacagucuguguuaccacaaggggagauauuuacuuacuugcagacuaucagugcaagaagauggcuucuaaguauguguauuucugugaaagaaacguaauuuuaauaauaauucaacucuuccagcaaauaucugaguguuagcuuuaugcuauguucuauaaaugucaaauggaaaaaauugaaugaggaaaaacaucaggaauuuuugucuuugauuuuugucuuuuggcauggauccagugaauauauauaaaauuucuguguaaauuguaaagugguauuucugaauuauguuuaauauguaguuaaauaugagcuauauauuuuuuucuuuuuuuguauuuuaggugcacagaaauagauuaaucauaauucuugauucgugacacucucaucauugguuccuguauagccuuuuuuacauuauacauuuauuuaucuuuagaauauaaucauauaucaugagcccucuaaccaggcuuaguguuuauaacugauaaguauauuuuuuaaaaaaacauguuauuauagaaugcaguaaaguagcaguugguugacuagucaagucaaagcaaagaaucauaaaguuuuuguuuuuuuuuuuuuaauugagacagguucuugcucuguagcccaggcuagucuugaacuccuggguucaagcgucccuccugucucagccucccaaagugcugggauuacagaugugagccacugcgcccagcuucauaaaguuuuaaguaugggugggugcaccaacuggaauucccuguguuuucauauaaaccauacucauaaugugucaccugucauuucauuuugaaugauuuaaggaaccagugcuuaaaaacaauugugaaguaauguaagugcagaauuguacauuuuuaauacauuuugaaucuuuuauaauugauuaauuaguuugacaguuuuuugcugcucauauuuauugugccauuccaaaguauucaacuucuauagacagguuucagacuaauauguuaccauuuauauaguauuuuacugugauaaauucauuauaaauauauacauuauuaguuuaaaaaaauacaaguacuuaaauaggucauuguacaaauauaaaugauucuugaaaguggauagcucaacuagugggagcaguuguguacaggaauucuggagaauagcuaucuaacuuuuaaaacaauuggggauuuaaauuuaaaugcaacaaaaugcuuuugauaaugua

SEQ ID NO: 16072 - RNA, 4737 nt, Homo sapiens
aaaucugaaguuugcggccucaaguaccacuuugauggggagagcuucugaagcuuccauacaaccugccgugccuuugcugcugccgcaguagauuuucagcucauuucuuucugcugcugcuucgcgcugcucugucaugccuaaaucuaucucgucacugccaaaggugccugaaucagggugaauuccacgagauucaccagcgguuuugcuccaguccaagguaaauacaguaugcaaaaugaggaaccacccaaggaugucggggaggggggagagaaagggauucccucaccuuuuccggcacauuccucguuaauuuccaccaggaggaggcgcgcagcccagcuccccuagucucucuucuuaaaucccccuaccuacggcugccgagguuggccgcgcgucgggaaucuccccgacaguccuggcccucccccgccccccggguugguuuuucccagcugcggagguugggagguugggccaggggcuggggugcgaagagagucggcgcccgcaacgcggagccgggaagucgucgcuacucugguggaacucagaguugguucuggaggcggcggacgcggaggugagcagugggagcccgcggccugggagagacccgggaggcgucguuggggccccuccccauccucggguggagaguaggguugguucggguugccacuguaccccgagucccacugcugcuuuguucccagacucuccccuccucuuuggagaugacuugaaccccuuugagauccgaggggcuggcggggcgcgggcuggggggcgacaguuguagcuccacuuccugcuaaugcgagaagguacaaaaagagaucaaaaaguccuguaaccugaaacuucccucgcauccuaaccgggaccugguggagaggucugggcgggggcggagacacccggaggccgaccuuccgccgaggcggugcaggaaggaacgggagagggagaaguuugguagggaaggaauuggggauuaagcgguaaguuagacgcgggagacgagucuccucgggaaaggcggagggcgggaggccggucggguuuauuuagugugggccagggaagaaggaagacuuugcggucugggugucggaugcgcgucccccuccggaguaaaagugaccggagggguuggggaggcgaggccggggcgggcuuuuggaaggaggucucugggacagacuggagacgacuagacucgaaaaggccgguuuuugcacuccggaagccgcggcagccaccgcuguucacgccucucuccugcuugucccaggucccucagaggauccagcgaggggcgccaacaagaggcgaagagguggcaccagggcggcggcaggaagaggagcgggagcaggagcgcggagcggagcgucccgacccgccgugcguacuuucuggagggaaggggcgggggaaucggccccugagggaagcgcccgguggcgaggggguuagccaaguuccggcugcggcgccacucccucgguuccacgagaggaaaguuuuuuuuuuccagacgcuuccgccggcucgcgcccuccgggcccagccucccgagccuucggagcgggcgccgucccagcccagcuccggggaaacgcgagccgcgaugccuggggggugcucccggggccccgccgccggggacgggcgucugcggcuggcgcgacuagcgcugguacuccugggcugggucuccucgucuucucccaccuccucggcauccuccuucuccuccucggcgccguuccuggcuuccgccguguccgcccagcccccgcugccggaccagugccccgcgcugugcgagugcuccgaggcagcgcgcacagucaagugcguuaaccgcaaucugaccgaggugcccacggaccugcccgccuacgugcgcaaccucuuccuuaccggcaaccagcuggccgugcucccugccggcgccuucgcccgccggccgccgcuggcggagcuggccgcgcucaaccucagcggcagccgccuggacgaggugcgcgcgggcgccuucgagcaucugcccagccugcgccagcucgaccucagccacaacccacuggccgaccucagucccuucgcuuucucgggcagcaaugccagcgucucggcccccaguccccuuguggaacugauccugaaccacaucgugcccccugaagaugagcggcagaaccggagcuucgagggcauggugguggcggcccugcuggcgggccgugcacugcaggggcuccgccgcuuggagcuggccagcaaccacuuccuuuaccugccgcgggaugugcuggcccaacugcccagccucaggcaccuggacuuaaguaauaauucgcuggugagccugaccuacguguccuuccgcaaccugacacaucuagaaagccuccaccuggaggacaaugcccucaagguccuucacaauggcacccuggcugaguugcaaggucuaccccacauuaggguuuuccuggacaacaaucccugggucugcgacugccacauggcagacauggugaccuggcucaaggaaacagagguagugcagggcaaagaccggcucaccugugcauauccggaaaaaaugaggaaucggguccucuuggaacucaacagugcugaccuggacugugacccgauucuucccccaucccugcaaaccucuuaugucuuccuggguauuguuuuagcccugauaggcgcuauuuuccuccugguuuuguauuugaaccgcaaggggauaaaaaaguggaugcauaacaucagagaugccugcagggaucacauggaaggguaucauuacagauaugaaaucaaugcggaccccagauuaacgaaccucaguucuaacucggaugucugagaaauauuagaggacagaccaaggacaacucugcaugagauguagacuuaagcuuuaucccuacuaggcuugcuccacuuucauccuccacuauagauacaacggacuuugacuaaaagcagugaaggggauuugcuuccuuguuauguaaaguuucucgguguguucuguuaauguaagacgaugaacaguuguguauaguguuuuacccucuucuuuuucuuggaacuccucaacacguauggagggauuuuucagguuucagcaugaacaugggcuucuugcugucugucucucucucaguacaguucaagguguagcaaguguacccacacagauagcauucaacaaaagcugccucaacuuuuucgagaaaaauacuuuauucauaaauaucaguuuuauucucauguaccuaaguuguggagaaaauaauugcauccuauaaacugccugcagacguuagcaggcucuucaaaauaacuccauggugcacaggagcaccugcauccaagagcaugcuuacauuuuacuguucugcauauuacaaaaaauaacuugcaacuucauaacuucuuugacaaaguaaauuacuuuuuugauugcaguuuauaugaaaauguacugauuuuuuuuuaauaaacugcaucgagauccaaccgacugaauuguuaaaaaaaaaaaaaauaaagauucuuaaaagaauuacagugugugcaaguuugcuuugaaaaaaggaugaagggcaggaguauucaauggucuugguuccgaugauaauuauuacuuaacauagcugagaaucaaacuguagcaaugucuaauauaaauagacuugggagaucguuuugaaaugguggauccuuuuaguauuuaaauggagaguuugaguauucaugugacuguauggucccaaaguuaaugcuauuuaugaaacaguuuuguaagaacauaaugaaguugguaaaagcuaagcguucugcacaauaaacaguucccaguuuggggcuuuuucaaggcuaaugaaguuauuguuggucuagaaaaauaguauuuacuuaauaaaacucuguuugaaauuguucuguggauuuuuagagcagaauuugaaacaaauguaaugcaaauaaauauaaagauaaagugucuuaaagacaauauucugaaauaaaagauauaaaauauaauuuaaaaaauauuucucaaugucuuaauguaaauugaaacuuagauuuucuugaggauauuuucaaaaaaacauuuaaaguggaacauaaauguucuuuaguuuaucagagacccagcuaauauguuuaaaaaguugacuugacaugguugaauaugaacuugaggaaauaaccacagauaaaugucuacaucuguaaacacgugucucaaguauuuauagguucuuaucuucaguucaguguuuaagaauuugaggauauuuugauuuuagcuaagcuguucauaauguaaguauauacaccuuugugaagaauaaaucacauuuagguguaaauacaggcaaucauuaauugauacauccauaauauacaaggcuuuuauuauuuuuucaguuuauuaucugucauuuaaucugaaaaguaaauuccauuaaucagucuucaggcucuuuuaucaagugauuuaaauguagccauuauugcuuaacugaaaguauuagguaaacuugcaucaguaagucuuagggcuugcuuuuccuuugaacugguuauguccuucagugcuuuauguuugaaauaaaaucuacauuuucauauuuuuauaaauaaaauaggaucagauaguauuuuagguucuag

SEQ ID NO: 16073 - RNA, 4737 nt, Homo sapiens
cuagaaccuaaaauacuaucugauccuauuuuauuuauaaaaauaugaaaauguagauuuuauuucaaacauaaagcacugaaggacauaaccaguucaaaggaaaagcaagcccuaagacuuacugaugcaaguuuaccuaauacuuucaguuaagcaauaauggcuacauuuaaaucacuugauaaaagagccugaagacugauuaauggaauuuacuuuucagauuaaaugacagauaauaaacugaaaaaauaauaaaagccuuguauauuauggauguaucaauuaaugauugccuguauuuacaccuaaaugugauuuauucuucacaaagguguauauacuuacauuaugaacagcuuagcuaaaaucaaaauauccucaaauucuuaaacacugaacugaagauaagaaccuauaaauacuugagacacguguuuacagauguagacauuuaucugugguuauuuccucaaguucauauucaaccaugucaagucaacuuuuuaaacauauuagcugggucucugauaaacuaaagaacauuuauguuccacuuuaaauguuuuuuugaaaauauccucaagaaaaucuaaguuucaauuuacauuaagacauugagaaauauuuuuuaaauuauauuuuauaucuuuuauuucagaauauugucuuuaagacacuuuaucuuuauauuuauuugcauuacauuuguuucaaauucugcucuaaaaauccacagaacaauuucaaacagaguuuuauuaaguaaauacuauuuuucuagaccaacaauaacuucauuagccuugaaaaagccccaaacugggaacuguuuauugugcagaacgcuuagcuuuuaccaacuucauuauguucuuacaaaacuguuucauaaauagcauuaacuuugggaccauacagucacaugaauacucaaacucuccauuuaaauacuaaaaggauccaccauuucaaaacgaucucccaagucuauuuauauuagacauugcuacaguuugauucucagcuauguuaaguaauaauuaucaucggaaccaagaccauugaauacuccugcccuucauccuuuuuucaaagcaaacuugcacacacuguaauucuuuuaagaaucuuuauuuuuuuuuuuuuuaacaauucagucgguuggaucucgaugcaguuuauuaaaaaaaaaucaguacauuuucauauaaacugcaaucaaaaaaguaauuuacuuugucaaagaaguuaugaaguugcaaguuauuuuuuguaauaugcagaacaguaaaauguaagcaugcucuuggaugcaggugcuccugugcaccauggaguuauuuugaagagccugcuaacgucugcaggcaguuuauaggaugcaauuauuuucuccacaacuuagguacaugagaauaaaacugauauuuaugaauaaaguauuuuucucgaaaaaguugaggcagcuuuuguugaaugcuaucuguguggguacacuugcuacaccuugaacuguacugagagagagacagacagcaagaagcccauguucaugcugaaaccugaaaaaucccuccauacguguugaggaguuccaagaaaaagaagaggguaaaacacuauacacaacuguucaucgucuuacauuaacagaacacaccgagaaacuuuacauaacaaggaagcaaauccccuucacugcuuuuagucaaaguccguuguaucuauaguggaggaugaaaguggagcaagccuaguagggauaaagcuuaagucuacaucucaugcagaguuguccuuggucuguccucuaauauuucucagacauccgaguuagaacugagguucguuaaucugggguccgcauugauuucauaucuguaaugauacccuuccaugugaucccugcaggcaucucugauguuaugcauccacuuuuuuauccccuugcgguucaaauacaaaaccaggaggaaaauagcgccuaucagggcuaaaacaauacccaggaagacauaagagguuugcagggaugggggaagaaucgggucacaguccaggucagcacuguugaguuccaagaggacccgauuccucauuuuuuccggauaugcacaggugagccggucuuugcccugcacuaccucuguuuccuugagccaggucaccaugucugccauguggcagucgcagacccagggauuguuguccaggaaaacccuaaugugggguagaccuugcaacucagccagggugccauugugaaggaccuugagggcauuguccuccagguggaggcuuucuagaugugucagguugcggaaggacacguaggucaggcucaccagcgaauuauuacuuaaguccaggugccugaggcugggcaguugggccagcacaucccgcggcagguaaaggaagugguugcuggccagcuccaagcggcggagccccugcagugcacggcccgccagcagggccgccaccaccaugcccucgaagcuccgguucugccgcucaucuucagggggcacgaugugguucaggaucaguuccacaaggggacugggggccgagacgcuggcauugcugcccgagaaagcgaagggacugaggucggccaguggguuguggcugaggucgagcuggcgcaggcugggcagaugcucgaaggcgcccgcgcgcaccucguccaggcggcugccgcugagguugagcgcggccagcuccgccagcggcggccggcgggcgaaggcgccggcagggagcacggccagcugguugccgguaaggaagagguugcgcacguaggcgggcagguccgugggcaccucggucagauugcgguuaacgcacuugacugugcgcgcugccucggagcacucgcacagcgcggggcacugguccggcagcgggggcugggcggacacggcggaagccaggaacggcgccgaggaggagaaggaggaugccgaggaggugggagaagacgaggagacccagcccaggaguaccagcgcuagucgcgccagccgcagacgcccguccccggcggcggggccccgggagcaccccccaggcaucgcggcucgcguuuccccggagcugggcugggacggcgcccgcuccgaaggcucgggaggcugggcccggagggcgcgagccggcggaagcgucuggaaaaaaaaaacuuuccucucguggaaccgagggaguggcgccgcagccggaacuuggcuaacccccucgccaccgggcgcuucccucaggggccgauucccccgccccuucccuccagaaaguacgcacggcgggucgggacgcuccgcuccgcgcuccugcucccgcuccucuuccugccgccgcccuggugccaccucuucgccucuuguuggcgccccucgcuggauccucugagggaccugggacaagcaggagagaggcgugaacagcgguggcugccgcggcuuccggagugcaaaaaccggccuuuucgagucuagucgucuccagucugucccagagaccuccuuccaaaagcccgccccggccucgccuccccaaccccuccggucacuuuuacuccggagggggacgcgcauccgacacccagaccgcaaagucuuccuucuucccuggcccacacuaaauaaacccgaccggccucccgcccuccgccuuucccgaggagacucgucucccgcgucuaacuuaccgcuuaauccccaauuccuucccuaccaaacuucucccucucccguuccuuccugcaccgccucggcggaaggucggccuccgggugucuccgcccccgcccagaccucuccaccaggucccgguuaggaugcgagggaaguuucagguuacaggacuuuuugaucucuuuuuguaccuucucgcauuagcaggaaguggagcuacaacugucgccccccagcccgcgccccgccagccccucggaucucaaagggguucaagucaucuccaaagaggaggggagagucugggaacaaagcagcagugggacucgggguacaguggcaacccgaaccaacccuacucuccacccgaggauggggaggggccccaacgacgccucccgggucucucccaggccgcgggcucccacugcucaccuccgcguccgccgccuccagaaccaacucugaguuccaccagaguagcgacgacuucccggcuccgcguugcgggcgccgacucucuucgcaccccagccccuggcccaaccucccaaccuccgcagcugggaaaaaccaacccggggggcgggggagggccaggacugucggggagauucccgacgcgcggccaaccucggcagccguagguagggggauuuaagaagagagacuaggggagcugggcugcgcgccuccuccugguggaaauuaacgaggaaugugccggaaaaggugagggaaucccuuucucuccccccuccccgacauccuugggugguuccucauuuugcauacuguauuuaccuuggacuggagcaaaaccgcuggugaaucucguggaauucacccugauucaggcaccuuuggcagugacgagauagauuuaggcaugacagagcagcgcgaagcagcagcagaaagaaaugagcugaaaaucuacugcggcagcagcaaaggcacggcagguuguauggaagcuucagaagcucuccccaucaaagugguacuugaggccgcaaacuucagauuu

SEQ ID NO: 16074 - RNA, 1622 nt, Homo sapiens
ggaccugggggaguaacucauucgaccugaaaaaaugaggaaagguuuuaagaagugggauggguuugggcagagguguuucaggcaggggcacuucauuaacaaggugugaagaggagaauagaaagcaugagggaggccucaggggagucuggcuagcaugcuccgaaaguuaacaucagugaggaauugugggcaaaaaggccagaaagauagguuaggaccugucuuagucagcucaggcugcuauaauaaagcaccauggacuccauggcuuacaaacaauagaaauuuauuucucacaguucuggagccuggaaguccaagagcaggguggcaucguuguugggcucuggugcaggcucuuuccugguuugcagauugcugacuucuuguuauguccuuaugugagggaaagaagacaagagggcucacuggaguuucuuuuauaaggucucuuaucucauucauaagggcucuucugucaugacuuacuugccuuccaaaaggucccaccuccuaauaccaucucauugaggguucagauuucaauacaugaauuuuaaggggacagaaacuuucagucaguugcaggauucaguuguggaggaccuugaaagccaggcugagaggucuggagagaauccugcauguaugagggagcuaugaaguuuggaggagagugacaugaucagaguccugguuuuggaaaauuuucuagccagcaacugcaggaugcauuggggcuaggaggauguagggagaaagggacuuugguaaguugguaguugugacaauguugccagguaggaauaugagggugggaagcagagcagaagcagucaaacuagaauaagaggacagagagagacucacagaggaggaggauuaugaggaggggcuguaccuugauuccaaggguucuagccugggugccugagcaucuggugaugacgccauaaccuggauaccaccuucaaggggaggaagagauaaugagcuugguuuuuagaucaguuggauuugaacagcagauacuaaguucauauggagauguccagcacacuauuagaaaaagaggcugagugcucuacaguuuccagaguaucuaucacuucucuacugcuuuuuccuccucugaaaaaaaggcccucuucucuuucucugucccagcugaaggcuauagauagcacugugauuaacaguucaugcggaacucagccauucuggaaucacauaauauuucugccucucucuagcuguaugaccuuagguaaguuauuggauuucucuaagccucaucaguuuccucacauauaaacuggugauaacuaaaguaucuucuguauaauguucccacaaauaaauuaauuaaugccagcuaauaccuggcauauuggaaaugccuaaaaauaucagcuguuaguaagccaaauuauuuaccauuccacgaacacacccagaacuuuccuuccucccgucauuugucccugcugcugcucuccacuuacaaugcucuccaaaggaaccgauucccuacuguucaucuuacucuguacacaagauccugaaauccuacuuacucuugacucuaggagccaggguuugaauuuggaauuauc

SEQ ID NO: 16075 - RNA, 11991 nt, Homo sapiens
aaauuaucuacuagcuuuuaaacauaugaugcuuuaguaaagauuagugcuaugcugcaaauaaacaggauucauauaaucucaccagguguaaucaauguggaaagacuaaggaagaaaaacacaaagccaaauucauaacuguccugaagccuuaaacugcucacaggggaaaccauuacccaaggugagugucacacuugcauaaugccugagugggaugggaaagcugauuucccuacucauauaguuaugcugcuaacuugucagaugcuaaaacaauuucuguauuguauuugucccuaauaaguaugaaacaauuuaggcccuacaaaaagcaggcuacacguauucccaugcugccagaucacuaagcugaauuucuucccuaagaaggacauaauuaaacuccaugaaaauaaucuuccugagaauaauaagauaaagggccaguguauauucaguaggucugaguugauguacuauugcacugcuagccaaagauaucaauaucuuuaaugaugugacauuccuccaagaguucaaggaugaaggaggaugugaacaaugaauacauuaagaugcagcugcauguuaccaucauaagucaauuagaguauguuuggauauuuggaaaauaauaaucccauuauucuuugaaaguacauuagugucaauagaaauaauaaaagacugagagaucuuggagacaucaaacaauagaauaaacaauuguaaaucuacuggaugccuugacaauaugcaggaaaugagcuacaugucuucugcaggucucucuuaauacagggcucacuccugcaaaguauaaaacuaguuuuucaagcagacagauggaacacaccaagauuccugaucuugaaagguuuacuguguggcagaaaagaucagacauguacauauagccaaaugugaauauaugcaauaaaaauguuaugaagugugaagagagcacagagaaaguagaaauuucuuucuccagggaucuagagcacauuuuuugaaaaauauagcuuucaaguuguaucuuaagaaaugaguggaauuuagggagaacaggguguaagacagggaauuuaaaaacugauucuggccaggcauguuggcucacaccuguaauuucagcacuucaggaggcugaagcagguggauugcuugagcccaggaguucaagaccagccuggacaacauggcgaaaugcugucucuacaaaauacaagaaaaaaauuagguaggugugguggcaggugccugcagucucagcaacccaggaggcugaggugggaagauggcuugagcccagggaaguugaggcugcagugagccacgauuguuccacugcauuccagccugggugacagagugagacccugucucaaaaaccaaauaaacaaauaaaaauaaaaauaaaaaacugauucuaaaauucauauagaaaugcaaaggaugccaaauagucaaaacaaaaauaaacaggaagaacaacauuagaagacuuggcuggguaugguggcucaugucuguauucccagcacuuugggaggccaaggcaaguggaucacuuggggccaggaguucgagaucagccuggccaacauggcaaaaccccaucccuacuaaaaauguaaaaauuugcugggcaugggggcaugcgccuguaaucccagcucucagaaggcugaggcgggagaaucgcuugaacccaagagguggaguuugcaaugagccaagaucccaccacuauacuccccuggggaacagagcaagaaucugucucaaauaaaaaaaaaaaaaagagagagagaagaagaagauauacacuaucuguauuaauccauuugcauuaguacaaaggaauaccugagaguagguaauuuauaaagaaaggagguuuguuuggcucacaguuaaguuauucaggcugcacaaguguggcaccagcaucugcucagcuucuggugaggccucagggagcuuucacucauggagaaggcacagggggagcaggugcaucacaugcugagagagggagcaagaaggagaggaggaggugccaggcuccuuuaaauauccagcucucaugugaacucuuagagaacucacucauuacugugaggacagccauucaugaggaaucugcccugaugacccaaacaccuuccacuaggcccaacuccaacaucggagguuacauuuaaacaugagauuuggagggggcaaauauccagacuauauuacuacugauuucaagacuucuaaagcuauaauaaacaagaaguguggaaugagugucaaacaggugaauagaauguccagaauuguaaaaaaaauuuaaaaauaaaaaauaaauaaagccaacacauauauagacaacugauuuucaguaaaguugcagaggcaauacacuggagaaaagaucuuuucaccaaaccaugcuggaacgauuagauauccauaagcaaaaaaaaaaaaaaaagaaaaggaucuuuuuugaucucucauuaaaaagaucauggugaucucacaccauguuuaagaaaaaaacucaaaaugaaucacgaaccuuaaugaaaaucugaaacuauagaacuucuagaaaaaaaaagcauaggauuauaccuuuaugaccuuggguuuggcaaagauuucuuucauaugacacuaaaagcaugauaucuauuaaaaaaauuauggauuagaguucaccaaaaugaagaauuucuguccuuugaagacacuguuaaggauaugaaaagacaacccacaaacugagagaaacuauuugcagauccuauaucugauaaauaacuuauauuuacagaauauaaagaacucucaaaacaacaauaaaacaaauucccuaauaaaacaaugggacaaagacuugaaaggcacuuugcuaaagauauacugaugaaaaauaagcauaugaaaaaaugcugaauaccauuagagaaaugcaauugaaaaaugacauacuacuacacaugcauauuagaaugaauacaauuuaaaagacugauguuacaauauguuggaaaggaaguggagcaaccagaauucacauacacuaugagaaaguuaaaaucauacaaccauuuuggaaaacuguuuagcaguuucuuaaaaagacaaaugccuaccuaccauaugacccagacauuccucuucuaggaacuuaaacaaguagaagcacauguucacaugaagacuuauaaaugaauauuuacagcaaauauucauagaaaauauuuauuuacaauagccaaaauuauaaguaacccaaauauccaucaacaaauaaauagauaagcaaauuaugguauguauagccacacaaugaaacacuacucagcaaugaaaagaaugaacuauugauacacacaacaacauggacgaaucucaaaauaauuacgcugaaugaaagaagccaggcaaaacagaguauguacugcaugauuucacuuauauaaauaccaugaaaauauggacugaucuguuguaaugcaaagcagaucuguaguuucagagaaagggaugggagggagggauuauaaaagggcaucauaauuuuuauggaugauggacauguuuauuaucuugauuguggugaugguuucuugacuguauacugugucaaaauguauuaaauugugcacuucaaauauguaaaaauuauuuugucaauuauaucucaaaguuauuuuaaaaaugcaauucaguccugacccacuucaaugccugauucgacugagauaaucagccucuagcccuaucuacuuaacagaggaaagaggaauacaucucucauggaagauaauuucccauguuguaucaauggauuuuucauauacaaugucugccaaauaauaaaaaaugucuagacaugugaaaugucaagaccauaugauuaauaauauaagaauaagaaacauuaaacaauagaugcaaauccacagauuauuuaggcauuagaguuaguagagucuuuuuauaaaaacuauaaacuaauuaauugcaauauuuuaagagcuuagaggaaaugauggacaaaauagaugaaaagacaaagauuuucaccagagaaauauacuaaauacauuuuuaagaaggaucaaacagguauucuaauacugaauaaauaacauguuuccaguucuggaaacacagugaacugagauaauuugaaucccucuuaaauaaaacuuuuaguaauguuggauaaaauacaacaacaaaaguaauauagagcuaagcaugaaggaaagugaaguuuccaggugacaaaaauaaagaggaaacuuaaagccacaaucguaagcuugugagcugacaacacagugcccugaaaagagugggcucguaucuauucaggaaaagggcucaucccagauguaaugacucuuggcuuacuaagaccacccugcccuaccccaccacacacacacauauaaaaguuauuggaagggcugcuucugugaugggcaggagaguaggacauagaucauguagagcuuucaggucaucauaaggacuguggcuuuuucacugcaugaaaugggaagccauugaaggauuuugaacagagaaguaacccgacuuaugauauuuaaaggaucacuuagaccucucuguugaaaguucucauaguaggcuuacaaaaauuaauuuaggacagggguagcuuagugccuaauaaaugucaccuguuauuguuuguaaugcaugcugcuagugcccacacaggguccuuuacuagccaaugccuguucccagcugcuagggauguuaaccagcaccuucuucucucaagaauuacccuugaucaaagcagaagccaucuuacccugacuggcuuggggcaacaaaagaucaugccccugccucaggaugggacugauucuguagugcaauuugugccccagaacuuccugugagaucagaauguggccagucugcagcugagaugacauucuugguggcuuuuccccugcucuaacugcuuccaucauuccccuucuuauagcucaccuacaauaaaucuuuucaggcuuuuauggaacacaaccuaugacacuguuguuaucauaauuaucucugaauuuauuauuucuuuaaugcaagucauucgcauacauuucacuugaagucaaaggcuggugcuuucaaacucacacugguaggucauagggucuguggguacugugugggccaacuuguacuacacuuacacuugacacuauucugcuaucuaaugagguguuuuuggaaugaagucgaacaacauuuguguuaaauuuuuaacauuugucuuuauuaauuuuaucauaaauguauacccaagguuaucuggguagguucagauucucauuauucauuuuaaaagccauccauaaccacauggucccucacgucccaauucuaccccugaaguaacauugcaaacuagguuaaaaucuccuauacauacaacaucuguauccuagacgagggauggagaaaaacagaguuucucuguuuauauacaggauaaagaggcaaaacaugaggaagaaaaaacuuuacuccauagagaacagguggaaaagauccuagaaauguaaauaccucucucuccaguauggauuuuaugaacuauguuuccuuaaaauguacacacauucuucccaaggcaggcguauuucucuggagaccucucacuagguauacaguugcagaugaacuucccaaggauuguucuuagcugaggaucccaaguuuucugcaaaauuuauucaaaagcuccaacuccauagaaagacaagaauauuuucucugugccacucacacacaucugccucgagaaucagcacaagcugccaacucaacaccucugaucacaggcugccugaagucgccucucucaauauaucuaaaagccuggccuagacauaaagacuuucuauuucuacuacacaucuuuucugggugacaggauggauuauuguucuaccaauaauagacaauuuuucaguagguaauaaaauagcucacauacacaguauauauuuuggcaaagucuuggcagcuuucagaagggaaaaaauccauugaauuuaaccugaggugguuguauaucucuaaaagagaaauucaggcauuuaaaaagucaccugcauucuuuucacaacuucuucaaaguugccucuuuuucaaaaauccccagugacuuaugcaauauacucuuugaucauuuuagguuugggaggcaguuuccaaaggccucucagguuucugcauguaaagugagcaggggaaaacugacagccuuugucucagcugucuauucaacaauguuugcaaagugaacagccuuggaagauggagauagugucucccucuggagcauagagcagguuuauuuacuauccagcauaacaaagauaauaucuccuucugagguaaaggccagggagguuugcuugcaacccauugucaaaacacaggguuccccuaagcucaggguuccucagccaugaugccaacccacugugugcacagcaucuccuugagcccuugcuucuccacacugugagaccuggaggcaagaggaacuauauuaauuucuauugcuguuguaaaaaaacaaaacacaacuaaaaauguggaguuggcaaugggcaguggcugguagaauauugaagaacaugauauaaacugacuagauugccuugaguagccuguuaguaggaauauggaugugaacaacucuaagugaggacucagagggaagugcugagcaugauagaaaaaaaauuaucuggccaggugcgguggugcgcaccuguagucccagcuacuugggaggcugaggcaggagaaucguuugaacccaggaggcggggguugcagugagccgagaucacgccacugcacuccagccuggcaacagagugagacuccaugucaaaaaaaaaaaauuaucuuaugaacuaucuaaaucaucaugaacagacuauugguagaaauauggauacuaaagguacugcagaugaaaauuaaaauggaaaugaggaacauguuauuggaaacuggagaaaaggagauccuuguuacauagcagcagaaagcuuaggugaauugugcccugcaauuauguagaaagcaaaaucuguaaauaauaaaguugaauauuuagcugagaggauuuccaagcaaaauguuaaagaugaggccugguuucuucuugcuacugauaguaaaaugcaagaggaaagaaaaauggagggaagaacuuuaagugaagaggaaucaggauugaugauuugggaaauucucagccaauuauauugcaaaaacacuaaaauuaggagauucaucaucaggaaagcaugcucuggagagaaagccaaggacugugacuaggcaaccuuugcuauugucucaaaagaaacaaaaagaguauuaaaucacacggggggcucucugaaaaaauuaggagugugacucauggaucauuuuauccauuuaaguacuaacuaggaauagagauaggguuauucaggagugauccacagaagagccucuugccuaauguaguaaguuucugugauauauccaggagacacccuaguucuugaaaauguuauaccagcagaaacacugccaacuuugagacagccaggcugguucguuuucuguuuuggagugguuuagagaaaaagaacaaaagcuccuuacucaaguuguagcuuaccuaacuuccagccaaucagcaaaagaagauccaagaagcuguuaaccgcaaguuccugcuuuaagggauuagggacuucccugaggccccauaugcauacuuagacuuaaacuucaacucauagcuaccccuuccucauuuuaaugcuaaaagucacuaagucacuaccagggguggagauuuaaaauguauugugacaugugauguacaaagaagcaugugaagccacugcccaagcgcuagagaaacuccuccuauacaugcccugauaaaacacuuaucuauggaaaggcccuguaaaacugacucacauacuacccucagggagcagccugcccuuuuccuugugcagugcugacuuccuuguguacaagcuaaaauaaagcuuucucuuucucuuugcuguuaugucuggugaucuguauuuccauccuggaagauuacaagaacccagggugcugauuacaucucauggcacuccagauagaacccucauuuuaggguccugugggagcaaauggcacagcccagacgacagagauggcugaccaggcacaaaccaaggcagcugcaccauuguuucacccuggugccucggugagucaaguuccuacauaggauaaguccccauucccuuuuucuuucucucucucuauuuuucuugcccuauucucucucuuucucuuugcuccuauguuuggugaucucucuugaugucuauacuggaagauuacaagaacccagggcacugauaacaacuucaacugaaauggacagagugagggcaagauaaaugaaggcuaucagacucccaaaauucuacaugcagaaaaaaaggcugauaaaacuacucagcuaaaaacacauuguaccuuucaagaaaaagaaaagaugauuccaagaguggagcuucaggcccagagaauguagccagaagucacaaaagacuauuuccaggccuugcagcuuaacaguuuucccaguuugaaggauuuguuauuuuggggacugaugauucauuuuuuccuuccauuuucuccuuuuuggaaugggaauacgguugauccuugaacaacauaggguugaacugcacguguccacuuguaugcagauuuuuuuucaaccaaauggggauugaaaauacaguauucuugggaugcgaaacccaccuauacggagagcuaauuuucauauacacggguucugcaggaccuacuguggaacuuaaguaugcuaggauuuugguguauacagggggccuggaaccaauccccugcauauacugaaagacaacuauuaguaacuaguaucuuaugucggucacaucauuguauuuugggagaaaauaacuuauuuucuaguuuuacagguccacagauggagaguuuuuccccaggaugaaucauacccaggaucucacuaauacugaaauuagaugguuaagauaauaagauuugggacuuuuaagcugauaagauuuagguaauacaugugacuuugaauugauucuauaaugaauugagacuguggaguauauugggaugggguguauguauugugcauauagaauggauauaaaccuuuggggccaaagggaagacuagcaggcuaaugguuccccaagcauguccacauccuaaucccugaaaccugucaauauguagccuuauguggcaaaaggcacacacuuuacagaugugauuaaaugaaggaucucaagauggggagaucaucuuagguaacccaauguaaucacaaagguccuuauaagagagaagcaggaugguuaaagacagagauguaaaguggaagaagaggagccacagagugggagcaaccccuggaagauagaaaaggcaagaaaacugauuaauccugagagccuccagauggaaugcugcugugcuaacaccuugauuuuagcccacugaaacugauuuuagacuugucuacucuagaacuggaagagaauaaauuuguguugcucuaagucacuaaauuugugguaauucguuacaacagcaguaggaaacaaacucaggaaccaacaugagcaugaagcauauguggccugcugugcuguaaugaagauuuuugucucugacccaagacucuugugucuucuggcagcauccaugagacuauggcaagcugauuugcagaaggggcaaaaucuuggaccauucacaguucuuaacauuuaguucauaaaaaugaugauauagucauggguauuugucugacguuuaaguaucuuucaaucuucugaucaauaaaucuacuucuaaauaagauaccacuuaaguagcugugaacuuuaauaauagcccaugauuuauauuucauuaaauaaauuaugaauaaucauacucauauuagaaguuaaacucuggccaggcaugguggcucauaccugcaaucccagcacuuugggaggccaaggcaggcagauaacuugaggucaggaguucgagaccagccuggccaacauauagugaaaucucgucucuacuaaaaaauacaaaaauuagcuaggcgugguggcacgugccuguagucccagcaacuugggaagcugaggcaggagaaucacuugaacccaggaggggaggcugcagugagccauccagccugggcgacagagcaagacuccgucucucaaaaaaaaaaaaaaaaaaaaaaaguuaacaaacucagcauucuuuaauacucuugcucucuugcauaaaaaauucaugaaaauagcaucuauuuauaaaaaauauguuaaaguagcuuuaauuacaaaaaaauuccaugcuuuguuuuacuauuuagagucuuaaagaaugauauuuucuuuaaaauacacaauagaaaagggauuucuuuuagcgaaauaaucccuaaaucucaugcauggcucagaucaccagaaucccagagaugguacagucagcacugccuacuccaagaaguuaggagacauuauaaacaugguacaacuuuuugggaaacaaaaaauuggaugugugaaaauaaagaaccagaggaaauuucugugcagucaaaugcauuuauuuuguagcuuaagcaagacagguggugaacaaauucauaaugaaaaugccacccagagguuaacagcuugccaugcaugcaacugugugcgcaaaaucaaguuguuuuaauaccagugugcagcuuugauuccuccaugaaauuaaagcuguguugcucacuuguuuacauaacucaggccacccugaauaucugcuaguggggaauuuacaacccacugaccaucucagcucaaagccagaugacuaucaccuacacaucugccaagguaauagcauggcaaauaguauuuuucuuguucuguagccaauggcacagauacaccaacacagagauacccagaaggcaccuccucucauucagcugacaagcuuccuaacauuucuuggggacaagaguaccauacauguacuacgaauugguacuuauucugaggcaggggauggcugucuccagguuagagcaugggugguuggaaguucucagaagagcuguuucagcacaacccaccagaaacauuggccaccaugacuguguaagaugagucuccugacauucugguagacaaccagauccccugacuaaagcuuggcucaauuaggguuaaguggaagguacagagauuugagagagccuacaagagauacgaggcaguacccuaguuuauacuguuuuauguauagcucagccucaucugaaggcaaagucauaaauucacaaaauauuagaggugggauggaucacucuagaccugucaaccuacaguuaaaaauggggcagcccagagagguaaagcaacucaccaaagguagagcauaguaguggcagggccagauuagaacaugguaggcuaauccucacccaagaaugcugacaauagguauuuggccaaauuuuucaacaagcaaaacgagcuaguauaaaucagagguguccaaucuuuuagcuucccugugccacacuggaagaagaguugucuugggccacacauaaaguacacuaacacuaacgauagcugacgagcuuuaaaaaaaauagcaaaaaaaaaaacaaaacucauguuuuaauaaaguuuaaaauuuguauugggccacauucaaagcuguccugggacacaugccacggguuggacaagcuugguguaaauacuuuaauacucccaaagcuccaaauguauu

SEQ ID NO: 16076 - RNA, 2054 nt, Homo sapiens
uuuuucuggaugguuuucuuaucagcuuuucacacaacagucaaguaaaccucguggcacuagcccuagaaaaggaaaaacacgagauucuuacaagacuacaaacauuacaacauauguaaaagcauuaaaaguauuaaaaaaaaauauuguccuuauaacgguccaucucagaagccagauccguaaaaguuuuuuuuuuucaacagaaguucagguucgggauaagaucaucacagauaagaccaaggacacaauauucacugaucucuaagcaaacagaaaaacuccacuuacagaaaucguugcaacuuuggaacuuccaagacaaucuggccucuaucaaugggcagacagcgacccucacuguuggcagaaaaaaaaaaaacccaggauuuuauaacacaacuguuauaaaaucacggcaacaaaauuuacuccaccucugaauuacuggucuuaaucucagaagccgaauccguacuuauuuuucuucagguuaucagcuucgggauagguuucaucauugauuagaccaaucagaccuuguauauguacacauaauacauuaaacugcacuucugugacacugacuacaaaccaagguaaugcuaaaaggcaaguauuauaguacaaauacuacagaacuuuuaagccauacaaccuacuucaaaaugaagcugcuagucagucacauucgacauucauuaucuucacuggcuacucguccacacucagaacgcuguucacugacaaaaaaaauuugauuuagucuagguguggauuaaaugcuaugcucaaucauaaaguacuaaaacaacacauaccuguuaaaagugucagguuuuaaccaagcgauuuuccauuaaauauucucccagauguucuggaaguuuuuucguguaucuaacaaaaaaaaguaaauuucaaacgaugcaacaguuccuauuccuguaaaucaacagguuuacuccuuuaguuuggaaacuaagcuuaacuaagcucuuaccuuugcaucuucagagcugcuccacugugccacugaagacagcgccauuguuccugcgggaaaucgguauuuaagcauucucgcagaaaugucacacuccaaggcguuuuuccacacaaaacccuuccccuucauuaauccgaauugcacacaacgccgccuucgaacagcucaguuucaauacagggucgaggcuucccauuuuaaaacaacgccgacggaaggccuucgccauuuuaguaaaggcccuuugcuguuaaaacuaacccuccgccccaauuaaggugguuuuuccgccgccgcucaggcacaugccggaggccagcaaguucggcgcccguggccgaucagcgguuccucacgccaaaacucggagccuguggccgucacgacucaaccucaguacauguggcaguccggccgcacguuucccacgugcaagcuuucaacucucagcacucuaaacucuucacuaagaugucuucacaggauuaaagcucuuaacucggccugcgccaccaucuuuugcucggauacuagcccgcaauacccacucaccuaccacccgcccagacgcucgcgaaggccgacguaaaagaccgaagugcgcagccaguagcuccuuauauagccucccggagucagaacgaggccgucccgcccucucgcaccuauuggacauggaaguagacagggguguggucgcgaauuagcgggagcgcgcgcgguggcucuucugaggcccguuccgcguuguggagcgcgccgcaggccggccgcgcgcccggccauuucccggcgcgcgcccgcaggcgcacugcgaagcgucucuuacgagucuggcggccgacuuggcccuacguggcgcggguguggcgccagaauucaaacagcugcaguuggaaacgacgcuuucgccugccacgagccaaguccguccaggacagauuggguccgagaguggacacaaguuuugcagcgcagggcggccucagcuuaggaccgauucgagaagcugggcuggcuggcuggcuggcgcugggcu

SEQ ID NO: 16077 - RNA, 54807 nt, Homo sapiens
gcgcccagggcgccgagggcgggacuggacucggcuugggcgugagauggcggcggcagcggugagcagcgccaagcggagccugcggggagagcugaagcagcgucugcgggcgaugagugccgaggagcggcuacgccagucccgcguacugagccagaaggugcgaggccgcccguagcggaagccgcggcggacagacccuccgaaggccuggcggccagcgauugcugaucugugcaugguccgugcuggcgcugggcuaggcgcccccccaccccccggcgcgcgcacguuuccccucccggcgcgcgcacgcccccuagucguggucuggacgcucuuggcacuauggcggggagagggcccgguagugaaaguuguggggcuaaagagcgagaggacggcagggguugacagauuuaucucugggaggggaguuuguuugcauggguggcucuuuuggugcucgaaaacccuccguggggaugacggugcuguggugagagcacggugagaacagaaaguugugguagaggagaugggugaacaccugagugcccagguucccucagugaggccuaaaguuaaugagcuacgaguaagacuccgguuauauuaguaaaauggccagagaaagaugcaggugcuuuagacgagggaacaccaaaaaagguguggagaugccaaagggcagaacucagagguugacuggacuucacuaagcauauggagggcuaaggcugugucucaguagcuccagggccuaggcuuuuccugucucagaguuggucaacauuaaaugcuuuuucuugagugaacgaaaggaagacuuggcuaucauauccaggcuucccaagaacguaggaaacagaagagagaaaugagaggaauaagugaggguccguguuuguugguuagcagaccucuguuucauuacuuucaccaacugcacugcuauguauuuuuagucuauguaaugucaguuuucuuaucaauaaaauggcagucauauccuguugugaaggcauguucuaaagaguuuuuggggacucauuuuuguuagacaccagaggaagaaaaauuuaauguccccugaauaaguacguauuuguaauucuguuguaagucaaacugaugaucugucuucccagcaucaugcuucagagacaccagauauuuggaaacuugauguuccuuggaauuaguuauaccaucaggcuuucuuaauuacccuucacuauucuauuauccguuauuuacucaaauucaaggugccuauggguuaaagcaguaaagcauauaugcucauuucaccccucucuucaucuauguagguguguaugagggaaucuauacagauguuaauucguucguucaaacagaauuauuuuagcuauuaugaggaagcauugcuggguguuuuaguagauguaaaggauauagacucuuguccuuacuaucuaguuguuuaaaauuuagcuaauucauucacauauguugaacaccuauguagugcacacuuggcuauauacuggguuguggagaugaaaaagauaugauuguugcucuaaaggagcagagagccuagaagaggaaacagacaugaauaaagaauugcauugaagccagauauaugauaaagguaaacaccaauguuguggaaacauagccuuggggaggggaaauuggaaagcuuucuauuggaaaauguuugagaugaauuucggagaacaagaugaauucuuucaggugaagggaaagaugggauaggggagugugaguagggauauuuaggcaagagaugacaggauacaguuuagcaugggcuuuggaacugcacagaucugggcugaaucuggcgccauuguuuuuuaacuguauauccuuggacaggucucauaaucucucagaaccuuugguuccuugucuauaaaauggauaauaucacucuuguaggucgauugugagaguuaaagaaguguguaaagggauguauucagagcuuuaccuauuguuuguuauguccuuuaggaagaguauaauggcagcauuuggauaauggguugaggaaggaagaaagaaaaaaaauauggagaccaguaaggggcuguugugccaauucaagugaaagaugaaaaauaugcaaaccagagcaugggcagugaagaugaggggaaaggaggcaaaugggagacuguuaagugagaaacagcaggacuuggcaacugauuggaagagguuagagaauacuggaaggggaggagagucaccagugauuccaaaauuuagagcuugguauaaugguguuuagccuuaggcauaaagaagguaggaauuggaacaaauuuuggaggggcauggggaaaauaaagaugaauucaguuucuaaucuucuacguugucuuucuccguagaagauuagaauucauaaacuauagauggaaauaguuuacauagauacagagucacugacagcaauagaaugacgacugagagcuggcauuaaaggaggagagagaaaaauuaaaaagcagacccaugacccucaguaauaaauacauuuuacucuguacaaacaaauauacacauacaaggaacauuuuacagcucuuaagcacauacaaugaaauuuaauauuuucuuuuuuuuucaagacagagucuugcucugucgcccaggcuggagugcgguggcaugaucucggcucacugcaaccucugccucccacguucaagcgauucuccugccucagccucccaaguagcugggauuacaggcacgugccgccaugcucagcuaauuuuucuauuuuuaguagagacgggguuucaccauguuggccaggguggucucgaacucgaccucgugaucuucccgccucugccucccaaagugcugggauuacaggcgugagccacugugccuggcucgaacuuuaauauuuucuauucuauuucauuuaaaaauuguagcccacuauugauuucaugacuaaccaauggaucaucacuggaaacaucaguguacuguguaguguuuugccauagugaaugcucaauaaagguguuaaaugaugucuuucauuuagaaaagcguauuuauucuuauuggcacuguaccuuuuuauaacuuagaaauuuaucagagaaguaauuuaaaugguaaagaaauucagguuuaugucauaucuugauucccuaagaugaggaaauuagugccccuuuacucacuguguuuucuacucccucugucaguuucugacauuuauauuguuauauuuauguugucaaguuuuguaauuuuucuuuuucuuuuuccuuuuuuuuuuuuuuuugagagggagucucgcucuguugcccaggcuguuaugcaguggcgugaucucggcuuacugcaagcucugcuucccggguucaugccauucuccugucucagcuucacaaguagcugggacuacaggcgcccgccaccacgcccgacuaauuuuuuguauuuuuaguagagaugggguuucaccguguuagccaggauggucucgaucuccugaccucgugauccgccugccucggccucccaaaguacugggauuacaggcgugagccaccgcgccuagccaguuuuucauuuuuugagacaaaguaucgcuuuguugcccaggcuggagugcaguggcgcaaucuuggcucacugcaaccuucgccucccggguucaaggaguucugugccucagccucccaaguagcugggauuacaggcgccugccgccacgccugacuaauuuuuguauuuuuuguagagacaggguuucaucaucuuggcccggcugauguugaacuccugaccucaugauccaccugccucggccugccaaagugcugggauuacaggcaugagccaccacgccuggccagguuuuguaauauuuaaacuuuguucuguaacuauaaugagucuacugagcaguauuugugaccgauuuccaaacuugagauuucaguaaauuguauuuacaguaaacaguauuuacaaaaauauguaaagcacugaauacauaccuuguauuuauuuuuuuaauuuuuuuuuagauggagucucgcucuguugccaggcuggagugcaguggcccaaucucggcucacugcaaccuccgccucccggguucaagcgauucuccuggcucagccucccgaguagcugggacuacaggugcgcgccacuaugcccagcuaguuuuuguauuuuuaguagagaugggguuucaccacguuggccaggauggucucgaccucuugaccucaugauccacccaccuuggcuucccaaagugccgggauuacaggugugagccaccacgcccagccguauuuuuguucuguagaugguauucauuguagaaucaaguuguaugauugaauauguaagaaaagacauaacuuuaugucacuagauauguguagcuaggaagguaauguuucaagugucaguaccaaagcuuuucucuuuucccccauaauugcucaaaaucauucucuuuuuuacuuuguucccauuuggagcauauuucuaauuucuguauuuuuccaggagcuucugauugccuuuauuuuuccuuuuuugacaaaucaagaauauguguuuaucuuaucaauagauucuuuuucaucgucuguuaaaauaaauccacucucuuuuugaaaacacuccagccccuugcuucuucuggucugguugccucuggcccauugcacugccauugcccugggguuccuccuuacuccacuucugaguuagggcugcuuuuugagucuaauaucuuugucuuucuuggauucuuuucccuucaucuuauuagaguauauuuucagauaauuuuuuuugagaaaguaucuuugggggugguaaacuuuuaaauauacauuaggaaauguuuuaccuucauacuugauugauaguuugaauuucaaauuuaaaauuauuuuccuuguucugcucagcacccauggcccccauucaauauggagacucguguuuuucuuuuucuuucucuuuuuuuuuuuuuuuuuuuuuugagauggaguuucauucuuguugcccaggcuugagugcaauggcaugaucuuggcucauccucugccuccuggguucaagugauccuucugccucagccucucaaguagcugggacuacaggcaugugccaccacgccuggcuaauuguuguauauuuaguagagaugggguuuuaccauguuggucaggcuggccucgaacuccugaccucagaugaucuacccgccuccaccucccuaagugcuggguuuacaggugugagccaaguauaucuucuuugauuauuuauuuuccuuugugccuuuuuggaacucuuguuaaucagauaauaaaaaucacagauugaucuucucuauuucuuaacauuuuuuucauuuuuccuauuuuugccuuuuccccuacuccacggcuuucuccuaaguuguuuuaauuuugcuaaucacaauuuuaguuuccauugauuauuucauaauucccugauugcuuccuccccauagcagucuauuguuauuuuagaaaugcaguuaucuucuugagugugucugagaaaacuaauuagaauuucaaaaaauuaucuguccuguuuguccauuuuuucuccccuucuuauuuuuuuccccauccuucuauuuuguauuuugacuuuucaaaauguuugaugauccuuuguuaucuguacauauuugugaaugaagaugucuuagcuaauggggauuuccucugccuuuuaugguugcuuugggauuucaagggaggaguggauucugccugaccugcacccuuauucucugaguguugugaucugcugcuguuuugucaguaaaauacugucccauccacucuuugucuuacagaaauuaggucucuauucucuuauucucaguacucuaauggauuuucuuuuuuugugcuucuuuaccaucauauaaaugggauuugaggaaggaagauaaauaugcaugcacagucucacauugaguguuaacugauguuuauuacugcuuauucaacucucgaucuucuauauucugcuguaaagagagcaaaaaggauacuuaacuuucucauauaguaguuggaugccaaaagccccaggccugcccaggucuagguuucacauuuccuuucuuugcccauuucaggccucaaaacaauuuuguaacuuuucagaaugugagaguuaacuuucuuccuuagacugguuugaugugcucuaucuacuuaauuucuguguuuccuuuuuuauuagugauaaccugacuuacuguuccuguaucuuucugccagucauauuuauaagcuacuuuuauggcuuacaauuauauaauaauaacaaaaguauuaaaaagucuuauaaagaauaagaaaaguauucuuuucuuuuuaguuuggagaauagggaggaacagaaaaggaagggaaaaaaagagagcuggccaggugcagugccucacaccuguaaucccagcacuuugggagguccagguggguggaucaguugagcucaggaguuugagaccagccugagcaacauggugaaacccugucuccacaaaaaauacgaaaaaucagccggacauggugguuugcaccuguggucccagcuacucuggaggcugaggcaggaggacugccugagccuaagaggcagugauugcagauugaggcagugguugcagauugcaccacugcacuccagccugggcaacagagggagacccugucucaaaaaaaaaaaaaaaaaaaaaaaaaaaaggaaaaaagagagcgaagggcuaacuucugaguguggauaaguuccugagauuguugacauuucuaugaugagcaaagcucauuuaccuucuccugccugauggaugauucaacugaauaugguuucuuucaccaggaucugcccccaccccauaauugugaauauuuuaauauucauuugaacagauggauuuuaggaaaugggauggggaugguagaggcauguucucugccucagagaacucaguucauggaccgguuagggauaccacauuuagggcacaugaaacaauuagugacccacucaugacaguacaucauuauuaagguauauauuaacucuaaauguaguaaggguucggcagaaguuaggaaaaguuagggcuugcguugggcuuuaaauggguagaauuugggaggagagagaagccugacaauccaaggaguggagaagcuugugggagccaagauacagagguaaaauaaagcauacucuaggaaaagcaugugaaaugaccgaagacuacuaaaauggauagguggggaucaagccuggaauucucuggauagacagcuugucuccacagugaccuuuuaaugaguuuucacaccuaccagaguggguguaccaggaagggauaaaaggagcagguaagugcugggucccaaacuaaaagucaggcuucaugaugcaacacugucugacccacuauaucacucuggucccccccccuuuuuuuuucuuuuuaauauuuaaagaaauuggagaaggcugagagagaaaggaggaauuguuaagaggaguugcuaaauauagucuuggaaaauauaauugccauaauuucccauuuaggugauugcccacagugaguaucaaaaguccaaaagaauuuccaucuuucugagcaugcaagaugaaauugagacagaagagaucaucaaggacauuuuccaacgaggcaaaaucugcuucaucccucgguaccgguuccagagcaaucacauggauauggugagaauagaaucaccagaggaaauuucuuuacuucccaaaacauccuggaauaucccucagccuggugagggugauguucgggaggaggccuuguccacaggugaguauuaugguguuaggauguuguuagauuaugaccaguuguuagaucucagauccacggguuaugugugggucagugggaguugcuuuuccuguaagggauuaauuuguauuuugccuacguuccaagacaccuguauuaccugguuuaggaugugaugccuuuugaaaacuguaaaguguaaaugaauaauauuguugacuucucacauauuguugcccuaccuuguggguugaauuauauauuuuuccugaauaauuauuuccugugguuucaguuauggucugcuugcuaaugagcauauuauuauuaauguuaaugagcacuuauaucuucucaacuucgacuaccuaccauguguuuaucucaguacauggcaccaccagcuacccagcuggccaugccagaaaucuccaggucauccuugacuccccucuuucucuuaugccccaccuguggucuauuguuaaguccuaaugauuuuaccuacugaauauuuacugaaucuguccauuucucuccaacccacugcuacuacugcagucuaagcugacaucuccucuugccugcauuccuggaaaggccuuuuaacuguucuuucucuccaugucuugcauccucuccuuccucuuuauugguuauuuaaaaguaauugaaacaagauuuugaaaacacaaaucugccacuucucuccccuccuuaaaaucuuucugugacuuacuauugcccuuagauugaaguaaacccuccuuaacgagguucuuccuaaucuuggcccugcuaucuuucuauuuucacaucuuucuacuccccacuucauagucugaguuccagccacucugaguaucucuguuucccaacuccacuuugccuucucuacugcugggucuuaauacaugcuguucucuggccaacagcugcuugggaaguuuuaucauuaugaaacagguaaagagaugaaagcaaaacaagcuaaggguauuauuuuuuaguauaaugccugaaacccaucuuagagguguauauuuuugacuaagacuuaagugguugcaaagaagcccuagcacaacuuuaugcagucuucgcucaguuucugccccuuccaauauaacaccauagccuauaaagucaguaugauggagucagaggggagagggucaaggacucguaacaguagagggauuauguacuuugcuaguuuaacuuucccuguauuguccaaucuugggcuuugcuagauguuaggcaccaaaaauacauucagaucuaccuccuucauguccugcaucaauaggccagaugaaugucagcauuuuaaaacucuuucauauuuucaaggggaaagauugcaagcauuuuaaggcaaugagauaauaagggaauacagaguaucuuggagagcagccuagguuuaucgagaagaaaagacaggaaauuauagcuacugacuuugcucaaacuuaaugcagcuacuccagacucgcaggcuuaaugguggaacccaggauacugucccaauuccaguugacucuguuaacagcuccuucaaugcuuguaucaucucuauaaugugccugcuaauuggaauuuuacuugguuuccuccaguaacuaauuccucuagaggcagcucauuccuuuuagaacagcugugcuccuucuagaacaucuucuuuggguugagcuaaaguguguuacuuugaacuuuugugcauuuguucugguucuauucaaguacaguggugaaaagaguaaggaagaagcauuauuuuuccuuuuaacuuauauuuacacuucuugguuaggauaaucucaauccaaauaagugagucaaucauuuaugcagguuuuuuuuucuuuucuuuugagacagaguuucacucugucacccgggcuggagugcaauggcgcuaucucggcucacugcaacuuccaccgccuggguucaagugauucuccugccucaguagcuagaauuacaggcgugcgccaccguggcuggcuaauuuuguauuuuuaauagagaugggguuucaccauguugaucaggcugaucucgaacuccugaccucagaugauccaccugcccuggccucccaaagugcugggauuacaggccaccgugcccggccuauguaugguuuuuagcaugucauuugucacauaggagcuaucgaauaaaugguaauuuauuaauuuuaagcaaggaagucagaauuauucauuauaagauaaacucauuacuagccaaguaguuaacauuucgguaauuuucagcagauauuuucacccaucuacuuugugucagacacuauuuuaggucuggaaagauaaggcccugauuugaagggacucacacuauagcugaugagacagaaaaugaacauaaacagaauauccuaaccuguauuauaugucaaauauaagugucaaaugaaaagauacugaauauuaaaaacauagaaauuuagaauaugguucugaauagaaaaacguccaccaaaaaaaccccacaacugguugcucauuuuuuuuuucuccucuauaguauuuauuuaugcuauauuuguaguaccaguggcuuuuuucccccaugcauuuuucuuugcagauacuugcaaucuggauuguaaagggauagaggauuauacccacaguuucucgaaacuucagucuggggucaaagcucgcuguuguuguuuauagaaauguuugaguaggcagccucagcuguuuguuaucuccuaacaucacacucuguacuguggauuuuuacuugcaucagcaacuuaaaaugugacaacuucagugcuuaagcauacaucuagcuuuacaguguuugggacaagcugaucagagcucaggcugucguugguguagcuuuuguugucuguuuaucuuucuuguuugcucacauuaucagagcuuagaaaagagugagcuuuuguguccucaguugcaauuauaaguuccuaagcaaaaauuucccaugggcuauucuuguauuauauauguagcaaaagaaauagauugcuaaaugaaaucgagggucggauucuuucccaaguuuauccucaagguaagggcugcuugggcaauuagauuagagcaggaauuuuuccaaugcaaguauauagucugauucaaccgggcuuaagcaaaaaugagauuuuauuggcccagagacugaaaaguucacagaagggcuggcuggaucaguggcauuaggagccagucuaucucugccuuuuggcuuugcuuccaucuauaucaguuucauuuacuggugccacaugguggcccauagcagcucuagguuccauggcauccuuacugcuagcaauaaagaacaaguuuguuuucuaacaguccgauaaaguccuggaccuaacucuucuugacccaaaugggcaucuugaaauuaaucacuauggccagagauauggaaucggcugacuggcuuaggccugggucuuacgugccugucccugacccauucuuugugaccaggaagaaaagaagugcggauugacuuagacuaggucauaugcccagcucggcagcccuacccaaaccacugagcugagaguagggugagaguguuuguuguguuuccagaacaagggggaauggauacuggagagucaaaacuaaacucaccaaugcugucaaucauuucugaaauucugcagaauauaauaggcucuuugcagucauagcuuugucagugcugauuuuuaacuuaugaucuucuuggaggcuuuuugggaauuaauaucuauguguaguuaccugagccauaacuuaaugaucacaacgaagacuuucuaguccucaaauaaaacauuuuaaaguaauugaguggggcaucaucaaggacagagucuuugaacaacccuucuagguuguucaugaucaguacuuuugggaggguuaugauugguucacugugaguagcucacauugacuucauuucuuucuuuguuaggguugcauggcgucugcaagaauauaauaaaagauaguggguauggauuucaucaaggcauauuugauggagucaugauauccucaggaggcuggagaaauuuggauuggcucauaauacuuuauucagaaaagauguguagaucacugcucuguggaaggugugaugggaguauagcagggaacagcauggaccugguucccaguguuuuggaguuaacuagccuauuguccucacagaagcagguuugugcuggcaugucacagggcucucuccuuugagcuguccuguucaacuuuuuauugaacuuuuagcuuuuuucaccuuuuguugaacauuuagaugucucacuguuccuuauuuucagcaugucuaaauucauucuuaucauucuuuuuuguuuuucauauuucuguuagcagccacuuuguagacauggaauuauccuugccuccuucccaccaucuacuuauuaccagguuuuucuuuguaauguuuuuaucaccugucuuucucuaauuccaguuuugggggaauucuuagucuacaauuuucauucuucauaucuguuccauuggaauaaacuuuaaauugguuuccuggccauauuaauuuucccaaaguaccuuucuguacaggucaucuacccuauucaagccuucucuguacgcugaauagaucuguguaccugggcaaacaaugguuccugcugguuguugucaaaagaagggacauuggaugaaauccaaacauucaggccacuuucugggucugaccucccucucuaucuuaauacuugugccuccuugguacagcuccuuauuucagccaaaguggucugcuggaagacaguauuuccuaguaauggaaaauacggauuugagaaucauacuaaccuggauuugaauucuaguuuugcuccuuucuaauuguguuaccuugggaagaucacuuaacuucuuagaguuucagucuucuuaccuguaaguggacucagaccuaccuuacauaucuguuauggaguuuaaaugagaaaaugucugacuaguguuuggcacauaguaggugcucaguaaaaaugccauuguugcugcuguggcugcuguuguuuuugcugauguugaguggucaagcauaggguaauguuaugugcuuugcugugaaagugauuuuguuuauaccauuuuccagucuagaauauauuauguguuucuucaggauagucucuucuagucuggugcuuaagaucacuggcuuuggagucagacugaucugaguuugaaucuggccuuuaccacuugggcagaauuacuuaacaucucaaaguccaaauuuccccaucugaaaauuggagauaauuacaguacugacuaauuguguuguugagaggauaaaguaagguaguaaggugauauauguaaagugccuaguacaguucgccuuguagucagagaucaauacauggcaguuauuaacaguaagcagaaauuauuucccccaaaccuuccauggcugccuacaauguacuaguccuuuucuuccguaauucuuauguacuuggcacuuuacguauauuagcacguuuuauuaauucuuuuuggaaguauaucccuuuucuuugcugauagacucuuucggagcagaaaccuucuucuaaaucauuuguaucccugguaccuagucauaugguuuauguuguagacuuucaguaaaaguuucuugaggugaagcuaacaguuuugaauucaaagcgugccuguauaaaugaauagauuaucaacacuuuauagcuaugaaagaaaaucuggauuuaaaaaacugugugcauguacacagggacacauuaaaaaguauacuagagucaguuguuuuauaaggcgcuguaacuuguuguuuuuagagacaaggucucacucucucacccagacuggagugcagggguguaaucauagcuaacuguaaccuugaacuucugggcucaagugauccuccaacuucagccuccugaguagccaggacuacagguacacacuaccaugccugacuaauuuuuaaauuuuuuguagagacacgucuacucuguugcccaggcugaucuugaacuccuggccucaagcaauccuccuggcuuggccucccagagugcugggauuauaggcgugagccacugcacccaaccaacauuuuuuauauuugugaguaaagaguuaacaucggucccggacuaagcugggccugccugggggaauaaccuugaaacuuaucuucucucagcacuaguuuuggggaagccauagaguugugauaaugugggauguaccuguaccugccuguuacugugugcuacuacaccugaauugggagcugugaguuggcauggaagccuugggucuguggaacuagaucuguauaaaagaugggcaggaaaugggaguugcagcuucucugugugaaggugaccuaugugccccuuggcucuugcugcacccugugugagugaggaggcaaaagaagcaguguacugagguagcugcugggcccuggaugagguaaagaugcugaaccugccauaucuccucuucuguguucuucuguaaggcuaaguacauggaguaauacuuagauugguuccugagcccgagugcuguaacagcugcugggucaaugugguauucucaauccagucucuggguuuguuuuuuauuuuuuguugggggcaggcagugcagcuuaaauaacagacauuuauuuucugacagucuggguauuuuuaauaauauucuguggagacucuaacaccacuggucccaccagugacugucagcaugucuaugagaaugcuuaauuuuuacuaagccaagaaauaaguaguuauaagauccuacaugguaugauauuuuaauaugaguuacagcuuaucuucucauugaaaguguuuccaaaccuuuaacacguguuucuuuagcuuaacaaaaaucguucucacuaauuguauuugaacuuuugaaauaaguuaugacuaaaaguaaaugaaagcaauuguaauuuuggaaugugcuuuugcacaucgcacaugccauuguaggcauuuugggugaccucccucucuggacaauugagaacauugccuccugaguuaggcacugugggagggagagugaacccuuacuguccuugcuucaucuucuuuguuuucagauaggauaacugcaacccagggaggcugucacuuccccaaggacacacaggcaguuaaugauaaugcgaggucacccaguucugguuuccacuccagugcccuuugaagugccauuuuucuucacacuucauucauuaauauugcuuuacuaccuagauuuucucucucuugacagcauacugcauuaaaaccguuauucauggaacagguacccuugguaacuguaugcaugggaacauugucauauuuucccaaggaagaacuuggacugagucacauguaucuaaaaguacucuggucucaaaguuaagcuuuuuuuuuuuuuucagucauuuuguauucggcuaaauacacaggaagaaccagcuacagcuuugauuuauaacagggccuuucauuugaaugagaagugcacccaugauaggcuuccuuggaccuguuccagaauugucuauuuuaucuuuugcagcggcuuuagaauauauccucauuucagagaaugguaauuuacuucuuguuaacucccagcccauuaagauuaaaagacaguuccuuagggguuaugcccuguuauucuugccaagaugggcuagccugcuaaauguucuacucaagcauaaugauucauugaauguacuauugaacacuuaacugucuuuaaaaggacuaacccaggugacuuaaaccucgcuacauauagaacuucagguguuuaaacugcuuuuccaauucaauuuuuauuuuaucaccuuaauugagacauuaaaaugucuauuagguuucuauguuuuuguguauacauuuaauucagaggaagggcagaauuuuuaagaggagugaaguuggaauuagaaaaaauaaauucuuuuuuuaguuuauugcucugaaccuuaaauuucaagcuaggguaguaaagaccuguguguaaaugaaugcccagcuuaaaugcugccuccuccaaaagucuucuuagauuucuuagucauauuuaaacacuuccuccuguguuuucgcccuguauuuugacaccucagcauaccuuuugucauuggauuugcuuuauuauauccuauauauguaguuuaaaaguuuuuuguuuguuuuuuuuuuuugcuuuacuacuugcagggauuaggaguccacuauuuaauagagaaccccauuucauuuaccccacuuuauaaaagguuagaaaaguacucuccauauuaaguuuauggcuucauguaacuuucaccugaugguccuuuagagaaacauauaaauagucuucaaacauuuuuuuuuugguguguuugggcuuagcacagugcccugaugaaucugagguaccaucucuuucuucaguaacuuaaauauccuuuuuaaaguacagcugagaauuguauauugagugaaugacugauaguauugcaaagaaaugcagauauaauagcacaugauccaucaauguuuaucuuuuauguuaaucgucaucuacaaaaccagauuguauugauuauuauccauaaauaaacaagcagaggccgggcgcaguggcucacaccuguaaucccagcacuucaggaggcugaggaaggcggaucacaaggucaggagaucgagaccauccuggcuaacauguugaaaccccgucuuuacuaaaaaauacaaaaaaagaaaaagaauuagccaggcgugguggugggugccuguagucccagcuacucaggaggcugaggcaggagaauggugugaacccaggaggcagagcuugcagugagcugagaucaugccacugcacuccagccugggcgacagagcgagacuccgucuuaaaaagaaaaaaaagaacaaaagcagaauaaacuaauuuacuguuggaugaaguaggcagcaaaucaugagauggaaauugaacagaaacaaaaaauaucuuccuaacugcccaugucauuacuuuggguuaaagcagucaaauccacuguaaaaauuuaaguguucuuuggguguagugacacagggaaccagaaucacuuguaagaaguccugugauuaauuaaaaaacaagaaagagcuaggaaagaaauuuugauuuuagucagaguuuuguguguauauaugugugcauguguguguguauaugcaugugcuguguauaaaaugggucaugauguuuuucuuacugaguuucuaaaauguuugaaagccacugauuuaggccucugcuucucaagaaggcaugcaucuauuacaggccuuauuggguaaauuuucuucaacuauuaauuuuacuucaacauuuuagcagaaacaaaccagaaaaacaaacauauaaacauacaaaccacacauuaguuuuauaacaaauacaaucacaaagguagcauauagaagauaaauaaaauucacaaauuuuaaggaaaaaaauuagcugggcaugcuggugggugccuguaaucccagcuacucaggaggcugaggcaggagaauugcuugaacccaggaggcggaaguugcagugagccaagaucacaccauuggacuccagccugggggacagagugagacucugacucaaaaaaaaaaaaaaaaaaaaaaaaggguaauaauuuaaagguaaaacacaaaauauuaaagcaaaaacuuugccucugugggcaggccugcaggcagacccuccagggauuuuaacuuucucugcaguuaccuuagugaaaaauuugggaaguacuggucauuuaguggaauuucaaaauuccacuaauggaugauacaaaugaaaagcaugauacaaaugaaaaugaaaauuuuuuguguuaaauuuuuuuugaugugcuguuuuaguuccucuguugauuuuuaagcuauguauuaaauuguuuuugcaguuucuggagggauuacaucuuuuauuuaguacagucuguuucagauuaguauucaucugacuccaguaaaauacagcaacuuugcucuuauauaauuccauucuuccuuccccauuuauguuauuauugucauauugaggcaggaaauuaaagaaagaaagaaaaaaaaaaagggaauaagcuuuccugugcuaggcugacuugucccagaggcagcaacaagcacagcugaaacccaggaaaagucuugauaauacuaucuaagaagccaggacacagaagaaugugcucuggagacucucccaccacucccuccacauagggagaagaaaaacaaauuucucuuuguuuuacaguaugaguuuauagauuccuguucccuguaacuagugacuucuaguauucuguuuuaucuaagcaguggagugauggucauaaagcaacugagcaggccugagauacggccaccugggcaccauagugaaggccauggaauaagccuugcuaggcacuacggcaaacuagauaauggccaucugaguugcauagcaauggucauguguaauccugaguuaugaaccuguuacaauuugauuaaccgucuugucuugccucuguauccuugcuuuugcuuugcgccaguguaagcuugacucaaguuagcccauccccuuuuagaaguguguauaagcgucaagugcugucuuuguucuuggcucaguuuuuggauguugagucugcugggucugagugcacucagaaaagauccuccugguuuaccccgaggucucucuuguccuccuaauucacacgacaguauaaguuacaucuguauguacuauaaaucuaacaaauaguauuauaauuauugcuuuaagaacucuuauguuuuaaaaaggaauagaagaaaagagaaaaaaccagucuuuuguguuuaccuuccuacuuacuguuuccaguguucuucauucuuuccugugaauucaaguuaccauccaguguaauuuccuuuuggcccaaaggauuuucuuuagucuuucucagacagcucugccaguaauuaauucucucaguuuuuguuuaucuaggaaugucuuauucugccucuauuuuugaaaggguuuugcugaauaugaaauucuuaguugacauauguauuuuuuuuccuuucagcauguucaauguuauucuucugccuuguggccuccauuguuucugaugagaagucaucauucauucuauuuuuguauuucccuuuuuauaauaaguuauuuuucucuuucagcaguuugacucugauguguaaaaauguagauuucuuuucuuuuuuuuuugagauagagucucgcucugucaccaggcugaagugcagugacaugaucuuggcucacugcagccucugccucccggguucaagcaauucuccugccucagccucccaaguagcuaggacuacaggugugcacugcuacgcuuggcuaauuuuuuuguauuuuuaguagagaugggguuucaccaugugggcuaggauggucuugauuuccugaccucgugauccacccgccguggcuucccaaagugcugggauuacaggcaugagccaccgugccuggcauguguagauuucuuuaguuuuauccuauaugggauuuauugagcuucuugggucuguagauuaauuuuuucaucaacuauaggagguucucagccauuauuuuucaaaaaaaauuuuuuuccugccacauugucucucuucuccuucuaggacucuuauuccauguauaguauauugguauucuugauauugucccacaagucacuuaggcuguguucauuuuucuucagucuuuuuuuucuuuuuucacguuggauaauuucuguagaucugucuuuaaguacacugccuuuuuucuuccaucaucucaaacccauuguugaauccauguagugcauuuuuuauuucaguaguuguacuuuucuuuuuuuuuuaaaaaaggaguuucacuguugucgcccaggcuggagugcaauggugcaaucucagcucacugcaaccucuggucccuggguucaagugauucuccugccucagccucuugaguagcugggacuacaggcacgugccaccacacccagcuaauuuuuguauuuuuaguagagauggaguuucaccauguuggccaggauggucucgaucucuugaccucgugauccaccugccuuggcuucccaaagugcugggauuauaggcaugagucauugugcccugccaguuguugaacuuuucaacuguagaguuugauacuuauugaaaguuucaguuucuucauugauauucuuuauuuguugagucauuggugucauauauucauuuaauucuaggaacauuuguuuccuuuacuuuuuuuuuuuuuuuuuugggauggagucucacacugucaccuaggcuggagugcaguggcaugaucuuggcucacugcaagcucugccuucuggguuuacaccauucuccugccucagccuccugaguagcugggacuacaggugccugccaccacgcccggcuaauuuuuuuuuguauuuuuaguggagaccggguuucaccauguuagccaggauggucucgaucuccugaccuugugaucugcccaccucggccucccaaagugcugggauuacaggcaugagccauugcgccuggccuacuuuaguuuuuuugaacagaauuuucuuuaauucuuggcucauauucauaauggcugcuuugaugucuuugcuaaauugaauaucuuggcccacuuagacuucauuuuccuugacugauuucccccaccuugauuauaggucacuuucuuguuucuuugcauauccuauauuuuuuuuguuguugaaaucuuuuugauaauaucuuguaguaucucuggauucugauuuacuuuuugaaguguuuguuuguuuuuugguaacuagcuugcucuuagccaguuagcacauaucucccuaugauaugugucuauagauaucucugcucaauuuuugugugcuuauuuauuuuuuggccuggcuuccuaggugcugcuccuauguccauauagcuuaguggugagccaaugauuguuucuucaaauauucaaaucuuuugcccaauuuuaauuacauugccuuuuuacuguuguguuaucuaaguuuuuuauguguucuggauaauaaguuccuugucagauaugugauuugcaaauauuucucccauuguguuuuuucacucucuugauggugaacuuugaagcaaaguuuuugauuuugauggaguccuauguaauaauuuuuugcuacuugugcuuuugguaucauagcuaagaaaccauugccuaauccaaggucaugaagauuuaugccuccguuuuuuucuaagaguuuuauuguuuuagcucuuacauuuaggucuuugauguauuuugagugaauuguuguaaaugguauaaguuggggccaacuuauucuuuuguauauggauauuugguugucccagcacugucuuuaaaaagaugauucuuuccguauugcauugucuuggcauugugucuucucuguuuuugaaggacagcuuugcuggagauagaauucuuggcuggcaguguuuuucauucagcacuuugaauguguuauuuucacugccuucuggccuccagguugccauugacaauucagcuguuaaucuuaugaggaucugaggaucucuagugauuuuuuuuuuuuuuugucgcuuuuguugcgggaagucagggacccugaacggagggaccggcugaagccauggcagaagaacauaaauugugaagauuucauggacauuuauuaguucucgaaauuaauacuuuuauaauuucuuacaccugucuuuacugcagucucugaacauaaacugugaagauuucauggacauuugucacuuccccaaucaauacucuugugauuuccuaugccugucuuuauuuuaaucucuuaaucccaucaucuuuguaagcuggggaugugugucgccucaggacccugugaugauugcguuaacugcacaaauuguucguaaagcauguguguuuaaacaauaugaaaucugggcaccuugaaaaaagaacaggauaacagcgauguucagggaacaagggagauaaccaucaggucugacugccugagagccgggcagaacagagccauauuucuccucuuacaaaagcgaauaggagaaauaucgcugaauucuuuuuuucagcaaggaacagcccugagauagccuucuagauucccuggaauaugucggagcuuuucaaaggcuccucaggacaucuucuuccccaguuuuuccuuuuaaguuuuuuggucagccucuuguuagcacuaacuggauuccugccccagacagcugugauauuaaacaauugccauugauuuuuaaaauaaauguccuagggcuagggcuuuuugcauggagagagcuaugagucagaucaaguaaagauaagaccugacaaugcaccuuuucagggaacugccagacaaauuaauuagugacaguuuucugggauggagcuuuuguugagcuccaaaccuguucugccccuccauuggcugccaggcuguuggugguugucacagcuauuuuaguuguaaggcuguugauuuucaagucuaccaugaagcuggggagagggggaugggaauggggcaaguugaaaaggcacaaagcucacuguucuuacagagaauaaacauuuagauugguguaagccuuugacuaauuucuagaguuuugaaaaguugauuuugaccauuuuucccaauguucuugcugguuuuauuaaggagcagauuuuuaguuuucuacucugccauucuagaagugauucugagccagugauuuagauaguaguuguuuucaaacacuggaaugcaugaagcuccacugauugaucugucugugaguugcagagugcauucaaguuuuagcacuucucuaguuguccuuggcuguuacucucugccaagcucucucagaucuucccugcauaucccuauaguuucuagucagccagguauguaggaagaguuuaucucagcccuucuauggaccucuuauuuuaguauagccacauuacauucccauuaugcucuuacaccaacugggauuacaaccuuggcaaguaaagcuguaauuuuuccuguaauauuccuauguuuagcucacaaagcccccuaccacaaguuaagucugccccuucuggcagcagagcugcuguuuuuuccagccagccccauauugguaaaacugccauucuugaggacugagcugggggccugggaaccucaccagguaagaggaccagagacuucugcuguuccuacucagucuuuggucagcuuccaaaucccugaaauggcuggcuuuggaugauuuuguuugauauacaguauuuuuuuuuucagagaggauuuucacugauuucuuaccaucauugcaaaagggaauguucaggagaggaaauuucugauuuuucagggaugugguaugugggagagaugcauaauguaauaacaguccaaauuucuugaguacuuacuaccugccagaaacugugcuaagcaauuauuuugcauugcuucauuugauucuuuccauacccugcagaggcaugggugcuauuaauauccugcuccucuauuuuauagaucagaaaaaaggcucagaugaaguaccuuaucgauggucacacaacucaugaguggcagaaauaauauuaagacccaggucccuuuggcuguuaagaccccagcccuaaaccacuacaucauauaucuauagcuggagccuggcaccaggaggcgucacaaugggauugagauagggauacagaaagaaggauggggacugaaaggugaaggguccugaagcccugagcuuccucuuuugcuguucucacucuguuuccuggagguuuuacugagugcccugugguguugacugcguccuacuugcaagcccuguggucucccuaauggucagcuaggcugggccucuaaggucuuucagaagugcacagcccuauggugaaaaggcauccuuucucaugagguaacagaccagcaggacuugcuuuuuggucacgacacugcugaccaaaacaggaugugguccagacaggauaaaauggagaaaccggcagaaaccagcagacgaugacaaaagugaucccuggcugcugucauugcucauuggcauaagaaacuccuaccagcaccaugacgauuuacaaaugccauggcaaugaccuggaaguuacuaccccuuuccauggcaacaaccuggaaauuacgauccuuuuguagaaaguucuaaauaaccucaauuugcauugaccugccccuuaauuuacauauagccaaauguggguuuaccugaauguuaaauacaguugccaggagccccugccuugcugacucugggcuacugccugagcgcuagcccuacucugcaaggagcaguacuguucagucaaaggcucacuccugaauucuuucccggcaaagccaaaaacccuccugggcauaaccccaguuuuggggcucaccuguccugcaucacucacaugacauuucccuauuuaaacacccaugaucccugagcccuacaagaccagaaggucauagggcuccacaguguuaccugguaauguuacagaauuagaucagagaaaaugggauuucuucauuguagugugcuuaaugaucucuguaaagaguauagcauaaaaaagcuucauuaguuugaagacuuauuuugauugaacugcaggauuucuguuugggccucguguauucuauuaaaaugaaauaaaguagcuauacuuaaauuuuuuuuuuuuuuuuuuuuuuuuugagacggagucuugcucugucgccaggcuggagugcagugguguuaucucagcucagugcaaccuccaccuccuggguucaagcgauucuccugccucagcaccccuaguagcugggauuacagguggccaccaccaugcccggcuaauuuuuguauuuuuucgguagagaugggguuucaccauguuggccaggaugguuucaaucucccgaccucgugauccaugccucggccucccaaagugcugagauuacaggcauuagccaccgugcccggccuauguaaaaaauuuuaauuuuaauagcauuugaagucagcauuuaauuuucuucuuuucuuuuuguuuaagcauuucaaauugucacuucaaacauuauacagaguuuccuugguaguacuuaaaaguacuauuuuucuaguaaucaccuuuaaguuuggcauuaauuuuuuuugucugagaauauuuguauaauuuuuuuauucagcaaaacugcaaaugaaucguuaauuauaaaagagguaaugaaagaagauaaaguggaaauugaacacuaaaaaaaaaaaaaaucccuuugucuugaauucuccccucaucaauuuucuguggggcaucccucuguaaauagcuuaugauugaauuuuugauauuuguacccaacugguagucuuuuaguuaggcuguucagucuguccucuuuuuuugggaauaaugcaugugucuggccuucuuucuguuaccuuugucaucauguuuuugggagacaauuuuuuuugucauuuccuuuucuuuguguccuuuuuucccucuaguacuucauaauuaugcauucauuucuacuauugguuacauuaaaauauuuuuagccucaaauucucacuagcauuauaaauauaguauuuauugaccuuaccccugugaaagacaagaaauuaaaugugccuuuucuuuucuuuuuuuuugagacagagucucacucuguugccuaggcuggagucgaauggagcaaucuuggcucacugcaacuuccaccucccagguucaaguaauucuccugcuucagccuccccaguagcugggauuacagucaugugccaccacgcccagcuaauuuuuuguauuuuuaguagagacagcuuucaccauguugaccaggcuggucucgaccuccucaguucaggugaucugccugcuuuggccucccaaagugcugggaauacaagcaugagccaccacgcccggccaaugugcuuuuucuuucuagcuuuugucaacauaaacugguguuuaaaauuaauaguaguuuaaagauguguauauucuuuaaagaauuuuuuucauugacauucgauuauuuucuuacuauauuauagaguauagagaagagucauuuaaacugaacuguaaauuuuccuggguucaugauuccuuguuccuacuguuauagcauaucuucuuuauucuugauuuauguauuuugaugaauuucuuggucagauggaauauuccuuuaaguaguuuuuuucagcaugguccgugagugguauguuuucagaaugcuuuuauuuuugaggcugucuuuguacacaucagugaauucuugaauaggauagaauucuagggucacaguuuuuuguuuuuguuucuuuuguccacccagaauucuagcccaggauuuggcaauuauuuucugucaagugcuagauaguaaauauuuuaggcuuuucaggccauggaaucuuugacagcagcucgauugugccacugcaauaugaaagaaaccauagacgguaccaaaacagacaguguuccaauacaacucuauuuacaaaaacaggcaacagaccagauuuagucuuagggcuauaguuugugaccuguguucuagacaacuagucuguugucuuguggugauuaguauuguaggugaggucugaugucauucauguuuuccuuuguaagaaacuuguuuuuucauugcuugacuucuuuuaggaauuuuuguuauuuuugauuuccaaauuuaauauucauuaauuuugugaauuaauugguauuuagucaucucuuucauccuaaaguuucauguccuuuuuaacuccagggaacuauuuucaacuaucuuuuuugauaaucccuucuuuccucuguuuuugaaauuauuauuauaguuacuuugguucuucuggaucuguaauauauuucucucaucuuuuuauccccaucacuuucaaaaucauuuggguuuauaaccgaaguucccuaucuugucuauuuuauugauuuggguucuucuucugucuauccuguuauuccuuugccaucauuaacauuuuaaaauuauuaaucuuuuaaaaaaaucuguuaagugagccaggcaugguggcucaugccuguuaucccagcacuuuuggaggccgaggugggaggaucauuugagcccaggaauuuaagacuagccugggaaacguaaugagaccccaucucuacaaaauauuuaaaauuagcuggcuguguuggcauacaacuguagucuuagcugcuugggaggcugaggugagaggauugccugagcccaggaggucuagguugcagagagcuaugcuugcacucccaccugggcaacagagcaagacugugucucaaaaaaauaaaacaaaaaccucuaagcaauuguuacaaaucucagauuauucuuuuguaugacuguguuuucuaauuuuauauuauagaugcagcauauucucaaauaucauuguuaaaagcuuuguccugaaauaugucuauuuuaaugggaaauauuugcacugauucuucagacugguccuucuccccaucuuuauugugagagauauagaauuuaacuuuuaaaauaguaauuaaauaccacaacaaaguaaggauacuuguggaguuguuuucucuuuaaguaaguacaaugacuaaaaauacuucauuugccaagagucugcuuucguuccuuuuguauauuuuauuaaaugcugguggcauaaauacauacuuacuuuuauuccuuaugaccugauguagucacaguaccccaaaguacuguauguauuaucaaauaagcuaccaacacucaccguuuuuucauuuuucaugaaaagguuuacauuaaaaaaaaaugcaccuaguguauagucagaguucucagaaccaauaaguuuuauguuugugugugugcguguacaucuauauuuacaucuauaucuauacuuuuaggagcuuuauuauaaugaauuugcucaugugauuguggaggccuagaagucucaaagucugcugucuguaagcuagagacccaggaaagguagugguguuuacucaaaguccgaaggacugagaaccaggggagccuaugguguaaauucuaguccuugugcaggaaaugugaugagauggccuagcucaugcaguuaggcaagaaagaagggacaaauuccuucuucugccuuuuauucuauucaggccaccugcauugagaugggcuguccacuuuacugaguccacucauucaauuguuaaucucauccuaaaacacucucauagacacacauagaaauaauauuuggucugggcaccuguuggcccaauuaaguugaugcauaaaauuaaccaucacaccaagaaauaccucuccuuuccccaaacccuucauaguacgugcuauauuucucuuugaaucuaagaagauuaucuucuaugaggaaauaaucugcuccacacagaaaccugauacagagcucuuucaauaaugacucauucucaacaucaugaaauuauauucgaaguugcagaaaauucacuauuguauauugaaugcuacauugaaauuggaaagaaaaaggugauauaaaauaaaagcuauuacauauuuugugcuucucccuaaucugcuuuauucauuggaaauuccuacuuaaguuuagucugcuuaaaacaagcuagauacuugauuuugcaugcaacaccuuggcuguuacuuuuacugucuccuagcacugugcuacagacugcaaaauauuuagagaaaauucagaccucgcucaaaauaaaaaauaaaaaaugcuagcauggucuauaccaacguuggauugcugggcucacucucacgugugugaucucucucauucucucgcucgugcucucucucucucacacacacacuccacucaaagcuacagugugcauucuucuaugaucccaguagauuguaggucucuguauugacuggagauacucuuccaaguugaagauuuaaaaaagaacuuuagauuuuuagugcugauucuucaucuuuauauuuagaaaauugucauuuuuagauuccugauagaaacuuucucuaaaacauuaucuuaguacauuaauuagaaauuuaugucccacauauacuagcucuaguaauuuacuggugacuaaggcauuguuaagaaauguguuuggaaaacuucuguugguuuuuuuuuuuuaugaccaucauuacauuuuuuucuauuuuuucauuuaucuacguuuaaaaauguuuggaaauauuucagaauuugauaguuauaacaagcuacaagagaauaaagauuuagcuggauuacagaaaaauaucuacuuaguaaugagugaaaaugagauaaauuugucauaugugacauaugguaauauacauacagaggccuaaagaaaacuucaaugucccccccuuuuuuuuuuuuuugcuacguaaucuuauuuccuuagaaagagcauauugauuuuacuccacugagaguuuggcuuucuaaaaucaccucaacaguuaauugauggugauaaucaaccaagaauuguucuucauuuauauaauuugcuaacuuucaaguucccauugaguugagaaagauagugaugauagcucugacaauauaccugaaccaguuuggauaggaauguuuaaaagauguauuaggcuauuuuuauccuguagaaacuauaguucauaggaguggugaguuaggggaggcuggagaaugggggaaaaugggaaguaagauaaauuguugguguaugugguuuugcagauuugcuuuuuuggcacuaaaagaguacuuuuuuuuuuucuuuucuuuuugagacagagucucacucugcuguccaggcuggagugcaguggcaugcccaggcuggagugcaauggcacgaucucagcucacugcagccucugccucccggauucaagcgauucuccugucucagccucccaacuaacugggacuacaggugccugccaccaccaugcccagcuaacuuuuuuguguuuuugguagaggugggguuucuucauguuggucggucuggucuggaacuccugaccucaggugauccacccaccuuggccucccaaagugcugggauuacaggugugagccaccgugccuggccaaucacuagcaguucuuaagaaaaaaauguuuuggaaggucguguguuugcccucguguucuguguaugcacgugcacugaauaggaggcagucccagggucucgccugcugaagagauccugcacaccuacugucugcuuggcugucauccuacuguauuguagaagcauccacaucagcucccuuuuuauuuggggguugugcccagauccuaacucucaacaagauguuuuucauuaugcuuuauccaggacacucuuucucacugcuguuuucaaaugccuuuggguuacuucugggaaguauagauucaaacucuuccaucagguaacuguuuucaccaaauaauguacagguaaauauuuggaagacauaagagaaaaucaaggggaaaacuuaggaaagaaggaaaccguugaacucaaauaguuaucuucuggacccaugaucagguccucugagggaaaaaacacagauccuuuuauucaugagaacuggacauauuccugcugcuggauuuguucuuagccauuagccucucgaaugccaccaucgcugucacagagaccaaaaaaaaacaaaaagcugcuccuguuccuccuccuuaaaaaaaaaaaaaaacuuauaaaauuucaaacugcagugacuguuuucucucuucccucaccuuaaagagguuuagguuugccugcuauugguaguucugaugggcucuguuagagauugugugguugguguucaggcccagaugaagaaagaagggaauaguuuaaauuugcuacauuuuguuuugcuugagaaagaugcaguaaacugaggggagaagggaauaagcgauuauuguaggcaccugccggagggagcuuugccacuguaugaaggauuuauuuucuccaugguugguuuuugucagcauagcccaguauuugcaggggcagaagauccaaacauggagccuuuguuaggauucauggccauacccacauuuugccuagcacacugcugaggguaagcagggaugagggcugagguggucuuccucguuaaaucagcuuugcacuaggugucugaggcccaagaagggucaagauuugcuuuuuagcaacuugcugcccagagacccaucguuacgauacguauaccugcuccuccuggcugggggcuugacugcaguuccacacugguuuccuuccggcucuucccaaggcagccauuucuuuaacauguauuucauuaucaaauucccuuuuuccuaaauuauaucuugcagaaauaccucgaaguuuccgacuuagauauggcauucuuuccugguuucuaaucauaauagacauuuuucccaaguuuguuuuccuuuguucauuucacuggaaaugaaaguagaaagucaaauauuugugcuaaggucuuuaucuugaauuuuaagacuuauauuuaaauaaugacaguuuuacaaguucagguacauuuccacuucguuuucuuguaauagaaauuguguaucuuuauggaucaagguuuucuuuguaaaaacagugggaguuacauuauugauaacauuuugaauuuaaccuuuugaaucugcaaaagguugcuguaauauuuuguuucauugugaaccucuccccugaaacaaagagaaaacacaucacaauauuuggaaguuugccuggagugaacguuuauuuuuuugggguguuuuucuuuuugacuuuuuaaaaaacaguuuuuguuguuuaaaaaacugcaaaugccagccauaaaaauauucucuauuccaucugccuaaggccaaaaagaaaucagaauuaggcaaaugaaaaucaggagcugagcccagugaucaauuauguccacucugccuuuuucuuuuccuuucuaaaguguuguauuuguucacucacuuguguaacaaauauucugagaguccuacugugugugacacugugccaagcaaggggguacuaacuugucauaagccuggacccugcuuaugagucaaguuucuuacacuauauugaaguaagcaccagaaagcguguacaggucuaugaaagcucaguuucuggacauuuacucucaaggacuuuuuuuuuuuuuuuuuuuuuuuuuuuuuuuuuguugagauggagucucacuuuguugcccaagcuggagugcaguggcgcaaucuaggcuuaaugcacccuccaccucccggguucaagcgauucuccugccucagccuccugaguagcugggacuaugggcgcguaccaccacacuuggcuaauuuuuguauuuuuaguagauaugggguuucaccauguuggccaggcuggucucaaauuccugaccucugguauuucgcccaccucagccucccagagugcugggauuacaggugugagccaccguaccuggccccaaggacuuuuuguacagagacagugacauggguaaauuauuaguagcuacccuuugucuacuaagugcuaagccuuaugcuaagugcucuuacauauguaagcuuauuacucaucaugacuauguuauuaucucauuuucacaguugcagaaaguaagucucagagcauuauuuaugggcaugccacagucaaaaggcagagccaggucuuccugccaggucugcuuuccccgaaggcaugcuguuugugggauggcacacggugccuuuccuuacugccgucaugugcuguggaggcgaguaaaaggagggcaugcucagguuaucaguuagaaucagauucggcugcauguagcagaaaacuccaaaguaucagugaaaacuucaaaauaucagugagaugcuuggaaaagaagucugggaguuguauuuauagucuguggcuguuguacaggccccacagucauuagggacagauccugccgcauaugccauaugguccugccugguaucucaagcuucggcuaucaacucugaauuguagucagcaggaggaaagagaggguguugggagaaaaagagcauccuucaccuugaaagucccauuugucagaacuuaggcacaaggucauacauaacuaccagggaaggugagaaaugugguguugcggugggauucauggccuccugaguaaaguuuucugcuacuaaggagaaagagagaaugauguccagaugggcaaccagcagccucugcugcauucagcucaaggcagguugugauuucaguuggugucauggccugagcugaggcuggaggcccacguugugaaggguauuguaugucacacaucugggauuugaacuuuauuuuguaggugcugggaguuaguuauugaaagacuuuaaucauaggaguaacaugacuaguucuauguuugggaaagguuguucugccagaaauaaggaggacaggcugucccaagggacagccaaagaaacugggaguggaccaucccuugggaaucugauggauucgaauggaugagaaaugaugaccacuuuuagaaauggagaggauagaacaaguucugacauaugcagcauguagagucuccaggccacuugaggcuguugagggacagucuggcuuugccaucugcaugucaugcucuuaaccuaggcaaagaaugcagaagagagaggagauguaggggguugggggacacauagugaaucccguuugagguggcuccaggaccucccagaaaugcugguagauggcuaguuggauauauagcucuggaggucaggacauaggagauauugauucaggacuugccagaguauggucuuggggugugcccugauauuacaaacagggaucuuaguggcuaggugaugaggccauggcaaauguagauggaccaagaucaauuugccuuucuagaugagguuuucuaggugaaauguuuuugaaacuauuuuguagccuaguauaauuuauaaaaguagagagaaacuauaaauauaaauuuggaagggguuagcuaaaaggagaaaacagcagaaucuucauauauauagaaauggauauuaauuugcuagaauuaagagacugcagguaaagauaguuuuuuuaauaccucuuuuugcuguagaaaggacaggauaaaaugauaaagggaugcuggaaugaggaaugguaacuuuaggcaagauagucuucugugagggcugauaugaucaaugagaguaagacauuagaaauacaagaauuguccugcugcucacccaucagcauuuucaguuucuccuugcaaaaguaguaauuaacuuuguacuuugagcuguauguucaguuagugauaaaccguagauaaaaagcagauuuaauuggcugaccccagguaagacuugccucucucauguacccuuugaagguuuaacaaauaaaauuugagggaaagguugauguuacuuauaggguguguuaguuaguuuuuugggggugggaaggaggcauauuuaugugcaagcugccaaauauuugagauaaggacauagucuuugaaugaaaaacagggauaugagaggauugauucaguuagccgucuuggccaacccaaguuaacuguacuucaucuuagucuauguugguguuagaaacaacaaaaaggaaaaaaaaaagccaaacaguagagcaacaauucauucauucauaaaaguaauuacaugccaucuaacuaaucacaugguaaauaauuuaaaugguuuagaaggguaugaaagaaaaagucccaccccucuucuucccagccuguuccccagaugugaccacuguuaacauacuuguguauccuucuagauauauauauuuguauccuuuuaaaaaauuuauacagauaggaucggaguucacauuuuguuuugcauccuacuuuuucacuuguugauaaaccauagaacucuuuucauagcaacacauauagauuuagcauaguguuuuaagugguuacauagcauugaugugcucuaaguuauuuaaccagucuucuguugauagcuauuuggguugcuucuguuuuuuagguauuacaaauaaaaauaaaaaagaacauccugauagauauuuuucugcauaguuaugcaaguaaguccaugggaucaacaucuauccaugaaauggcuaugaauucuaaauuuuuauagguguuucuguauugcuuacuaaaaaagguuaugccacuuuacguacucaucaccaacacaugagaguauguugaccucucccugagugagugaauggccgaaauaacaaaugaacgugcauuaaugacuaccaguugugugguagccuccaugugaugcccuggaaacaaaaagauaaauaaggggcaguggugucuggccauaggaguucacauuuuguuggggaagacagguguauggagggggacgauggauaaggagugguuaggaucaagguuuuggucuuagguggaguugagucuaguuacugacugcugcauacuagcugaguggacaugaguaaaccccuucaccuaagccucugaucauuugaaaaugaggguaauaauaucugcuucacuagauuguuuugaagauuaaauaggaaauuuacauaaagcuuuuaguacaaugccagugcauauaagugcuugaugaugaugaugacgacgaugacuauuccacaugaacuagugauuucaguccuggugcuaaggaucccauugggaugugcccagagugcucugggaacacaagauggagauuucucuuugccuaaagugcaugagaaggcuucagaagggaaguuguaauuaagucuuuaacuuugaauagugguuugccaugagguuguaucagaaggaaacauaccccuuuuaauaagucucucaagaaaguacacuguaaccggaaaccucauuaauauauugaaaaaguuauucucagaagaaauucauugugggcaucugugugaauuuucaaccuuggaaguaacuuaauuuugucuuaucaguauuucugguuuuguuuugaaguacuaaucaaaaaaaaaauccuuaaauuuuaauuucuccuugcuucuuugaaaaguuauaaugguuaaaauacacuacuuaugaaaauuucaaaauauauacuaagcuuucuaaaauguuuuuuaaccuuucuaauucaucuuuuguaaagugcuguucuuugccccauuucuuuccgggaauuuaucuuucucuugguauucauuuauuuuuuuccagguugguaacaauucuuuauauauuaaaagauuaaccauuagucugucauguaugcugcaaauaauuuguauccauuuuuuuuuuuuugagauggagucucgcucuguugcccaggcuggagugcaguggugcgaucucuguucacugcaagcucugccuccuggguucacgccauucuccugccucagccucccgaguagcugagacaacaggcacccgacaccacacccggcuaauuuuuuguauuuuugguagaggcaggguuucaccauguuagccaggauggucuccaucuccugaccucgugauuugcccaccucggccucccaaagugcuaggauuacaggcgugagccaccacgccuggccaauuuguauucauuuuuaaaccuuuuucuuaacuuuuuguauuuugagggcgaggauacagauguuuuaaaauguuauuaguaaaguuuauuaauguuuucuuuuaggauuuuugccuuuggcuuuauuuuuaggaguucuuacuucacuugaguuuauauaaaucaucaucauuuuaucuuaguauuuuguguuuuuaaauauuaaagucuuaauccuuuuugaauuuuuauuugaaucccuauguauacagggagagaaaauaaggguuuuuuuuuuuuuuuuuuuuugacauguauucucucucugucuuccagccuggagugcaguggcacaaucuuggcucacugcaaccucugccuccuggguucaagcaauucuucugccucaaucucccgaguagcugggauuacaggcucccgccauuaugccuggcuaauuuuuguauuuuuagaagagacgggccuucaccauguuggccaagcuggucucgaacuucugaccucaggugaucugcccgccucggccucccaaagugcugggguuacaggcaugagccauugccccuggcugagaauauguuuuauaaagaaauguuagccagguguccgaacacauuuaaugaguaaucuacccuuucccuaccuuuucaugaacaaaauucuuauauauguuuggguguguaucuggauguuuuugucuuuuccaaacuaucuguggaaucugccuauuuuggcacuagugccauaguauuuugaugaauauagauguauaauggcuguucaauggauuuuaauaccuggugggaugaguccugccccauuauucuacuuugaaaaauuuagcugacuauucuaaauuuauuuuuuaagauuaacuguaaaagaauuuuguuaguuucuuuuccaaaauccccuugagagcuugauuggaauuguguugaauuuguagauuaauuugggggaaauggauuucugugcaauauucagucuucuucaggaauauggugugccuccccauuuauuccaggacuuugcuguguuccuuuguaaaugcuuuugcuucuagucauguuguuacugcacugguccuguuaaguauauuguuaaguguauuccggaucaguuuauauuuguuguucuuacaaauagaaauuuguccauuguguuguuaagcugguuauuuuugucauauaggaaagcguaggagcauaggcccaaauuuccaaauggaaacagacguuucugaaguaauuuuaaaguuauuuucuucacaauuuucuuaaguuugauaaaauaaaauauuagaagauauaauuucauaagaaacuugcaucuuugauaacauguuuucaaaacaaaguauucaagacuagguuuuuaaaggcuauuuaugagauggauugaauaguuuucuuaauuuccagcagaugucaguguuuuacaaauuuauuguuaguccacagagacagauuugucuucagucucccaauuucuguauccuuuaguuauuuaauuggcacauaggggauuaucugaauuggaagggauuugaagaucaucuaagucaguuuuucauuuuguagauaagagaacaggccuaggugggaaaugacuuguccgaagucacacaaacagaggagggcuaaaacccagguguucuuguuuccaaaagacuuuuccuuucugaaagacucauccuuucgugguugauacaauaggccaccucccuagugagguuuuccuguguuuaacucccuucucaagggaauacaacuuccuuccuuuguaccuauuaccuuggaacuuacauuauucuaccccuuauuacuauuauuuaauaaucucuuuacagacaacugauuagaugcauuuuuagcugaccagguuguuagguccuagagggcaugaauaguaacuuaucucuguguuaucuguaguuccuugggcagggccuuccauaaagugagucauuaguaaugacuauugauuugaauccauuaaauuuugauucaaacuuuuuucugcucuuuuccuguaaagcuguuuuagaagguuuuagagaggauuauguuuuuuuuuuuuuuuuuuuugagauggagucucgcucugucacccaggcuggagugcaguggcgcaaucuuggcccacugcaaccucugccuccuggguucaagcaauucuccugucucagccucuugaguaacugggauuacaggcacgcgccaccaugcccagcuaauuuuuguauuuuuaguagagacggggguuucaccguguuggucagacuggucucgaacuccugaccucgugaucugucuuggccucccaaagugcugggauuacaggcgugagccacugugcccagccggauuuuggguuuuaagagcaaguuucucccccaccagaagaggacuuauugaagcagauaacaaggcuaguugcagugaaaaggcacuuggaacuaacuggaaaagcacauuauauaaaauccauguacuauuauuucaaaguaauagguuacuuuaucauagacuugcuguaauagaauuuguucuagauggcacaaggcucauauuagcugggcuaugaguccucuuaggcaugcaagaagagagcaagcugaagaaauauaauguacuguguaauuuuauuuuaguuaaauauacugaaccagagagguugcaggacuuucaagugcucauuuaacaguucaguaaaaaaauggugaaagacaggaagaaguuuccauuuuacuaaacucuuaaggcuuggaaaucauacugugcaauaauuaauuaagaauagugggccaggcacgguggcucaugccuguaaucgcagcacuuugggaggccgaggugaguggaucaccugaggaucaggaguucgagaccagccuggccaacaugaugaaaccccaucucuacuaaaaaaauauaaaaauuagcugggcgugguggugcaugccuguaaucccagcuacuugggaggcugaggcaggagaauggcuugaacccgggaggcggagguugcagugagccgagaucgugcuacuguacuccagccugggcaacaagagcgaaacucugucucaaaaaaaaaaaaaaagugacuuugcgagcucaucuucuaaaaacugagaaaaauagaaauagcuccaaaacaccguuguauuucuguaucugaagaaauuguucuucacugcuuuuaagaguaagcuagacuuuuuuuucuugaguacacccucacaugaaugugagcauaggauggacugcccucuagacucuucccuaaaugccuaauuucuuucuuucuuucuuucuuuuuuuguugugguaaggaaacacauaacaaaauuuaccaucuuaaccauuuuaaagguacaguucaggaguguuaaguauauucacauugcugugcaacagaucuccagaauuuuucauauugcauaucugaaaaucuauacccauuaaacaguucuucuuuccccccuuucuucagccucugguaaccaccauucuacuuucugauucuauggguuugacugcuuucaagacuucauuuaauuaggaucauauaauguuuguuuuuuugugugugugacugacuuaauuuauuucuugauugaaucacacagauaaacaagguauuguccuuaaauucucagagucacuaagcuuugauucuaaagagaucugagauauugaaucuauaaauaacuuaaauuuacaagaagaaaacaaacacauuaaaaaaguaggcaaagacaugugcagauacuuuucgaaagaagacauauacauggccaagaagcauaugaaaaaaugcugaaauuuuuucaucauaagagaaauacaagucaaaaccacagugagcuaccaucucauaccagucagaauggcuauugguaaaaagucaaaaaauaacaaaugcuggugagauuguggagaaaagggaacgcuuaugcauugcugguggaaguguaaauuaguucagccauugugggaagcaacgugaugaucccacaaagaacuaaagacagaauuaccauucgacccagcaaucccaguauugagucuauacucaaaggaauauaaaucguucaaccauaaagacacauacucacauauguucauugcaggacuauucauaauagcaaagacauggaaucagccuaaaugcccaucaauaguggacugaauaaagaaaauaugguacauauauacuauagaauauuaugcaguuauaaaaaagagugagaucauguccuuugcggcaacaugguuggagcuggaggguauuauccuaagcaaaccaacagaagaacagaaaaccaaauacugcguguucucacuuauaagugggagcuaaaugaugagaacacauggaagaaagaggggaacagcagacacugaggccuccuugaggauggggagugggagaagggaaaggaucagaaaaaguaccuauuggguacuauacuuaguaccugggugaugaaauaaucuguacaccaaaccccugugacaugaguuuacuuguauaacaaaccugcacauguaccccugaaccuaaaaugaaaguuaauaaaaaaguuauugaaaaguuccauccacccauuuuacagaugaguaaaaucagacaagcagagguugccuacaguuagugaaaaauaauaggaaguucuaaugucuucucuguuucauuuuuagguccaucugauuaucaacaacucagaugccaaauaaauauaauauuuagaaaugccauuuauauuaagcuacugcugauguggauccuauuuucugcagagcauuuuuacauaucugcaguaaagagaguuuaaauuauauuuuuuuccaguaaguuuuauuuuugucaguaucugcuaagauaggauaagcugauguauagauuuuuuuuuguuaaaaaccuuauggcagaagcuguaaaguagggauuggcagggugcuuuuucugcagagggccagauaguaaauaucuggggcuuuguaguccauacagugucuguugcagugauucaauucugcuguuuuagugugaagacagagcauggcuguguccuauugaaacuuuauguacaaaaucauacaguggaccagauuugacuugcaggcuauaguuugcaaaccccagugguaaaguauugggacaccauucccacuuuucagucugcagcaaccuagcuugcuucuuucauauacaauuguaguuguuuauggugauggugaugaugauguugauuaagaaaauaauguaaaucaaauuacuauuaucuguugacaugauuuuagaguuauuuucuagacaacguaguaggcuuaagauauaaaaaacauacuuaagaaaauagcauguuugaaguaccucuucaaaaagaagacuggaaauuuuucugcauauuguuaaaaauauuuuuuucuaaaggaaaauagcuuuguucuuauaaagauaagacauaaagaauaaauuaaaaauaagcccaaaucuccaagccaggaguaaccacugauaauaaccauauuuuggucuuuugcuaggugauuuugguuggccaccucuagauccacugucuaucuuuucuacuugcuuaguggcaaggaagaccagccucuguggacuacaucagcaggcagcaaugaagaccagaggcugcaggguguuaccccucgcccccagugcacauccacacuccagucaggcagccuucucaucgcagcuaugcggguucuuauaaccaugcccuccccagcccuuccccuugcaccuucaggccaaguuguugguacagucagcuaccccagggacuguaccaucucucuugcuuucucuaagcaucuccaucucuuuauuaaucuuuucuaguuucccuaguuugagugugccuucugucccucaccauggcccugaccugacugguacagacgcugcauccaguuugacugauuccaccaccaaggcaaauaagcagcgcucucccugucugcuuuaauuucguagggaaagaacaaagagcuuccacacuucacuagagcuacacuaccauucacauucccaggccugcauuuccuagcuguaugacuuugggcaaauuacaucaucuuguugggaagauuaaauuaagucauguuugcaaagagcuuagcacagugucuagcacacagcugaaugugcugaaagaaauuauaaaagagcaacuucauuuuucuugguuuguaaacagauacaccucaaaggagccuuuuaaagagaaaggcuauuucuaacagaggaaugcuuuccuaucacacguguuucggagacuguauuucagugagccaucacggcuccugcucugccuaaggcuugagcaguuucuuacggaccgcucugcauguuucuagcugacaggagguggcaguagagagcuaggcccacccuugcacaugguuugggcugauaggaaaucugcaugauagcucuuguaguguuaguauuaugacucaagaaauaacuuucagagucaacagaaggaggauaggcauuauucauauccccaaguauaauacagcuagaauuuauugaacacuuacuagaguuuuaucuccuuuauuuagucccucuaaaauagcauuauuuuuaucugaagaagaaauuggguuucaaagagaauuucaguaacuuuacuaauguuucuuagcuaguaaugguuguuaugggauucaaaccugggcagucucuguaaaagccugcacagauaacugcugugcaggacugccuccaaggcucuuguccuugauguuuguguuuaaaaaauauaaggaugauauuuuuuaaaauuugguuccauaugcacaugauaaaaauguaaaccauauagaagaguacuaugaaaguguaaaauagucuucucauccaagucuccuguucuuuaauacuuuguuucagagguagccacucuucuuucguauccuuccugagauauccuuauaggggugaaccuguauuauggguagaaggauugguuucuauaacccauuuuaucuugacuccuggccucuuguccuugauauuuuucuaggcucuuuggauuagguaggaggaaagugcugcugugagaucuucagcagccaagucacuaaauauuauccacauuucuuauuagcuuuuucagcuuuacuuagaagagucuaaauuccugucaccuccugcuuccuucauuuaaacacauaguguucauaagauugagugaaagccuugaacccauaauacacuuggguuuuaaauauaagaugcacacagauugucuuauauucugaauaccucaguaacugauuagcagaaugacccgugucauccagggauacuaggagaagggccaccuuacaugguguugguacuuauuucuaaugcuuuugugacaaauauggucgcuguauucuggugcaaauguuaguaucuguguuaaaagaaagaauuuuauaguaagaaugcagaagugaucaauuaugguggucaugucuuuaauagaugauucucacuacgguguguuugauucagugugaauauucccagauggccaaaauagguugugaccauucauagcagaaagagugaagguauguuuacaauguaauuuuuaaaaauuaacagucuauaauaauagguggcucaguuaacuccuccuuaaguauguuauagauuugcagggaaccauguuuuuuaaaaacccaauuuuuguauauaaucagaaguugaauauauuuuauuacugcagucauguaaaugguuuuguuuauugccuuguaugugcuguacuguuuuauaugaagagugauucaaggagguugugcuucagucuguucuuucuaaggcaaucauaaugaguucaaaacauaugguauugauuuuugacaguucugccucaagagcuaucaugaauuauugguucuguauuuuauuuuaggauuucagcuucuucauguuuuagaagcauguuugauggaaguaccugugucucucuguaaucagccacguggccugaggaguaggcaugcagcaguugauuaaguugacauuugguauuaauagcuuagagacucuuuacaucauaauaugcuuauccauucuagauuuuaggugaagguaauuuugaugauguuucauagcuaauaagugguagugcuggauucagacccaggcagccugucuagaauccuacacacuuaaccccucuccuguacuaccucuaagaugcuuggccuuguuguguuuccuccauaccuuuacuuaaucucauuuguaucuuuugguaauaggaaccauguauauuauccaucuggaacagcaagcccucagcuucaccucuuaugagcugagucucuuaugaguugaaugacuuuagggaguaauuugaccucucugagcaucaguuuauucuuuugugaaauggggauaauaguucccacccuccugccucccuagguagauguacugaccagcugguuuuauucauccuucucuuuccaggauauggcaucuuggcugacacaucguaggcgcuuuacaaauguuaguuucugugcucuccuucucuucuagaagcaggacuuugguuaagaguuagguaucucacaggauaaucugaacaagucacuccuuggauauagucaggaagcuaaaauaaauacagcaaggggacuacucauuauaucccuuauauccuucacugucauucuuuuuuucacgguaaacagaacugagcucaaauucucuggggaaagacaaaagcucuguuccuagaaggaagggagaaggauuccuacuacuuaauggaccacaggcauucuuacaguauaggauaagagcuggucacaccaaacugcauggacugggaggacucaauggaaguuuaagauuugugauauuaugauuguuaugauaaauaaguuaacaaaaagaguagaaaacccuuacaggaaugaaaaacaaugucgcaggagcaaaggugugcagauaggaaggugcccacauaccucuugggcucuaacacuuauuuucagccuucuuuucaguauuacaguaaagacaguccacuagcugaacugauuauauucugaaaagcucaggacagggagucugaguucaggacaucuuaggaggugucaggggcccaggcuaccucgcugccagaauuaauaagaauguuuuguacggugaacugaauccucagagccuaauacuucugucucaggaaguagaggcauuuauagaaucuuacuucuucauuuuuuuucgaggccuacuaccuaggcuuuuuuccuggucaacgaagauucugcagcucagcaucuguccccaucucuccacuuauauuauccuugccccggugauucccuaguugccaaaucuaauagauauuuuuguguccuuaccuuacuuguccauucugccacauuugacacugcgucuacuucucucucccugaaacucucuuuccuuauguucuaugauggggguuaucacauugcagccccacaggccaaaucuggcccuccaccuguuuuuguaaauaacauguuaucaggacacagccacacucauucauuuacauuugucuuuggcugcuuucauacuacacagcagaguuauguucuaacagagacccuaaggccugcaaagccuaaauuauuuacucucuggucuuuuguaggaaaaaugugcuaaucugcauucuauaaccucauucuccccugguuuucuuccucuuuuuuuggcucugcugaaccccuuugcugagagaacauguaagagccaguucuaagguaagauuguaaaagcucuggucaaaaaauacuugaaauauuggagaaacuauaccccuuucccugcuaccugguucaagaaauagugccugagauuucuuuuuaaaaaaauagaaagguauccuaauaaauacaauuguugugaacagauauguugcauuaucuaauacaguuuucaugaccagcuccauuuuacggaugagaaaacaaauggaagcacagagauugcaguagcuuuccuaugaucacacagcuaagaaauagccugagggcccaugccccuaaucaccacaucagacugccuccagagggcacugcuguuucagagccagcaccaaaugaaaagacggaagauguuuuugagcaaauaaaugcaguaugugggguugggugaguuuuccaaagguuagcuuuguaguuuuggaaugcaagaucacauuggaaagguagcgaagccuggagaaaaacacucaacaaaccaugacucugcagaacaaucuuaugacaucuagagagcucugugcccacuaacacagaaugugaagcaagugcacacaggauuaaaaucagagcagguuggcucuugcacauugcacugucaguggacgcuauuaaugagucuuuggcgauuugaaaacagagcaaugccagaggcauaugcagaacugugcacggacuaagguuuuucuucugucuccccuauugaauucugaccuuguggugugugaaggugucucuggugucuaccucuauuagugggaccagugugugugagggaagcuuguugagccucugcaugauuuuuaagccccacugagcugucaccuuugaggaggaaaaacauccagcauaguguucccaaagugugaggagccccagggguguguguggggugggugaugcauguggggauggugguaaggcacaggaagagcuucaaggaugacaacaaauaaagucaagcaaagaauacaugauguguuucagggaaaacacuuggauuuaacaaguagcagaagugggagaagacuaggaaguauaucuuaaggaccugaggccaggagcaaccugugauccccgugguugaagggagcagcaggaacaguucugugggcagggcuacaacaacaacaccgcauguacgauguaaggaccuccaccuaggaagggcuguuuccgagccuuaguuaccugggaauccaaaaccauucucgucuugcuucucaaguguaaaacucauuuugaaaaagcagccauacaaaguuauauuuuuauuauuuuauuuuauuuuuuugccucuuugagccaaauuuauguacuucggaauuauuaaaauagaggaugucaugcuaggauugauccauucugcaggcaaaauauucauuuuucaggguuucuuuggccuaaaauucuauuaaaauccaaggaugaaagaggaauuggaaaaauuauggcccucaaagaaauuuucuguccagugagggagacagagacguguaccaucaacugugguacaagguagacuucagugagagcugugaucaaaguacagggaguaacaagaaaagagggaguagauuaacucucgcucaagggauuugagaacguuguuuucuuaucucuguuucauuucuucauucuuuuccuccaacuaccuaaauguggauguuccaaacuucugccuuuucuuucuuguguauuguaucuggugggaauccugacuauucucuuggcuucucuuuuggucucuuugcuuuuuuaaauuuuuuauugugguaaauaacauauaaugugagaucuacccuccuaaaaguuguaagugucugggaaaguauuguuaacuguaagcacaguuguacagcagaucucuagaacuuuuucaucuuccaugaaugaaacucuguauccauugaauggcaacucucugucucccccuuucuccugcgccugguaaccaucauucuacauucuguuccuaagauuuugacuacucuagauaccacauguaaguggcaucauaaaguauuugucuuuuuguggcugacuuauuucacuuggcauaauaucuuccaggcuuauccauggguugcauauugcagaauuuccuucuuugauauggcugaauaauauucauugaauguauguaccacauuugguuuguucguucauccaucgaugcauacuuguuuccauaucuuggcacuugggaauaauggugcaaugaacgugggagugcaaauaucucuuuaagacccugacuucaauccuuuuggauaaauacccagaagugggauugcugggccauaugguaguucuacuuuuaauuuguugaggaacccauauacucuuuucuuuaauggcugcauuauuuuacacccccaccagcaguguacaaggguucugauuucuccacauccuugccaacauuugugguuuucuauuuuuuggauauuggacauccucaugaauguggggugguauuucauugaaguuuugauuuguauuucccugaugaucagugauguugaguauauuuucauaugccuguuggccauuuguaugucuucuuuggacaaaugucuguuuaagucuuuuuuuuuuuuuuuuuuuuugagacggagucucacucugucgcccaggcuggagugcaguggcgcaauagcuccaccucccggguucacaccauucuccugucucagccucccgaguagcugggacuacaggcgcccuccaccaugccuggcuaauauuuuguauuuuuaguagagacgggauuucaccauguuagccaggaugaucucugucuucugaccucaugauccgcccgccucugccucccaaagugcugggauugcaagcaugagccaccgugcccauccuguuuaagucuuuugcccaguuuuuaauuggguuauuugguuuuuugcuguuguguucuagggggucucugugccuuugaccccaaaucuccaugccuguaccuggugaacucuacacucaugucuucugcuacuccucagguugauccuucuguccaagcgaguaaacugcuccccacucccuacucccucacucagcucuugccaccuuucuuuugguuucugaaagauacuuagacccaacucugacacaucuuaaaaauccaggucaaguugaguuuuccaugaauucuucccugaccacccagcguuugcucucccccugcuggggucucuaguauuugucccuguugcuuuuggggcauuuggcagagacugcugccgugcauuggaauggaaauuacaugcgguuauauuuuguacuaacugaacugccauuucaugaagggaagagacuguguguccuccagaggaccuuacagagcaccuugccauacuguaaagaggcaggaauccuuagaaagguuugcgcauuguguguucuagguauagaagacagaacugaacuucaagccugauggugcucuggcaacagaaagaggacacgagggaguaaaguccaaauucacaguccacugucaaucccaagagggacaaaugagcuggacaggaacagggaggaaagacagaggucagugaccaggaccuuuuuagaaaguugggauuggaauagacaaggagguuuacaggggaaggucauuacuguaaucugaggcaugcuuugcuggauuuuggcaggcaggggugaccagguguaugcugggagcuagagagaagcugaguucaccucacaguucugcagguagucagaauaucugcugauagugggggcuagccauguuggcagucugauccucucuacucugaacaugcuguucuggagaauucauggcuuccaacccugguauaucuugccagcaaaugcuauaugaaugguuauuccacaacuaagcuauaggucacccagaaacccccaggacagcugucaggaggccaagacucaguauaaggaggcuacagggcagacuacuggguuugacauguaauguggcucuuaugcugacacugguaccccauguuucuugccagaggcuggaguaccauucccucauggagguucuucaccuagugaccuucauugccaucuucaugggaauccccacacacccuuacugcaguuggguuuuuauagccuccaggacccugccucccacccugagcuccagcauucuguccugauaaugucauagccaguucuggucuucguguuacuugagaggguuguagccagagaacuaguuguggguccccaucuuguaccuuuccuugaguaggucaaagccugcucucacacgagucuggggaagcccggcagccuggccuugccucuccaaugggaggggaaaugaggagggaguaggcugucugaacugcuugguaugccugacaguggacucucuuucugcucacugacccugagaaacagcuuuguccuuuauggcuccuccuugacuguuucccgcccuccaacugucauuauccugggguauugauuuccaaaccugacagguauggagaaucaccaggaugcuagaaaaaagagggcccuaucucuggagauucucuguauuuaacuaguuaugaaugaggccugggaaucuggcacuuuuguacagauauauguaaaagaucuguugaggaugaauaagagacuuaacuaaguugcugaguacguuuuauuuccuuuuuuguccaacucugugcuuuuuggauauuaauggucacacauuguuuuuagaaaucagagaaagaauugaugucauuacaaaacaaaaaacacauccugaaaugaucuuucagaaacaauuaauccucuuaaauuuguuccucuuuuccgcagggggacuugaucucaucuucaugccaggccuuggguuugacaaacauggcaaccgacuggggaggggcaagggcuacuaugaugccuaucugaagcgcuguuugcagcaucaggaagugaagcccuacacccuggcguuggcuuucaaagaacagauuugccuccaggucccagugaaugaaaacgacaugaagguagaugaaguccuuuacgaagacucgucaacagcuuaaaucuggauuacuacagccaaauaaucaguguuuuauaugagaguaaagcaaaguauguguauuuuucccuugucaaaaauuaguugaaauuguucauuaaugugaauacagacugcauuuuaaaauuguaauuaugaaauaccuuauauaaaaccaucuuuaaaaaccaauagaagugugaauaguagaauauuaauuaaaauggaggcuaucagccugugauuuucagcuuaacuuccugguguuaaugugacaaguugaucugucuacuuugcaauuuaaguuaaauauuuaugaggaacugugcuccgacugagugcgagaggaagguaaacuugcgggagugggcacuguauuucauuacgccuuucaugaccuggucuguccuggcaggcacauggagacuuggggacuauuaauuuauuuguugguauuugcuuuggauacagaauucccuaagaauauuaucucacuucaucaugacuuccuuuacccacucuagaauuuuauguuggacacuuuguagcuuuuggugguuaguggagggaaaccuuuuaugauuuaaauacuuuuacuccacugauugguuaccaucacugcauguaucagcccuugaugaguuuaagaucuaguaucuuauaaguuagaaauuauuucuguuuacucaugguuucugcuuuggaaaugaaauuugcugugaguugaaaguuggcagauggcaacacagcuagggagcaauaauuuuguuguggggaggauuuggucaucuccagaaacccgggagucacguggcucucuuacucacacuccauguccauccugucaccaggucuuguugauuuugccucugaaaugccucuuaaaucuauucucuccuuucaauuuuccugucacuccuuuuguccagccuuuuagcauuucuaagcuggacuaggcgagagugucacaccugcuucccuuggcuuccaucuugccucuuccaguuuauuucucaagcugcagucaaacugaucuuagaaaacacgaaucuaaucaugcagcaccccugacuaaggucuuccgguggcuguucagagccucuuggguagcaaacagauggcuucuguuguauacaaagccccuuaagagaggucuccucaucuacuuuuucuagccucuucucucccaacucuguauucuccuguaacacugacugagcacugcaggcuucugcccuuugcacauaguaagcaugcauuucucucugucugaaaugcucuuucuguuguucaucuagaagacuguuuucccuugaagacucagcccuagcaucaccucuucugugaagucuucugcuacuuucccaagcagagugaguguuccuucccuugucugaguggccuuggccauugaugugcuuaucauguugucuuacguaucaaauuauuuguugucauaucuguccccuucaccauacugugagcuccaaagaaaagaagugaucuuuauacuucuuaugcuuaguacacaacuagacauauagugugugugugagagagagaauuuuuuaaugaaauaauugaauacauuggaaguguuucauucaaaauacucauccauuauucuuuggauaguagcauaaauuugauguuuuauguacaaaaguaaaaacauuugaaaaauaucaggcugaauauggguuuguacaauauaauauguaugaugaggaaagggaaggaaacugaauucucagaagcuaugaagucacauuauuguacugguuaaaaauauuguuaaguauuauuucgacuauaagguuaaagugaauguuaauguagcugacaugacuguuggugugaaaugguagagcaguaaaauuccugaccugcugcaggucuagaaaguuuggcauuguugaacuuagucuauguuauucuucuguuaaaugagagcauuuaaaaaccacucuaccagcuccucaagugcagacagaaugccgaguuaacuggccagaaaaugcagggugcugagauucaggaaagucagagggccacaggaucucggccugaaaagagaagcacucccuagugaucacuaaugcacaguagucuuugugcagggauauuggaagggagaaaaugccccuaugauguaggugauuacaacacuguaacucugauuagggcauacacagaggcugaagacaaggccuuagacucaggaggcaagcacuucaguagaggcuaacaugaagcaagaaugaugagcgucucagaugaggggacaaucugaguagaagagaaauagcaacuagaucugcacaaaaacaauuucaaauauugggaaauuggaaauauaucagggccccaacauaggucuguguuugcuguauguacuauagaacugugcuuaauuuaauuagaaaguaaacuauauaaaguucuagucaagagcauuauacacuuaaucacaaagucuuacuaacuaggagauugauaaaugugacuaggcgugagugucuugcugcagacaguuccuggucccaauuuuuuuuuuuuuuuccugcagagaucauugaaauucaguugaucacacugcucuuuagucauauguuuacaugcuuaauuucuccacuacccuacaaucuccucaaaggcaaauucucugccaaguucauaguuuauuccaguaucuaccacagacacaaaaaauaaagagccaauaaauucuuuuuuuaguuguuccagcaacauuuauugaauauguaacuuuaugucuguuauagauuaaguucuccaauauaugugaaucuguuugcuggcuuacuucauugucccuuuguuauguuuuucugucucagcaccagccccacauugcuuuaguucucauaguuuuaagucuugauggcuaugaggguaagccuccuuccuaauucuucuucaggaaugccuaagagccaaucaauucuugaugaaggaaugaaccaguuugaauauugcccug

SEQ ID NO: 16078 - RNA, 11759 nt, Homo sapiens
cgcggcugcgcacugagccgccggcccucccggaagcgcagagcuccgcuggugccacgucuauccccuuacauccuccuaggacccggucgguagucgucgccccagcccgccgggggcgcagcgcccgagccgcggcccucgagacgggaccgagagcaucaugggcagcacugucccgcgcuccgccuccgugcugcuucugcugcugcuccugcgccgggccgagcagcccugcggggccgagcucaccuucgagcugccggacaacgccaagcagugcuuccacgaggagguggagcagggcgugaaguucucccuggauuaccaggugaggccgggcgcccggcagcgcucccuucucccuccacucccaggucucaccuggacacuggcuagccccugacuggaggcgcucgaauuagccacaggcuacagggaggcugcauggggugggaguccccggagaccaguugacuuccccgugaggaggaagguuugggucaucagggcccacccgagacgagccuggccagcgaggagguagucagcgccgcaggugcgagcccgggauggggacgccagggcggaucccgcagccuggggagcuggccaaagagauauccgcaggcccccgagacacuaaccaacggcaguucugaucggcuggacacaggcucucuaaccccagucucuuagaccaccuugugccuucgaguacugaaaaauggcagcaagaggaagugggcucauaguuuuaguuuauuccuccccucuccagcguuuaaaguuggagugaggugagggcagcagaagugagaaugggcacuuuggaaaggagggaucagugcagccauugaggccuggcgguguuuacaaggagcgguguggcugcaagacuuggcucuugccauauggcuuagaaaagcucaguuccuguauuccugucuccuuugagagaucccguggcccacaggugacaggagcaggucuugagugaguagucugccccgauauuuagugagcaggucuaggguugggggccaagugggcaucauacucagacagcuaucugcuuguggacgcaugcugauaggcacuucagaaaugaggggccacgggcagcaggaaugggggcaagcuauuugaccaguuccucugugguuagaggcacugaaggaagcuugcgcuuggagacaacuucuaugugguagucucagucacugauuuguccacuuucaggucuuuguggacaacaugcaaauugugacuggguuaacaugggcaaccuaggugcaaugacaaaaagaaugauaauucugugguugcagggaccucagaugucaucuggucacugccagggcggaaaucccuugucaaaguguguccagccuggguuuaaacacacuuagcaacaggauacucacugcuuuuugcaaagcuugcugagcaggacuaguaacuuuuguccggacaaagaggccauuuaaauuuggaagcagauggaggccauugaccguguccuuugauggaucuugguuauagccauugccuaccugugagauuuugcuuuaugugggucuuauuuuucuuauguuacaaggagaguuugaacuaaaugauucccaaagacucuuccaccgcugacacucagaaauuccaugaauacuucgaucaauauuuuucuucuccuugcauucagucauuaauaauauauuguuaauagcuacuugacccauucagcaagccaagaaugacccuugcugguggggggagggggaacaccugucuguuauuggaacggagaagcaggaggugcagcaugcaugcucuaggguggcccccaaaucagaucccacaucuccacugcaaccccaggggguuaguuugcagucugacgauuguccaguaauuggcuggcacuuuuggggcccuugcuaaauuuauguuggacaccgugcuaaacacuuuaggugugauaacuuauugacuccucacuucauggauaaagacauauccucagagaauaaaguaacuugucuagggucacauggcuaaugaguggcagugcccuaaaucagugauuugcugugugucuuguguuaaguauugaacaaagauaaagaaucgguggcaucuaguugcauuggaauaguuucuuggacaucccuccucaucuugcucuugauuucgggaagcuuuaucagcaccaucucaggaagagcaguuauccugggguauguucauucaugcuucagaauagugcaauagguaaauguuuaggcacuggaaccaaaagcucucaaggcagaucucaucucaccacuuucucuuguguaaccuuagggaauuuacuuaaccuuggaaccucaguuucuucuucuguaaaauggaaaggauuaggcucauugaaacccugcagagcaaacuugggagucaggcaggcauagauucaaaucuuagcccuuucacuuucaagcagugugaccacagccaauuuauuuaaccuugcucagccuuaguaaaaugagaaguggcguagcaccugccuuagaaaguuuugaagaugaagugacagaaauguuuguagagucugaucacagugucugguuggcauuugguaaguggugguugcuccuuugauaacagcaauuuuuuuaugguugucaggucaucacuggaggccacuacgauguugacugcuauguggaggacccccaggggaacaccaucuacagagaaacgaagaagcaguacgacagcuucacguaccgggcugaagucaagggcguuuaucaguuuugcuucaguaaugaguuuuccaccuucucucacaagaccgucuacuuugacuuucaagugggcgaugagccucccauucucccagacauggggaacagggucacagcucucacccaggugagugaacauuagcaguucggggcugcugaacccccuagcguguuccucuucauuggccucugucuaggcugguggugggagucaucauccauccagcucccagucuggaagucucaggguugguuuugucucuuucuucauaccuaguccuaaaggaugccaugcucuucuuucgaucuuccuuuccacucucuaaccaggucccugcaguacuuuccucugacauuccugucucuacucuuucauucccacucagucuuuugcacaguaccacuuucgaaguaccugugucaugugucucugcuuauaugaugugccuguaucauaaagaccaaaguccuacuuugugugguguauuaguuaagguaacacaaggugcuguaacaaaauaaacaccaaacaucaauggcuuaacagaauagaaguuuauucucaugcauaaucuagaaaagguugguggggagcuuuccuccauggugugacucaggaauccaggcucauucuuucuugucaucuuucugucuucccuuagggcuucagggucuucugccuguagcugccaaaggaagagagaaugagaaaagcccaucuacuucuuaaaagcccaggcccagugggaauacguaucaccugcucaugucccaugggugagaacuuagucauguggcaaagcuggaugaaaggaaggcuggcaaguagagccuuagcaacagcuccacacuauggaggagaaacggugacauuuuggggggauagucaugucugucgcccauggcugucaagguucauuauucucugaucccauccuccuucgucugucuucccuucugcuauuuaagccccuccuucccuuucauaugcaggcugggggcuuccugagggcuaggacccugaaugauuuacuuuuguauccucagugcuucagugcauaagguagggcacaggaaggagcucaccaaauacuugugaaaugacugucagggcccagggaaaccuguaagacaggaauaaccaucgauagcagcacgugugccagaaccaaagccacagcgucuugaacuuucaaggaggccagaugaucuucugggccgccuuccaagguggcauccuuccucuguggcucugggcacacucacgagugccuguggauucauuugcccagucuuccaccuucccuaagcaguuggaggcuagagcugcacuguucaguacaguagccagugucuaaauuuggcuauuuaaauuaauuaaaauuaaauuaaaaauucacuuccucaucugcaccauagcaauacuccagguacucaauagucacagguggcuaguggccaugcauagaaaguuccauuguccaaaacuggguuugaucuuugggcuuuuggcaacaugacuucuguuagaagauccagccgaggguguguauuguguguaagaucuuuugcaaccgauacucaugagaguucuguuggccacuguugagacagccucuauugggaagauucuguaagucuccaaaagcugagcugaagaacuucccccuuaaccaguagaaaacaaauugguaggaaaagccuuaaagaauuaggucaacagagacauucuuuccuggagccugagcaguaguuugauuuuguugcaggaaagagugauuuaugcuucccuuuucuuauaucuuagaaccucuucuuugcuccugcuuagccucaaaagagccguuuccuuccacuucucuuaccccgccaccuugaaccaucugugccugccuuugagaguacuugcuuuuaugccagaauucacucagucuacacauugugccagccguggauggcucugugccugguacugggcacccugcaaggagcgcagcccugcaagccaguuggcuauggggcacuguggucagagcuguaauugaagcgccaggagucuugaggaggcacugaugaauucuuccaggagucaggaaggcuucacuugaaaauguagaagcuuggccuucuaggugaagagaacaggugagauuuauggaguguaacuuucauucuucucgccagcgcuuuuuaucuugcuuggcaugggucccccuuuacccagcagcugcugucucgccucuccccagacuucuugcagcacaguggugagccagaggccaugguuucuggcaagaaaguaaguauuaggugaaagaacagguuccauagugaccagggcccaggccagggauucagguccaaaggacuuguuucaggccggaguucaggaaaaccaggcuccuaggagaggaccugggccaggagaaugcgacuucaggaaagccaagcucgaggggcuuccaggcuuccugagaaucugggaagauccuggucagagcugaagguuucugacagaggucaaaggccaagagcuaccucccuggugaucuaggaaggauuaaagguuuucuuaagugcucugaugccagcuucuacuucccugucuuugaguucuugaagaauuugaagaagcagauacuugggucaggggaggccugaugaggugagggcugcaggaauuugucagugguuacagacugaagaccucggcauccgcugguggcugggacaggaugggaugucagcguggagauggaggaaagggauggugccagaggugggaugggucaggguguccuagagaccgacagucaccaugaaguggcaacuauaaucccugugaggcuccaggacacuggaagccagccaggacugguggucuuagcagggcggaaggucacacacgaggagaccuggggacucguggccuggaaaaacaggacccugaaaacagagggguucuguugguuuucugcugggugggaagcuggcugagggacugccuaacugaaauuuugugguaacaggcugaacaaguuugcuuuagaugagcacuaacugaagaucucagcggauggggaaguagcauguuuuuguggugagggugagcauccagguagcugugauucuuggggaugauucucggggauguauugcucuggggucucuugcagcgucugugcaagguccugaaggcgucugcagguguuaguugccaagaaagcuguagaguaucaccuguugcuccguuacccucuuggaacuggucccuuugcuaucacugaucugaucugagauuguuccuuuaaaggccacgaggccucuucaugcagucuccgugccgguuucuggccugugucgcuggaucuaggccuuuaaagugaugcuucacauaaauaucugacucauccucugucuuggugucuacaccugugauuucuguguccucccucuucuuuuucccuuccuccuuccucuccagugacucuggguccugggagaaggcuggagaugcugaccaguacugcugaauucccaggccagggccuacgguccaaggaguccccagucaagugagucuaguuguacacuuuguuucugaaugaguuugugacacauaaacuuggagaauggaauuauagccuggaaaaucaaaugagcccuuccacaguguucucugcggauuuguacauacaaacauguaugcauauguguacauaugaauacauaugugugugugccacacauacauauacacauauacuaccuaugaccaugauacauacauguauacacuuaugugugugucuccaucccucccacugauuucaagaaugauccacuuuguuaugaaguccugugauuucagugccaucaauuucccuccaguccacucuucccugacauggcgaccuucuuaaccgaggccugcaucuucucuucccaguagaauugcagccaccuaagugguuucccugccucuaaacugguucgcauacaucccuuucugcaucauagcugccagaggcagauucucguaaagugggauuccgaucuugccaaucuucugcucacagagccacacgauaaagucuuggaccucgaggcccuuuacugugagcuuccaccuccccacagcugcuucuccacgcauccccaucaccaugucagucccugaucccagaccaggcccuguacaguucuuugccugugcuucugcugcuugggauguguucucagccuggugacguccugcccauccaucagggcucagcuugucgugucccaugucaaguacuccaucuucucuggcaggcucagcaucuuucuccugggguguuccugccgcucugcauacccuucuguuguuggcuguuuauacugcauucuaguugaguaauuuuuucuuuaaauugggaacuuucugagacccaggacugugucuggcucugauucuuaauucccugggccuagcacagugccuggaaggaaaguaagcauugaguaaauguuugaaugaaggaauuaguggaagugugagcuauucaaacucagccaugauuugaaauccuuguaaccucauccuacaagugucuauccugagucccccagccccaccuucaauccuuugugauuuuccagggaucaccagggugauguaaauacagaacggauuuguguuaccaagucugccuguauagguagugccuggcagggagcacuagggaggcuucuagaaauggcauaucuugaguuagcuuugacacagguucacauagguuaagcccgacuccacauugaccucuuuccugcuuccuucccaguuuaguguccuguuccaucugugacagcugacaugcuuuagugagcuuuggaagcauuccccggagagcuaggaggagcaaccacaaaugcgaccauuguccccagugcagaggccuacaccugagcuuucuuuucuggugguuggccuuugaagccaguuggcuuuggaaguucccuuuggagucaacuuccugaugucuggaacccuucuuaggaucauuuguuccuuuuucaauaucaaaugucugcagguauagcccaccuaccaaaugcagggaagugaagaaguccaaugcugacuacacuccaguugugaaagaugauauguagcccaaaauaauagaggauagaggaugucacugagaaaacaggacagagguacucaugggggacaaauaggcuuguucuucacuugcuauugcuccuugagcugguguacccagucuaacucuaucaguuccaucugauacacagugaucaugccaccuuucuacgugugacauuucaccacuucuuacacauggaccuggaugagagggccagccacugugugcaggagagucccauagccuugggagguagaccuguugccagaaagagggaagcugcugcccuguaaugcagaggcagaagggaagcuuuuguucuuccuuacauagucuaguucagcuccuagaauggcccagaauuaaggauacccaaugaggcaaguaaggguaacaccauuguuuggcagugguuuccuguuugucuucuggaagugguuuaaugugagagagaaacaaggguuuuggggagguguaggguccagccccacaggguggauggguuuucucccuauguguggagacgagagauuguagaaauaaagacauaagacaaagagauuaaaaagaagacagcugggcccaggggaccacuaccaccaagacgcagagacugguaguggccccgaaugccaggcugcgcugauacuuauuggauacaagacaaaggggcaggcuaaggagugugagccaucuccaaugauugguaaggucacguguccacuggacagggggcccuucccugccuggcagccaaggcagagagagagagagaagagagagagacagcuuaugccauuauuucugcauaucagagacuuuuaguacuuucacuaauuugcuacugcuaucuaaaagcccagguacacaggauggaacaugaaagaagacuaggagugugaccacugaagcacagcaucacagggagacaguuagguccccggauaacugcgggugggccugacugaugucaggcccuccacaagagguggaggaguagagucuucucugaacuccacugggaaaagggagucccccuuucccagucugcuaaguagcggguguuuuuccuugacacugacgcuaccgcuagaccacaguccacuuggcaaugggcgucuucccagacacuggcauuaccgcuagaccaaggagcccucuggcggcccuguccaggcauaacagaaggcucgcacucuugucuucuggucacuucucacuauguccccucagcuccuaucucuguguggccugguuuuuccuagguuaugauuguagagcaaggauuauuauaauauuggaauaaagaguaauugccacaaacuaaugauuaaugauauucauauauaauccuaucuaugaucuauaucuaguaucacuauucuuauuuuauauauuuuauuauacuggaacagcucgugcccucggucucuugccucggcaccuggguggcuugccgcccacaggaagggaggucacagagugacuuggucuuuucuaguuuauuguacuguacuuuacaaauaguuugccuuuggaguuugggaacugaagugagugucuggugcaugcuuugugaauuccucuagccugagaacucacugauaggauagaauuuucuaggucuuggauacauggugguuuagaggcugccucugaauaagaacucaacguuuucccacaggcauaauguguugucuauugcugaguaacuaauuacuacaaacauagugucuuaaugcaauacucacuuauuaccgcacagcucuguaugcugugagccugggcagguuggccagauucuuuggggucucccaagccugaugucgaggugguggcagguugggcuccuaccuggaagcucuggggaaggaucugcuuucaugcucauucagguuguugguggaguucaguucuuugugguuguaggacugagguccccauuuccuugcugacuguuguacccucaacgccuggaggccuuuuucugguccuggcaaguggucaccuccaccuucaaagccaguguggcacauugaauuuuucucaugcuucagaacugucuugacuucuucugcaacuagcuggagaaagcuccuggcgucugagggcuccugugaugggaucaggccugaauaaccuccccaucuucaggucagcugugucauauuaacgugaugcagucacagaggugacagcucaucauauucacagcuuucuggaauuagggcgggggaccuuggugguggugggaaggacauuuucagacuucugccuaccacacugaauauuuuugcagguaaagaaaguuaugauguaguauguguuacacaugagcguaugugucuauguagugccuguuuauauauaugugucuuugcaugugugugcaugugcuuacauacaugaagcgugugucuucauguguuuguguuuauacauaaaacuauaggcagcaauuacauaauagaaugagcaugagcaguggauucagaguccaaacacaacuguggucuaguucacacuuugcuguuuauuaguuguaugacuuugggcaauucguguagccucuuggagccucaguuuccucaucugugugugggauaagcccucguuaacagugaggguaaugauccgugccuaucaggaguauuguaaggauugaauaagagaguauagggcagugcuugaaagcauaggcucaggacucagacucuaacucagccacauacuaacugugugacucugggcaaguuacuuaaccucucugagcuucaauuaggcuuguugugaggauuaaauaaaaccacguaaaacccuuagcacagacucuuaguuagcauucaguggauaucaccuaggauguugacaacagcauuugcuguuugcuggaucccacauuugucuauggguuagcagugugacugcuuuucucuuccugcccagauggaguccgccugcgugaccauccaugaggcucugaaaacggugauugacucccagacgcauuaccggcugcgggaggcccaggaccgggcccgagcagaagaccuuaauagccgagucucuuacuggucuguuggcgagacgauugcccuguucguggucagcuucagucaggugcuacuguugaaaagcuucuucacagaaaaacgacccaucagcagggcaguccacuccuagccccggcauccugcucuagggccccucaugccccaggcuggagcagcucuccuaggucacagccugcugggcugggucgcguagcccaggguggaggcagaacgaugcugcugugguagcccuuugccuuucaugcccaugcuugauucuugcaccucagcagcugaaggucucagagaccaguaaucagaaggcauccgacugcauuaagugugcagcgcugaaaagacauuuacaacuaggccagggauuagccacugugggaggguggacaggcaaugguucaguggccuggcuguuggcaggaacuccaagugcccaggccucuugggcagcuuagggcccugccucuguuucaugaugcaugggucauuugucuuggguguccuaucccauauggagaagaaaggggcucuaaguucuggcucuucuuucuuugggguucucuguaccugaggaaaccaggcccugggugacuuugcagaucugcucacccucggugagcaacagugucagccaugcaagcaggacagaauggugacugggugcccuuggugagcuguguauuuccuaggagguagaaaacugugggaaacuguggcuaauaaaaacuaagugugagcguccugga

SEQ ID NO: 16079 - RNA, 76922 nt, Homo sapiens
cgugcggagcgaaggggcggugcggaggggguagggggcgcagcggccgcggcgcggaggcgcagggcgcgggcgccuacgguuggcgcgcgguagcgaugccgggggccggagcccgggcggaggagggcggcggcggcggcgagggcgcggcgcagggggcggccgcggagcccggggcggguccggcgcgggagccagcgcggcuguguggcuaucugcagaagcugucgggcaagggcccccugcguggcuaccgcagccgcugguucguguucgacgcgcgccgcugcuaccuuuacuauuucaagaguccgcaggacgcgcugccccucggccacuuggacaucgcggacgccugcuucagcuaccagggccccgacgaggcggcggagccgggcacggagccgcccgcgcacuuccaggugcacagcgcgggagccgucacggugcucaaggugggaccgcucgccccaaagccgcccgcgcgcuuccgccggcguccccugccuccgccacuggcuugcgccauccacccuccuuccuccaaggccuccucgccccugcccacgucggccugccuuucccugcuucuccacaucccgcccucguuccuaucuccuccccacuaucugggcuuaggccagucucgcuggggcuaccaagccccgucuccuuucucagacaccuugacccauuaucucccucugcgccuaaccucgggccagucucuggugucucccgacccccaccaucccguggauguccugugcagccuucccaggcauccgugagcguaggcuucuaccccuggggccuccuuuagaacuuugccuauggccuugguaccucagugaaccgcucugggcugcagcggccuccucuguaaaaugggauaacaguaguaucuaccucaugggguguugggauuaaaugaauuauacuuuaaacugcucaguaaaugucagugcuuuuauuuauuuguuuauuuauucuuuuugagacaggaucuuguucuguuguccaggcuggagugcaggggugcgaucucggcucacugcagccuccaugccugggcucaagagauccucccaccucagccucccaaguagcugggaccacaggugcgggccaccacgccuggcuaauuaaauuuuuuuuuuuuuuuaaagaaacgggggucucacuauguugcccaggcuagucucgaacuccugggccgaaaccauccuccccauccagcuucccaaagugcugggaugccaggcgugagccagagugcauuuagcacuguagacagaaagagucagauggcagggcccuuagagacaguccacuacauuuuccuccagaguggacggggaugcuccagcuaaggucacacagccaguagguggcagauccuguguucuuccuccuugcuuuguccaggaugggugggagggggucuuuucagccaguuaugccuugcuccuuugaggcucccuuaauccuccaguggacagacaaaaugagagauacaguguagaagcaggagaguagagucaggaguccuggugcugaaaggccuccccuguccuugggaguucugggggacuagacugucaccuccuaggggcccaccugcuuugagcaucuggagggaucugggcccaggccuggagcuggguauccuuuuuccaggcuuugcucccugccugguuucugugagucuccacccucacucucacuccucuuccguauuccagguugggcuuucuccagagcaacaggguugggcugggauguaugaaagugcucucaaagcuggccacacggagagcagacuaggcaaacuccuggccuugugagcugaggacuguuccucagacccccagagcugcuaacagcuggagcugcucccuggagauguucuuagagcuuugcugacucagcuuuugccaguucaagcaggaucugauucccauguucucuugggcuccccuguccugucuguaagugggugcagacagccuguuuccccaaagaaaaccaacucggguugcaguccuacacaggcuuacuuagagagugccuguauaaacuugguaaugacccuagugggagaccuuugccaaaggcagaggcucuuccucaguguacauacgggcugucccugugucggacgaauuuccugugggauguuuguuaaagaaaauagagcaucguguuucacauuuuucccagaugacuguagaacucuaucaguuuuuuucauuaaaauaaucugaaucuccuguaaucccagcacuuugggaggccgagacggguggaucacgaggucaggagcucgagaccauccuggcuaacacggugacaccccaugucuauuaaauauacaaaaaauuagccaggcaugguggcgggugccuguagucccaguuauucgggaggcugaggcaggagaauggcgugaacccgggaggaagagcuugcagugagcagagaucgcgccacugcacucagccugggugacagagugagacuccaucucaaaaaaaauuaaaaaaaaaauaauaaauaagaaucuacauaagcaggguuacaaggcgcauugucagaaguguggcuuuaaacuucgauggacuugaacuugaagcaggagucugcugcucacacauauuggacaaauuacaccaguucccugcuccaguuuccucuuuggucuagugggaaucauaccuuccucauuagguggcugugaggauucuggagaauguuauggaaaauggcuggcgcauuuuccauagugguauggaaaauaguaggcacuacauggcauaugaaacaucaagcagugucuuuggccaaauauguaguguauucauauaguggaauauuaugcaguaguaaacaaagguacuagagcuauaggugucaacguggauuacucucacaaacaauaaaauugaacaagaaguaaguuacacacugauuguguucagaaugauaccacuuauagaaagguuaggaagaucaugugaaacaguacuacagaucauaaggauguaugcucuuucgcgaggggaagagcuuuauggggcugaugagcucugguuuccagguagugguugccugugaugggaagagggaggaugugauugggaaugggugccucagggcuucuccuguuuugcaguguuuuauuucuuggacugggucauagguauaucaguguuuguccuauuaugcuauccaucuuuuuguagguucagaauauuucuuuuuuuaaagaaaggaaauacauuuuccuuuggguuacugacaauggaggaauauuuugacauguaaaauuaaauuggucacagaauaagauaguaccgaguguuggcuguauacaacaaugggaauggaaaucaggcaaggcuuucuggaagaagggaggagaaggccgggcgugguggcucaugccuguaaucccagcacuuugggaggccgaggcgaguggaucacuugaggucaggaguucgagaccagccuggccaauauggugaaaccccaucucuacuaaaaauacaaaaauuggcugggcaugguggcgcacgcuguagucccagcugcucgcgaggcugaggcaggagaauugcaugaacccgggaggcggagguugcagugagccgagaucacaccacugcacuccagccugagcgacagagugagacuccaccuuaaaaacaaacaaacaaacaaacaaacaagcaaaaaacaccccgacucuaaaacccugcucccuuuuuuuuuuugaaacagagucuugcugugucgcccaggcuggagugcaguggcacagucucugcuaacugcaaccucuggcucccggguucaagcaauucuccugccucagccuuccgagcugagggacuauaggcgcgugccaccgcucccagcuaauuuuuguauuuuuaguagagacgggguuucaccauauuggccaggcuggucucgaacuccugaccucgugauccaccugccucugccucucaaagugcugggguuacagauaugagccaccgcacccagccaggcguguguuuuaagaaaauuaaauuucauuguacaguuauuucuuuugagcuguaggaguaaaaucuuuaugguguaaguauggaaauuaccaauuuaucuuccuuuucgucuuucaaaugcaagaacugauucccuuaagccuuaauguuucacuuuagggcugcccagccauagaggagacccugauuucuaaggauuuuaaguuaggauuuagcccugcucagacuucagcuagugguauauaauuuuacaaauaccauuucuuaucacagaggguuaaaaaguaaagaaaaaucagcacuuuucuuauucuauuaucauauguuuuucuuauuuaaaagugucuuucagcucucucuggagaagcugugguuuuguugggcuuuuucaaaauguuuuucuauguaagucuuaaugaaagcugauauaggaauuucuugggaaacuccucuauucccaaacuuagggauuugaucuggugccuuaugagguaauagaggcuagagaggggaugugauuuugccaacaucaugaagcuagacucagacccucucugaaaguagaggcuccaggaauagugaaugucuaaaauguguaguaucuaauuguauugucuguucugacaagucugcuuuuuuuugacuuuguuggggaucggauaaggcguaguaguagucuuuccuucuauugcauuuaauaucuguccuuuuuggauaguggguaucacaagggaacauuuuacugcccaguucuuuaccaggaugccuaguaccuuuugcuggacaugucuggaaacugcugcaagggucuagcagaggcugaugcuuccugugugcgucucucucuguguguaggggugcuggaggcuucucacagagcuuuacuggaaucugaggcacuuaggggaaggagagcaugugacugaccgagggugaagcuuaaacagccuugaucuuccagaucucugcagacuuuggagcaagagagcgucaucagaccgucagcaaaugaauuccucccuccguaggugcuuggugcuaaauagacauguguacugguuucugagccacacguaacugaauagcuguguaccccuauucuuaaccacuuuugugggaaugcacauucccugguguugaaauuucucuuaaugacaaacauuugucggcuuggguaaucauauuguuuucagugcaaaauagauguggugaaccagccuccuuugcuguuugguucuucuaagcuguucugcccuagggcaucugcucagucuugaagcauuauuuaacucuuuaaguuaugggaauuuaacuuuucauggcuuuccaauuaguaaguuccuucaaggcaaguccaguauugugcuugugauaucacaguggcauuccgucucccucucccacugccucacacaguccucauugcaggggagucuccauccuauuuccugcuaaccagaggguaagcucccuaaggacuguguguauccucagcuccugcaacaguaucuggcacaaaggagacaugcuauaaacuaguguuuguguuccugaaaaauucguauguugaagugccagcucccagugugaugauauuuagagguggggccuuugggagguaauuaacucaugaggguggagccuucacgaaugggauuagugccuuuauaaaaagagacccuggagagaugaucuccccuuccaccuaugaggauacagcaaaaaggcauuccuuugcaaaccaggaagagggcccccgccaggaaccaaauugaccagcaccuugauuuuggacauuccagccuucagaacugaguaaauuucuguuguuuaagccacuuagucugugguguuuuuguuauaacagccugaaccgacuaagguaaggugcccagguagacauuuguugcaugaaugaauagaaaauggucacccaguaagcacugguuuuggugugagcccugacccuuuagaagugaucagccagaacucccaaauauacagguguauuacaugccauucuugccucaugucauggagguggcagccauucagugaaugcccacugaauuuaacagacaucaggaauccaaaaggggguuaugacucacccuuccccagaggagagagcuuacagucaguuccauauuuucgggucucauauauuucaugcccauggucaggacuccaaggacacuguuauagcagaggcaaacuuuuuauguaaagggccacauacuauuuuagguuuugcgcacucugccauaucugucacuaugcuguuguaguacagaaacaaccacagaaugaguauagcuguguuuuaacuuuuaguuauggacucugaaauuuggauuucauauaauuuucacauuucgcaaaauauucuuuugauuuuuuucaaccauuuaaaaauguuagcugggcacaguggcucacuccuguaaucccagcacuuugggaggccgaaaugggaggaucacuugauaccaauaguucgagaccagccuaggcaacaaagugagacccuaucccuacaaaaauuaaaaaaaacuagccagguguggcuggaugugguggcucacgccuguaaucccagcacuuugggaagccgagguggguggaucacuugaggucaggaguuugagaccagccugaccagcauggugagacccugucucuacuaaaaauacaaaauuagcugggugugguggcggaugccuguaaucccagcugcuugggaggcugaggcaggagaauugcuugaacccaggaaacagagguugcagcaagcugagguggcgccauugcacuccagccugggcgacaagagcgaaacucugucucaaaacaaaaaacaaacuagccaggcaugauggcacaugucuuuagucccagcuacuugggaggcugaggcaggaggacugcuugaucccaggagguggacauugcagugagcuguguuugcuccacuguacuccagccugggugacagagggagacccuguuucaaaaaaauaaaauagcaaaauaaaaauguuaaaacugcccuugccuuguagauuguacagaaauaggcagagacuggaaaugaccgcaggcuguaguucacugacuuguguucuaggaaggccucaggagcuucccacucauucacucacugugugugcuuaggcacuggggauaugacuggacaagacaaacagucccuguccuccuggagcuuucaguaggugggggggacagacguuaauaaaauauaacaaacaccaaccagugcuaggaaguuugaaaggaaagauaugcaaugcauguauaguucaggaucuugaucugguuuaugguugguggagggcuaggaaagacuuuccugaagaagcgacauuugagcugagacucaaaggaugaguugguguugacuggagcggggguggggguggagaggaggaagucaaguguuguagggagaggaaauggcauaagcagaggcccuuaggugggggugcugguugcaugugggacucaaggagugccugguggcaacuaggagugaaggggacauagccuuuggaagaggcaggccuugggccagggcaggauuuuggucuucaucuuaagagcuagagucaguaaagaguuuuaagcaggguuugacaaauagguuuuuguuuucuuucuucugcucccagauagauuguuuuaggccauuugugcugcugugaaaaaauaccguagacaggguagcuuauaaacaacagaaauuuauuucucauaguucuggaggcugggaagcccaagaugaaggcaccagcagauuuggugucuggugagggcucacucugcuuuagagguggugccuucuagugguguccucauagcagaaggggacagacaaguuccuucuggggccuccaucuauguauguuuguauauauguauguauguaucuaucuaucuaaauguauuuuucuccucaaauuccuuuuaccacucuggccucuuucauaaggacccugaucucauuccagagggcucugcccucaugacuuaaaucacuucccacaaggcuucccucuuaguacuaucaucuuggggacugggucucaacacgugaauuuugcggggacacacguuuggacuguggcacugaugguuuggucaugccuaguauuuuuauguaacuaaguuagaggauuaucguguuggguacaaaggguugauguauuuauauguuauguacuggcaaacagauuuaaaaguagauaaaugcaaagcugaaccuaucuugagcaguugcuucuuaauuuuguuucugagugguggguguugugaugggugaagcucgcuuuggcagguguguguguggcuagggccggcccgcccugguggacuuccuuuccugaagcauuccuaauggcccccggcauugacuucucuccugcugcacuugcuuugcucauaugcacauuaccaguuuccuuccucuguggagaugacgauuucuugagaaauggaaggaguauucagauguaccagcucccaccucacgucugagggggguggaccagucuccucgaucaguugcuuuuaccuuugagccacuggggugcagacuucccaccuccagucagaacaaaauacaaacaguaacacccccuuccucuaaagaaagaaaaagacccccaccauuguagaagugacugucaguuugggagagggagaggcauuuucauuagcaauuuucgguucugguauuuauguagugggaucuuaaugacaugugaucggguguucacccauauccugucaggccagcccucagcuggguuuuguuugcuuucacagagugaaugcaauguggaaaugguaaacuggguaguggugacuaguuaguggcuuguaacuaguguucugugaaguacuuugccuggagugcucaguucaguaaacaucuuggcauucagauaugugaggccaugugaggggcaagaagcugagaggaucccuggggagacuguggcuuucgugauuguccagcaggcaguagcucaccagccagcacaggaggcccucagucggcuacagauucaggaugguuuugcuccuggucuagucuuugagugucugcuguuguguccuaccagagcaucaccuccuaggauauuuugucaguguauuucacuacugugccuuucauacuuagaggaucccagcaccuguuagaugcuuguuggcuaaaugcaugcuuuaagcccucauauccucuguguguguguguguguguguguguguguguguguguggguguggugugugugcuuucauuucauggugaaacggacguuuguaguguccauuuacucagcaaauauuuuugagcaucuaucauauucuaagcacuaugcugcuugcugcaaauacagcagugaaaauuuuccauugauuuaagaaacuguaguguuaacuuuaaaaauagcuuagcaucugauauaaucaaagaauuguaagaguuuugaaaaaaacauugaagaggcccauguuugucuguaguauucagcacugagauaaauaucacaugucugcaaguuuuuugauucugagaagucuggcacuucuccauaguaaaggaaggggagggggcauccauauguaaaauacuaaucuggauauggcccagggccagaaaucugugauuuguguaauaauuuuggugaacacugcagaauuggagaguucuguauaacugauuaucaagaaagcucccugaagaagaugggacaagggaguuaguaaauguugguauaauuguguagcugcucaaagacuuaguuccuguuugaucagcaacauguguucccuguaagcugggaaucaccaucuucuaaugaguuugcaugcuuggccauuuucuuagccuuugcagagauugccugggagaacuagaauccagugugagaaguggggauuugguagcugagauccugugugcuucuucuuucugccccuuuccuaggccagugcuacuguaccagcagacuuuccuugagcagacugccccugggcugggacuuguguugcugagugucagauggcaggccuggccguggccuggaggugggcaggcuaauguuaucagagauguugaucuuggauuauaggaauuauuucuaggcagcaagcccaguauucauuuuccucuccagcucucugguguucaggagaggcugugcuugcagagaagguggccagcuuucuaaauggaugcagccaacuggccauucaccaaacagacuuuguugagcaggagucaagcuuugccucuggccucagggagcuucugugucuguuuugggugugauuagggcauugucaauagguggcucugggagcuggaggaaggcauucauuauuuuugcucaagggucauuaucccaaaguuagaacuggagaggcccucagagaucagcccccuucccaugugugauacagagaggaaacugagucccacagcuagcuacccuaccacugaaaccuucuccuucuccaaacacaugaacgauauuuuaccauuuuaaacccagcaguuugaugauacuugcuuuauauaucugucguaauccauuaguagaaaauugggcuuauucuuuuuuuaguaguuguauauggagacucaaauuguaccuuuaaccauuuuguguuggggcacagauuuaagaaguuuagucacauggagguuggaaauuaacagcauagguuauaaacuuccaguggggguugacuugauaggaggcaucagugauguuucccuggcagagauugaggccuggugcaucccuuuugagagggcuucucuuuggagguggcuuugguuuucucuuugguucgucaaaggaaaacaggcaguuggcagauggcuguaucuuuucauucugcucuguaaggcauacccucuggccuuagaagugaaccacuuuuuauacuguuuacacagcucucuuguauauacuguuguagagguaacaugcugauaagacuuuuuuuguuucugucuuuuaaaggaaaauaucucccucagaaccgcaguucuuaaauuuuguguggaaaagacuccuccuggguucuguuaaaaugcagauugugggguucguccccuggagauucugcuuuaguuggcaggccagagugggccucaggaaucugccuuucuuuccagcaucccagcccuucugcugcagaucucuguggcuucccugugaaacacugcucuccucccgaugaugaauguucucuuuggcugugaagaaaagacugacccuguaugaugguggcuuucuaaguggacuagaaauaacuaaacugcuugggugaagaccagugaagugugagcccuccauccucggguugacucucugugguuuauagcugcauaucuucuuugcauucugaguuucuaugcugcagaggaguggcuuuuggcccaauucuccauuggccccaagguuucuguccccuuugcugaucaugguggcuggcagacccuacgugcuaggguuccuuccugagcauucagagggaggcuccaggagggaacaguguucacuuggcaucuuucgguauuucugggagggugaauugcaaugaucaccaccaccaaagagcugguaaguacuuucagaucccucagcuuuucaccagagagaaguggguaacaaugauauaggacgaccaucugauacuccugagacaccaacuccaccuuaaaacacuguuagaaaucaccgugguucccaaacauuccuguaaauucacugaaagacuaggcggguuccugguaccuggcuccacugccucccaaaucucugguggguggagccugggaaccugucccaacuccguuuccuaaaacuucauguuaagucagucauucuuuugcccuaguuuuaguugaaaaacaucaagcagaauaaugugguauugcauaguguguggaagccaaugugggcagagguggagcaagaccauccaauaggcuacaggcuguggcugcaggaguuguuauuuauccugagcucauccuuggcucucucacauugugcaauggcagagcugagagggaaccauaggaauguagcccuguggucacuuggaggccucgugcucccuuucucucugaaacagaaaguauuuugacaggcuucuacauuuccuguagggacgagcauguccggagaguggccuuguccuugcccuugucuugaugaaaucuguggcucagcccagcuggguggccugggcugugagaggcuuugauguggccagaucccucacaagcccaguuguuuucauugcccacuuuccagugaacucacauuugcucuucuuuguucuaguuguaggcccuauucuucuaguccauuacccuuaguugcuaaucucuguuaaaugguauuugcuuaaaaauguauuugcugaauauggguuuaagaaauggcuuuucucucaagguguuugcuuuuuaaaaggggugcuugaguguuagagauggcagaacuccucagaccaccaccuaccagaauggaugaugaauguggcaucuucccagggaaugacugcccaccucaacacagacucuuccgggaaauugauuauggguucuaggugugugcucagccuuugaaaggggcuagauuagaacuauuuuaauaagauacaauuauuuuguaagacauaugaaugcuaauuuuaagauagcaauuuuaaaagauacgaaaggagaauuuguuauguucaguagaggaauggagguuugugaccuuguauuccauuuuccaaggagccaggagauccaguauuugccuucuuagucucuguugcugggcugaaacagaagauuucaaaaccuuccuggggaaaaaaauacauuuuuuuuuuccauuggugcugggccagaucccuugagauuguuuccaggcucaugauuuugaaacacucaggaaaaaauuuggaaccuagaguuauuuaucagauucgggguuagagucuguuuuccauuugaauuuuguuuuguauuaccaggcugcuuacaauauucuugugcuuuuuauugcuuauggaagaaauuacuuuagacauuucuuagagauccaaauaucuuccuugaguuuaagaaacaaaaauuccuucauuaugagcagccaucgcauucuuuucagaaauggauacccaaaauuauccauguaauuuaaauugcuuucuagaagguaugcagacuugaccuauucuguauauauauuuuccuuccuguggcuccuucgugauuguugguuauguuguucuuuuggcuaauaaacaugguaggaccugacccuuugggaaggaacccagaguucauaacccuaagugggugauugagauggugugcgucacauagagcguguuggaggaaugaucguuugguuguauaagggauguuggcuggccuuacagaugagauguuugaacugggucuugagugagugggaauuuguuagggagguguuagugcaguaggagcagagauugugaaggcuuuugugggccuuuugugugggagaaagguuauaguucuguggaguguggggcagugugggccagauuucuugacacuuggaagccaugagagaguuuuaagcaugcgacauauaugacuucauuggcuuggugucagaagagaguuuggagaggagagacugagacagcaaguccaguuaggaagcuguugcagaggcccagggguagaugaaucuggagacccagaggcccagggguagaugaaucuggagacccagaggcccagggguagaugacucugagacugucaggaugcaugaaucugagagacugacaagggaguccuuaggaauaggagaccuggcgauucuauuauaucagacuggagaaguuucuguccucuccauauuugcuugugugugguguuguuauugcucacagcagucuauuuuugagaaacacccuuagagcagaguugugauuaagaguggaaccauguuggccaucauagacugauggucaugcccucucccagugacacuaugcugaccccucuagauuuaauguccagaggaccuucucuacugauguggggaccagcaucugauauaguuuuauuugucccugaagccaaccuagaggcuuuuauuugaacuuugcuauugauugaggccaucagcauuucaauauuugagaaaaaccauagaggaacuugugauuucugcuaaaaugcugagaggauugauuuugucuuggacaugcucucucauccuuccccuugauagcaaguaaugcagacucagguuugaguuuugacugugccaaguggcuaugagauuuuggguaaacaugauaauauagguaguugauacacagugaguacuuugugccaaauacucuucugagcuuaacagauguuaaguggguuaucauggguaaacaugauaauauagacaguugauacacgaguacuuugugccaaauacucuucugagcuuaacacauguuaaguggguuaucgguaaacaugauaauauagauaguugauaccuaaugaguacuuugugccaaacacccuuuugagcuuaacacauguuaacuaauuaauuuucaauaccaugaaguagguuccuauuauuauuauuucaauuuuaccagcaaggaauccgaggcccagacaauuuauguaacauaccuaacauagccagccaguagcagagcugggauuugaaccuugguaguuaggcuccaggguccaugggcaagcagaugauacuguuuggggagaguuaguuacgaggguuaaaugacaguguguauaaagcgaaagcauagugucuggcacacaguaauuguuuaauugauggugucuaauauaauaugcaaauauauauuauggaagagucuauauaauuuuaauacaguuuuauaaagaaaauugguuuucuaccaauuggcuagaaaauugguagaaaauauauggguagagaauuuucuauacauuuauggguagaaagauguuuggaaauaccaaaguauugauggagguuauuucuggugaugcagcuauguucauuuuauuuucuucuuugcuuuccuguguuuuccaaauucuccucagcagauguagauuguuauuauuugaaauauaagucuaaaauauguuguuguuuuuuaaaacuaaagauuaaugggaucucaccagacaaacaggacuucccacaguccaggaagagugaagagcccugcaaagcuauaguggugugaaacucuacaccaugcuuagugacuuugaaguuguuuggucuuuuuucaguucgucauugucuauuaauuuauuuguaguguuuuagacacauauuuucuuugcuuugcuuucuuuguggguuuagaaagcccuuuaccuuccaagagaauagaaauguuaggacagcaguuucuugugcugcuggggagacuaaucagcccucuuauaaucagugacucccugcugccuggagacggcuugcaggguugcccgugggagaagcagcuccggggcuuacaguuugaagugucuguccuucuagcuuucaguuuugggcucggucuugacagaguguuuuguuuuccucgucuagugcaucauggugcacauggcauucauuuucugcauagagucuuguggcugcuguuuauacuucaguuuuagcuaaaccuucccgugugaauuucugcugugccacauugcuugauuuaaguccugucaucccuuccauaccuuuauaauuugguggaaaucuauacaacuguuguuguaagaggcagaaagagacaggaacuuaauuuuaauuauacaggcuuuuuuuuucuaauuuaaugguuuuuauuaaauuuauuaaauucauucauuuaaugguuuuuauuaaauucauuaguuuauuaaaucaugaauugaauuugaaauuauuuucucugaugauagguuucucacccagggcaucacuuauuuuuuuuccagguauuugaccaguuguccuaaugcuauuauauauaauauauauauaaauuauauauauauuuuuggagacagggucucgcucugucacccagccuggaguacagugguacaguuauggcucacugcagcuucaaccuccugggcucaagaaauucucccacgucagccuucugaguagcugggacuacaggcaugcaccaccacaccuggcuaauuuuuguacuuuuuguagagaggggauuucaccauguuggccaggcuggucuugaacuccucgguucaagcgaucugccugccucugccucccaaagugcugggauuauaggugucagccacugugccuggccuauuauuauuauauuuuuaagagacagggucuuuuguuuuguuuuugauauggaguuuugcucuuguugccuagguuggagugcaauggcacaaucuuggcucacuguaaucucugccucccagguuuaaaugauucuccugccucagccucccaaguagcugggauuacaggagugugccaccacaccugguaaauuuauauuucuaauagagacgagguuuuaccauauugcccaggcugaucuugaacuccggggcucaagcaaucugccugccucugucucccguagugcugggauuacaggcaugagccacugugccuggccuauuauuauuauauuuuaaagagacagggucuucugauuucauuuugagacagaguuucacuguuguugcccaggcuggagugcaguggcgcgaucucggcucacugcaaccuccgcuuccuggguguaaacgauucuccugucucggccucccgaguagcugggauuacaggagugugccaccacaccuggcuaauuuugguauuuuuaauagagacgagguuucaccauguuggccaggcuggucucgaacuucugacuucaggugaucugccugucucggccucccaaagugcugggauuacaggagugagccacagugcccaaccaagagauaggucuugcucugucgcccaggcuggguacagaucucggcucacugcaaacucugucuccugggcucaagggaucaucuaacuucagccuccugaguagcugguacuacaagcacacgccaccaugccuggcuaauuuuuuuuuuuuuuuuuuguagugaugugguuucaccauguugcucaggcuggucucaaacuccugagcccaagugauucacccaccugggccucccaaagggcuaagauuacuggcaugagccacugcgccuggccucuggauuucuuaauuggauaccuaggcauuuuauguugauuguaauuauaaacuuguuucccacuguuuauuguuggcauaaaggaaaauguuugcuugcggugaauaucucagagguaggaauuaaccagaucucauccaguucuguauucuuagugcuaacuacuggacuuggcccaaguuaggcucuuaauaaacauuuguuaagcaaaugaacacuuuauguacaugguguugucccuuuuuccucuuuuggacuacuuuagcuacauucccaggaauagaauugugggucaaagaaugugaacauuaguauagcuucuaaaaugugguaaauuuugauagguggacauuguuuacuaaagggaauaaaagcuuagauaaacuuguuguuuaguggagaugaugaggcccgacucccuguagaugcugcuggguugcuacuccagccccuguccucacaaucauguacuuccugcugagagugggcccauaauauacguguauugaaaucaguuaacuuguaaucaaacaacuuuauugugggacuugucuaagcaucaaguugagagcuggugggaggcugaggggagucucuggggcccaagaggaggaacagguggccagggccugucucacacaagagugggcuucuggguuuugagcuacuggagaccuggggacagcagcuugugggagcagcuggggcaucacaugguacuucucagccagcugucaaggacugcauucccaccucaagcagaauguggauggcuugcuuuuauucuccgagcuggugccucaugucuuggcccccaaaggcagcagauggcuguccuguagaauugugcccacccaauccuugucugccccucucccucacccaggacguucaugcagccauguaggagacaacuacaauggcuuuccaagauguucagcuuggucucauauugggauuggugccauauuugaccugggauuucagcaguauugaggaaguagcaacaauugaacaugagaggaugagucagauauuugaguguuuauauucaggacacugugcaagacaucuuggaucguauugagaccagcaggucuggucucugccuuuaaggaacuuggguuagugaggaacacacagggagugcccucaccuccaugggaggguuaccugggcuacaagauucucugagcucccuauucagagaauggagacaaaauguacacccagaucagggaaaccugcucugaagagguggccuuugcauuggaucuugaagggugaguaggaaggagcugaggagacugguguuaggggagacaaaaugcacacccaggucagggaaaccugcucugaagagguggccuuugcauuggaccuugaagggugaggaggaaggagcuggagagacggguguuaggggagacucaggagcuggccuagguaaggcaucagacagcacacaccagcaccuggcuucuugcugggugcuugccuggcaucggcucccaauucucugcugaucuguggagcucugccuugucacuguuucuucuagcaugaguggaaugccugucuggcucuccagaacuugggaccacagcauuuuggucauucugagggguggggggcagauggugauccuucccgguccucacuccuccggcgggcgugucuuuggugaaugcugugugguccuggccguuagcuucugcgcugacuggcucauugucaccagcugagcugaggcucagcggagggaacuccuggugauagaccuagcaaggcguugucugugcagccagaucacucaaagguccuacucgccccacuuuuggagcacugaauaaaggcacuauagcuggggccagaccagcagaugccuggguuccuaaagaauguuggccucuccuuggacauuaauggaccauggggugguuggagauauggaggcgccuguuuaaagagagaaguuaucuugaguuguaaagugcuguagaagggcaaugguguuggcugccccacacccccguggaccccaugcccuuggcuuauguuauaauccugagguacuguuuccugccaagccagaucucccaccaaccuuggcucucaaaauggaauauauuugccauuguaguguagaccagcacuguucaguaaagauaagaugugagccacauaauauacuuuuaaauuuucaaugagccacauuaaaccaguaaaauuaauuuuaauacuaucguauuuauucaguguauccaaaagauuuuauguggcacuggccaucucucaugugcucaguagucacgucuggcuagggcuacuguguugguacagggcagaucugaaccaauuuccugggacuggggcgauaaagaggcugguuugugauuauacauuuaauuaggccugagccgaaucuccauuuaguccuuugcuaaaagauaccagauaaaaaacgcagaggcuuuuuggauuucugcugauuuugcuguguuguacuuuuaguggugcucagucuuagaaccuguguguguuucugucuuuggguuucagcugucuucagaaaaggcccuuuggggcuuuucugucaaagcacaugccccagagccauuucagacagucuggcccccagccuuuuacuagcuaauuggggauugaagucaaaagucuucuagugaucucuagauuuuuuuuuuucuuugagacagagucucacugucgcccaggcuggagugcaguggcaccgugucggcucacugcaaccuccguuuccuggguucaagcaguucuccugccucagccucccaaguagcugggauuacgggcacccaccaccacgccuggcuaauuuuuaaaaauacuuuuaguagagacgggguuucaccauguuggcuaggcuggucucgaacuccugaccucaggugauccgccugccucggccucccaaagugcugagauuacaggugugagccgccauagcagccuguuuagguuuuuuuuuugaaaggaaacaaacccaguuaaucagugucuugauuaacugacuuguuaaccagauuuugcccaucuuauugaccaaauuucuacaauaugauaaaauaucagucauugaaagcaugugaucuaaaaguuuugccucaggaauuuagugagagaugacucagagguuacugauuguuucccaguuacauuuaauacucaaagauuuaaagugaaaaggauuucuuguaaaaagcagauuuuucauggugccugcauugucagaggcagcuggagagguugguucagauaugcccuagugaguaugugccagcuucucuagcagccuguggcucccgagcauaaauagaaacacagcugcauaugcaggcugaacaagaggaagugucugggcaccucccuggcuggagcagaaggcucccagggugcuuagcucaccuguggcauggggauggaggggccagguagucagggagcuggugggaggaccacacacgcacauucccccacccaaacacacacuugccucuaaggguuggggguuuggcagacugggcucacaguauugacucccuguaugaccuagacaagucacuucccuuucugggccucuguccccucaucugcaaaaaaaaaaaaaaaaaaaaaaaaaaaaaaagaggaggacugggugggcuuugggcucugaauuuggcucugguugugucucucaguuccugacuugccuagugacucuucucucccuuccuguggaaaugcuugugugcucuuugccccgccccagggccaggcugagcuccugugucugcacugcaaccagccugccucccaaacuccaggcugcaauucauggaucucccaagugggcucacggccucuggccugaacuaaucuccuccuaugcaaacugugcaccugccuuucccucaccaccauuuucaccagcaguaccuuugucuaauaaugucagugcccugcuaaguuccccauuccaucucuuuaggaaggcacacaagucccuucagggccagguccuugccacucacugaccucaccucacuccugcucucugaccuuuguucuuuuguagacacuucucucucucccuggaaucucuuuuccucuggccacugccugcuuccccuuuaagaccaaguucuccuguaucauuuucugauuauucauucauucacuuauuccuucauauauguauucaguaaauacugaccuacuaugugccugacacugagcuagaugcuagagaaauggagacaacuuggaguuuguuucuuggagaagauagacauuaaaccuauacuuugaagcuuuugaaccugccuauggcagguguccugaacuuugaguaccuuguccuuugcugcaccuccccucuuuggcuauguguccuuccccagugcucuccagucacgccagccccgcgucgccugcucugcuuucugucauagcacuuaaugcaacauggaaacuacugguuguuuuuuccugucuuucucacuaggccaggccccaggucuggguaccugauaggugcucagcaaauguugguuaaaugaauggaugaaauggcaacuuggcugguauaguuggaagaacuuucuguaaaauacccaaagauccuguaaugaaaauacccaaagauccuuuucuuuaacuggggccaggugugcaaguaucacuaaaaagacccagguuguggucacagcacccacagguuauccuuugcuuggagguaguaguaguuuggucuagggcuaucucuugcugucaggccugcagagccauuuucuucacugccucugaucuuggcaaccacugugucugaugucugcacaugucacuggaugccaguguugaugaaguucccauaaucgugucauggcagcuuuccuucuucuugggacuccuuugcugggggcagccuggagaccuugacccauaccugcagucuaguuuauuuauauuuagguucauuguucuggguccucucccccaucuugguugauuuuuuuuuuaaugauauucacucuuuguguauauaauucugugauuuuggacaaauguguagaaucaugacuuuacccagaaccaugauacauagcaguucugucacccacaaauucuugugcugccgcuuuguagucagcugcuccccucccugccaagcccuggcaaccacauauuuguuuucuguccugacaauuuugccuucucaggguguuacauaaguggcaucauacaguauauaaccauuugggucaggcuucuuucacuuggcaauaugcauuuaauauuuauccauguaguaggaaucaauagugugcuccuuuuuauugcuaaauaguauauuauuguauagauguaccaguuuuuuuuaauccuuucuccagacaaaguucucauuuuuuuuggcaauuaugaauaaaaccucuauaaacauucacauacaggucuuugugugaauauguuuucauuccucuuggguggauauguagggaugggcuugccagguuacuugguaaguguauguuuaacuuuauaaggaauugcuaaacuguuuucuaaaguagcugcaccauguugcauuccaccugcagcuuaugaaaguacuagcugcccugcacccuugucagcacuuggcauugucaacuuuuugaaauauuagccauuuuaauaggagugccagcucguuuuuaaucugcaguuuucuuuguauacucucagaugcugauggaguuuaaauaucauuauuugaugugauuuggcaaggccgucuuucauaccuaugucagauuuuauuuuugaagauggaauuuguaguugcucagaguaaaagagcagcaguauuaucacaucuuccuaaacgguuuugaggaaaauguuauacugcauuauucuuuaauuucagaauuuaaaaagacuucuuguuaauuggguucaguucuucauguuacaauugcuauuugcuugaccaacucaucaugagcaaaagcuacuaaucuuguaacugaaguuuccuugaucuguucaucuuaacucucacauggcaagcugaacagucuacucaugagacauaauauuuuuuaagcucuucauauuacugguggccauaacauguuuuuccccucccucuuucuaggcucccaaucgucaacucaugacuuacugguuacaggagcuucagcagaagagaugggaauauuguaacagucuugacauggucaagugggacagcaggaccucuccaacucccggggauuuuccuaagggucuuguagccagagauaacacugguaaggcagaaauaaaggggagcugggucaguucuuuguguaagccauucgauaccacauaugaacuuagcagugaaugaaaaugaauuuagaaagaaaauaauaaugaugcuaccuuaugaguggacagcauuccacaguuacccagcgccuccauguacaaagcuuaugcaagcccagugacagccuuggaaucaggcaaggccagugccaagcauauggaagauacgacuaaggucagcaugugguaaguuguggugcuguaagucuaguucugacugcagggccagccuuucuacuacaccuaaugaugaagcacucaugccuagauagucaugcuugggcagacuugccaagauugacagguguuuguauacacuaggaagguauucucagaucauuccacuuguaauucucuaguguuucuuaggaagacuuuaaccuucaaacauugauuucauucuauccuggauucauggcauuucuguaacucaggguaaucccuggccauuugcagcauggagauaaccucuagaaagaacagaacaacaauuauuugcugcccauccuaccccauugcaaagacuguggagaugggacuguuuuuuggcccccacucuucauacagggaaaauaacacauccagaaaaacaaacaaacaaacaaaacagccuccugagcucugaaguaaggucuaaaaagcccaggccauuguauuaguauuuuuggaagacacacggagcguacauuaaaaggaguagacaacaguaaggacuaguucuaacaguuucauaaagagauuucuucacuuccuaaaacccgugggacccucugcucagcagaacacagggcugcauccgaguugccugucccaccaaggaugguguuggcacguguggcugauuuacuccagaaacaaaggcauucuuagaugaauuuuucgucuccaaauuugucagucuuguuuuuacuugucccaguauuuuucagcagguuaacccucuuaucagugauaaauuacuauauaugcuuuguaccuauuaauauguuuucugugagaguuuuugagucacuuucacgacugucuuagcgcucugacuauuccagguucugagaucaugccuuuauuuucaacuuuaugcgcccuuauguuucguucagagucgagucacuguuaacugaguuguuuugaaagccacucuuauagugcuuuucacucaaaaggagcuccuaacugagugucucagucacuuggaacauuuggaaacccugugggaacaggcaggguucaugagcauagccagugccuuuggcacaggaggugcuugauuugccucaguuccuuuguucugagggcaccaagugcuucuuucuagcaaagacucagggauauuaaaccgaaaggaggacaaagaaguagugccuagcccuauagucucuuuauaacagcuguccuuccuccuucuaagccaaaaugcugugauuggagagccagagaaaacaucugaagcccauauuuguuucuccuccuuugauauggggacuccagguauggaauuuagcauuugaguaaaugccaccugacauuuacucauucauucagcaaagucggcacucaagaugagcuuugucccucuccucacagaauuucuagucaagcagggugguugugcagagaaaaaaugagagaaaugugagggaagggugcaugcugguaccaugggcuguaagugggcugugcauaguuucuggcaguuagggccucucugaggaagugcaucuaagccaaggccuggaggauggccaggaacuagcuagguagagaggaggggagucagaugacagggcugaacugcagugccuucccagagcugcagucaggauggcuacuggcuggaagcaguuguggggagugagcugaaccugggggcacaccugggacccagagccagagcugggggagagccuagacugcuggucuugggauuuuggacuuuaaccuaagagcaguggagugccuuugaagauuuuauagauagaaaugacuguaacauuagacuucuauuaauuuuuagauagcuucgaagaacaaggaaugaaacuuugggccccagagcaguaugugaggcuauaaugguucaggaagucaaaaaaucuaaagcaggaagucaagaagaaaaggcuguauuuuagccccuuuuguuuuaucgucagagauaaaaucugguucaaagauaaauugugauguguuauauggcagugcucugugaaguuucuaaagccaugcuuguuguuaucugcucagcuuagccuacucuaguaagaauuaaagaagaauguuuuuauaacugauuugcauuaaaaauaaaacuuuuccuaguauugucucguagucacccaguuguuuggaacauuuugauuuguagucuagugggcaucacccaucaggacccuccuagcaccuaaagucaauauggagaaagauauaggggauuaacguuuugcacugauagcuaguuguauaucuuagaaggcagcucuaccugguggaagaagcccugugggccugugagucuuggggauauuuacuaguugucagacucuaaguaagucacguauccuguaguacaggguuaggaaacuguggcucugggaauugaaguuuguucaccccucuucauaguuguuauaaagaucaaaugggaaacugcauuguuaaguguaaagagccauauguauguguauauacacauauauauuguauacauauauaugagaugauaucauuuugaaaggguuagcauuauguuuaguuguaauuaacaggaaaccuuacuaauaaggacuuacacauagggaguaauuugucucacaugauaagcaguuuguggcuggcauagcuacucacuagugccacugaagggcccaagcugucucugacucuguauuuuccauugcuagaguguauuagcuuuccugcucaugcuagcugccccuggggguggcacuuacaucaaaaggagaaugcuuucccagaaaccuguggcuuaugcaucauuggcuggaacugucauauggccauuccuagcuggaaggagucugggaagccaaguauuuuagcugagcauauggccacgaucaaaaccaaggucuauaaguaaggaaaagcuggauugaauauucauuaaggagccagcacugucacauaguugcuuacauuaauuuuuuuucuagaaucuguguugaguaagagacuuuccugugugauuggaacuugcagcuuuauuauuagucaguaucuguucugucugcccucuauuuuguagccugcccucugaaggcaugccaugccucaaauaccauucuacauugucuucugugucuggauagauaaagaccuaguuucaacauaaaagaguaauuugcauaaagauacaaucaggugucuauaaaccuuuauagcuguugagaaugagguagcuagaacccaaaggaggugcccauaaauggcuaauagccucauuacaggauguaugucuagcacauuccguuuacuucauuccccacauaaacuaauaagaaaacaagccagggauaacaacacccugcuuuuuuaaaaaacuucuugaaaguucaugaguacuaaagcacucauggucauagcaggcucaaaugcccaagugccuguuugaauauggaugguauuucuugcagaaaauuguauugugaagacaguuugaaggaugaccacacauuuccuccccugaagcagcugcauugguuaguugaacuguuacacuuuuaacagcuugugugcaaggggauggcgugggaggaguagcuguaacuuucaguccucaggcagccugagcagugcucucggugcaggaugcaggguguagagagcugccagaaggaaagccaucagguggaaugcaggccccgcguuggcagugccacaggaauuacacaucauccuuuaaugucgugauuccauacagagaucaaggaagcugugcuuuuguguaauccuuguaaaaugcugcaaaauaccaugcguucuugugaaguaucagucaugguaguuaccaguguuguaucugagaggcagcauggggagagcuuaugggaccuugagcacaucauaauuuccccaucuguaaagcaagaugcucucugaaccagucugugaaagucagguugugaaagaaugugacugugggagggaggaugugagggagaugcugagugggguuagauugcaguucugucucggaggagccugcuagagaggguuggaaaggagucuauguggaacaggcuugcaauuuggugucagcagagacauccucagccuagauuuggugggacuuggugcaggugaauacagggauugauguggcugugaauggggguggggugguggcugagccagauugcaggagaacagggaggaaugggaaaggaaaagagggaaacccccaccccagggaaacccccaccccaauucagggcaucugucagaggcaagguggcaggagagaggaaagucaggaaguaugaugaguauaaacccacucaagaacugcaggggccuuugcugccuucugcccaauuggccuuuugucccaugccauguuagcaaguucuugucuuuuauggauuaauuuggucauuuaaccaauauuuauuaagucacuccucuaugcuagguguuggauaugcagcuguuagcaaaucagauagagguucaguucucacagaguuguguccuugauggggguaggggacaggcaaaugagcaauuaaccagacauauggacuggcccauccuggggccucucaggaccuggugguuggcugccccuuuuuucugguacuuagauguaugcuauguccucacuuggaagauauuucuauuccuccugacuggguccuucacaaucuguauuaaaacucacauugauaaauaaaaaaauuuuuuucagauuaaacccacccugucuuccuccaacucccaguguugacacccagacuuucguuugcugugugcuuugaugcauauggguacaacccuuucccaguguucuuuucuccuuucuuggaugcagcugcaagccuggguugaguuuuaugagaauucucccacuguacacaguucugugcucugcagagguugcuggcggagcaccuaggccugacugagacagcaggagaggagagggaagacucacugaggcaguccgguuguaggcaggagccgccccugugcggggagucccauuaggaggagacuuugagcaucauguguuagaaugcaguaagugggaagggcucuuggagaccagggaggcugagacugcccggguucacacuggauuuagaggcagugcuggaaucagaaccuaggaaaugggaacaaugcagucggaaacucccucagaguuuucauuuaggcauuugaaaauguuuaaaaaagacagaggucuaaacaccaaaaaccgucaggcacagacuuucuuuccccacugaagcuguaagacaaaagacauguucaugaacacuaguccagccucuuaaaaucuucgaggaaauguugccauguccuaguuuguguuuucccuuaguguccuccuugaggcgguuuccugcaugcuaauguuaggacauguauugaggagaagccagcagcucugcuuuucauuaaguaaaucucacguggucucuuaaaaaccaaaaaccagacaaaaauaacaguaacagcaaaaauguauuaagcuggaaaagagcuucuuuuucaagucagauaauuacuuuuagaaauuuuccuccaacguguuccucccuggucucuggucccuuuucuccaccccuccuuggggccucugaguuccucaggaaguauuuccaguaugggcuguggguugcugcaaggccugggguuuucuugguaauaggcacuuugccacaugagcauuugacaguccagucucgcagaggggccguucaucaccuugcuacuagcccacacaggaagaagaggcuggacucagccuguaacagaaaucuguacaguuuguuguguuuauuuccugacuuggcuuagaauugugaugaugauuguaagaccagccuuugaaguaaaggaguuugagcugcaccuuuaccccaugugccuguagacugacacauggugucaccaacauugagcacccccugccccccacuccagacacugugcucucuaguagguacacucaucucuaccugccuugcaauauuuguauacugcaggggcaggugucuggguucuggcccuggcucuggacucuaguguccugauggagaaaguagguagggagacuggacuggauuagugguguuugaacuuuuuuuucuuuuguuuacuggaaccucuuuuccaaaugaaaucuuaaaggcaacccuaguauauaaaagagugaaggaggaacugcugaggaugaagcugagcauggggcccccauccucuuuucccucuagaagucccccaggcaucuccuggaacccuaagacucacaggaagggucuggaucccaacgacucaauguauuuauucuguagugacuuggagcuugacauguuacuguuuuacuuaugucucucuccuggauguguucuccuuuacggggaaagcucugucucauugguuguugugcccucggugccuagugcuuaauacaugauaguaaaaccaagaacuggcaaucugugguuauuuguaacuucuugccucuugacucaagaggcugcagugagccgugaucacaccacugcacuccaggccuuagugacagagugagacccagucucaaaaaaaaaaaaaaaaaaguguauacucuguuaccaagucuguaauucuucuguucccagcacaccgucuugcuuuucuuagucagaacccuacuguaagccaugcauugacucuccuggccagagccaaauuacccugauagauacacagcacuuguuuacucaugccaugcccaagauacuuccccaguguguucuugaagcccuuccuacacugauuguggucaagucagaaccugccuacacagugcaggcccaucauguggcauucaggacguugcucuccaagccugcgcagcacaggaaugccugcucucuguuuccuuuaccagugcucagugaccuuuaccagagaccuguucuugcugacucugauugugugcuucucugauuagaaacgaauuuuucuuggcuggguacaguggcuuaugccuguauucccagcacuuugggacgccaagguggaagaauugcuugaacccaggcauucaagacuaguuugggcaauauggcaaacccugucucuacaaaagaaaaaaaaaauacaaaaauuagcugggcaucgugcgugccuguagucccagcuacuugguaggcugaagcaagaggauugcaugagccugggagguugaggcugcagugagucguguucacugagacccuaucucaaaaaaaaaaagagaaaauaauuuuucuugaauaucaguggucagcagucaauucugauuucacagaaagagaugguugauuuuguugauauagagauauuuuaaaaagaaguguagaucaaauugauuauuguaaaguaauauugaauucuguuuauaagcauguccuauucucagagagauuaugccauucggcaugggauaauucuaccacugaaauaccagugcagauuauguuauuuggaagaauacaaaguauuuguaguuagaaauguuuuuaucagccgggcacaguggcucaugccuguaaucccagcacuuugggaggccgagacggguggaucaccugaggucaggaguucgcgaccagccuggccaacauggugaaaccucgucuguacuaaaaauacaaaaauuagccagguguggugcugggugccuguaaucccagcuacuugggaggcugaggcagaagaaucgcuugaacccaggaggaggagguugcagugagccgagaccgcgccauugcauucuguccugggcaacaagagcaaaacuccgucuaugggggaaaaaaaaagaaaaauguuuuuaucaaaaacaaaaaaauuuuaaguaacuuuuuauuaugggaaauuuuaaacauauacgaagaauaacauaauauuaccucuagguuuauuagguaguuggaacaguaauuaccccucguuucauugauacccugcuuuguuauuuucaagcaaauaacauguuaccugaagcaaauauuacuauguauuuguuaaguaacaaaauguugcuauuuugaaguaaauccugaccaucauaucauuuccaccuuaacuauuucaaaaguuuacauuuuaaagauguguugugaaguuucaucaugcuuuagcaucaguauguuugcuugugaauuuacugaacugcuauucugugaugugcaaacuuuauuuuuucacugucacucuuuacaagcaaauacauuuauauuuguauuucucccacuuucuuagagaaaagggacccuuguauaaucugaucugcaccuugcuuuucuuauauaacaguuuauccuggaaauuguuucuuaucaguacaggugauuggacuuugaugacggguuuauggugaggguuauuggucugcaguacuggaggaaaauucuagccuuugcuuucucugggccaacacuguuaauacuuggugguuugaggcaugucacaaccuuccuuugagaaacauggaucuguuuagaugaagaugguuucagaacaucagaguuacccacagauuauguuuuuauguaguauacauuaaaaauauacuauuacauaguuuagauuuuuauauaguaugucaagucaguguuuuaugugggaugucaaguuucguguggaagcuuugaguaacugacauuuguuuaccuuuuuuuucagauuuaauuuacccacacccaaaugcuucugcagaaaaagccagaaauguccuagcuguggagacugugccuggagagcuggugggagaacaagcugcaaaucagcccgccccagggcauccaaauuccauuaauuuuuacucuuugaaacaguggggcaaugagcucaagugagucuuuagaaagcagcauaugaaauugaaaauggguuguuucugauaauguauguuauaauuuuauaaaugaaguuauaaaacuaucuuacacuuacaaaggccuuuguuguuuacaucauacuuucccauagaucauugugguuuuagcuuguauuacaugcuuauucugugucugacacuaugccaaacaguuucacacuuaaacgguuuaauuuaauugcucaacucugugaaguaggucauauggcugacauuuuacagagacugaaacuggcugaaggagaguaugugucugaggucacaauucuuccaggcugcagagcuggggcuucuugugccuagggccuaguccccucuccaagacacuaggcuggccacguccugugcucuggauuuccauucucuguuugugcaugggcuagugagaguagagguggguugguuuuuguucguuugguugguuuuuaugagaugaggucuugcuguguugcccaggcuggucucaaguccugggcucaagugauccuccugccucagccucuugaguaguugggacuacaggcaugugccacuaugguugacuuguuuuuuaaagaagaacuuuauugauauacaauucacacacuguacaauucacccauuuaaaauguacaauucaaugauuuuugguauauucacagaguugugcuuccaucaccacaaucaauuuuuaaauguuuucaucgauccaaaaagaaacucauuacauuagcaguuccuucucauuucccccaaccccuucuccucugucaacccucagccguaggcaacuccuaaucaacuuucuaucucuaugaauuuguuuuuugguggguuuuuuuuuuuuuuuuaagauaaggucuuguucuguuacccaggcuggcaugcaguugcgugguucauggcugacugcagccuugaacgaagcaauccuccuaccucagcuuccagaguagcugggacuacaggugugcaccaccaugcccggcuaauauuuuauuuauuuauuuauuuuguagagacaggguucccucuaucuugcacgggcuggucucaacuucugggcucaagcaauccuaccuuggccucccaaagugcugggauuacaugagccacugccccuggcuuaugaauuuguuuauuguggacauuucauauaaauggcaccgugcauaccuuugugucuggcuucuuuccguuagcauaauauuuucaagauucauccaugcuguagcaacuaucagugcuucauuuccuuuuauggccaaauaauauucccauauaugaaugugccauauuuuguuuauccauuagcuggggguggugaugcaugccugcggucccaauuacuuggaggcugaggugggaaaaucacuugaggccaagaggucgaggcugcagugagcugaguucgcaucacugcacuccagccugggcaacguggugaaacccugucucaaaaaaaagaaaaaaugaaaaaagagaaagguuguaguggcagugcguugugggagacuuggaaguuucuugcuguccuguagaguccaagccaguggucacuaugcaguuggccagcugagcuccauaaggggucccacugguuuuucaggauggggcugggguguucuuagaagcuaccauccaaggacacacuguuuuaaaaaguagccucuuugcuguaacugcuuucuuuuuuguaccuucgugguugaauucaguaugauaaaguuauuuucuguguguuuuuaguuuuuaaggcauagguuuauauugaagcugagugggauauauaggauauauauagguuauauuggagcugaaugucagggguacucagaccucagaagaccagcacuugugagggugaucacuguagugggcccugccuuccuuccucauccuggcuuguggcugcagucccaccuucuugguccugcucugcucccauucaucggcuuuuugcuguuuucucucuugagucagcucugaucaugucaucucccuacgcugauagcccucagccugcaagugcagcuccaaacucuuuggucugauauuugagguucucaacgauacgacauuagucucuuccuugggcagcuguucccaguauuagcacuuugugagccucuguguuccggccauucugugccuuccucuucaucccagaaccucugcucaccaugugccugucugcccugugccaucugauuaaguccagucaucucccagcacccaggggauggggaggggucauccgggaggcacaguggggcugccuucccuagguaccugcagcuugagaaccacugauuuccucuguuucaaaguauugggcuucucaguaaagaaagggaucugugcuccuaaaagugucagaaaaccacugagagccucccuucauuccacauguuaaaagguugaggcuuagagagguaaagugacuugcucaagaucacauagcaaguguguggccgagcugaacacacacccaggucuccuaauuggggacccagugcuccuucccccuuucaucauaagaacacauuugggggacuauugauuugccagauuuucauaccuaagcugugucaucugcccucaaagugagauaauggaaugagguggaaauagaccuguaaugcuggguguuuuccauguccuugagcauaggaacauggaugaugauugagugccuccugccuaggaaagugaacgccugucacuucugccugucacagcugacagaucacauucagggugaaaaaucuaguguaggaguuaucuucuaucagcugugccuuugccguguaacacagugauuaagaaccaggcugccugaguucaacucccagcuaugccacuuaguagcuggauaacuugggcaaguuacuuaauauucugugccuccguuucucauuuguaauaugaagauaauaaucauacaucaugagauugauagcaugaugaugaauucauauguguaaacugcuuagaacagucccuggcacuuaggaaguacuaggcgaguguuaguuguugcuguugcugguggaggcacagcucaugacaaagccauucuucacagagguuuuugggaccacuuucuguagacacuaaugcuuauugacuggcauaugaaucuuaaguguuuaugguuuuuuguuuuucuuuuguuuguuuuuacuuauggcaugcuuuaugaaguuuuaaauaaaaugccuuaggugcacagacagacuuuagugacccuaaaauagauuacuguauuauaaaugaauggcucaaaaauuguauuuuuuaaugcacucaaaaugcugucaacauuauggucaaggcuuaaaagauaaaugaagguuuauucuuuuauucuauuuaucaguauaguugaaacucucuuaacuagcuccccugaugaacugacauuuuaagguuccucaguagagccaugguccucacugacugacugcaugagaccaaaugggccacuucagggcaccugugucccugcugcccccaccagcugagcuacagaccuaccaagaaucagcuggguuuguuccucacugguuaaugcccguuguacuuauuauuguaauuauguaauucaaugagauauuuacuaaacccgugaaauauaaaaaaggaauuguuguuucuaggaaaaauaaguugaaugcuuagggaaaauuugauaaaggugagucacugaaaaaauugcugugaggaugugggugacaugaucgugaaaaaucaaagaaaaaaaacuuaaaacccuguaagauuuuaugcuuagauuguuucacaacuguuaggccuuguuccacuuuuuaauaagaaacaaacaaaauugggaaaguuagcugaugucuuaauggaugugauuugcccaagaaagauaacagagaacugcaguuaguauccccagauugaucucuuccuuccucccucccugccucccuuuucuuucuuucuuucuuucucucucucucucuuucuuucuuucuuucuuucuuucuuccuuucuuucuuucuuuuuucuuucuuuccuucuuucuugcuuuuucuuucuuucuuuccuuccuuccuucuuucuuucuuucucucuuccucucucccucccucccuucuuuccuuccuuccuuccuuuucucucuccuuccuuccucccucccucccccccuuucuuucuuucuuuucuuuuucuuucucuuucuuucuuucucuuccuuucuuucuuuuucuuucucucucucuuucuuucucucucacuuucucucuuucuuucuccccuuuccuuuccuuucuuuucuuuuuucauuuuuugagacagggucucuacuuugucacccaggcuggaguguaguggcaugaucuuggcuuacugaacccuugaacuucugggcucaagugauccucacaccucagccccccgaguagcuggaaauuuaggcacgugucaccaugcccaguauccccagauuccaagaagaggcuuuggcugguguguaucaguagacuggcagaugagugcacauuuacauacaccuuuacaggugcauguguuuguuuuaaguuccuuuuauauggauuccugcuuuaaccacauuuuucauuuaacuuuucaacaguccaaaucacaccaggugaaggaacuaggucucugcugaaauucuggccaguccauguguguaugugcauacucaggggugggagugcgcaagcaagagugagaaagcgcaugccugagcacacgugugagcgugcauuggaagccuguguggcgguugagcguguauuuucaguguauguaggaggugugcuuaggcugcagcagcgcugacagcagucagcaaaguucuguggcuuuguggccuggacugugcgcccaucucugggugcuaggcugggccugauguggaccucuggcuccugggguccagcucuaguucuguucaagaguggggucacauuguggauauuguagucagcccagguuuuggaaucccaguccugcuacuuauugggugugugauguugagcuagugacuuaacuucucugagcuuuauuuucuccaucaguaaauugcguguguguguguguguguguguguguguguguguaguaagccucucuacuggaugggugggagugaguguuaagguuauaaauaagaacugccuagcacagugucauuguaagugcucaguaaaugguggcuacacaacccaggccugcugguauugcugccacuguuguuacccugucucuuuugagccaguaggugaagugagucuccacuuccuugagucagguggauggggugccuuucucaaugcagguguaagggcugagcuagccgggaaggugugcucauccuuccaggccugccucccauaggucuucugcgggcccugcaguuggccccgcucugauccuuuguuuuugcuucucucuugacucccucaggccugguagaaagaguuauuugugagcauggcggggguucccaagaaucuauuaugguuuuagugucuaggaccguaaagucaugacagugacuccucucuucagccccaguucguagcagagggcccggcgcagcccaaagcaggcacccggauguuuggugaauuaggggaaguuuuuccugucccggagccguaaugugguacuugugauuuuccuuguuggaaggcacagcuaugucugccaagaaagacaaggcauguagucaccaugcugcugccucacacagacauuuuuuaagccaggacuucuggagaaggaagcagaaaggaaggcaacuugcucuuuggcccauggaguuucagcaguugcaggaaguuggcugggguguguguguguuucugcaguggugcaauggcaccuggucuuuucugauagcccccaggagcaugaagucgugcuuagcaauuaugucccaguaguccucuuggucuugauccauucacaugcucccaggggcccacauaucagaagggccaucgguguaugacacuguuccauggaaaucacugcggucaugagaggaccaguggcuuuggccuguagacucggagaccuuucaccaugacucagcauggcaagcugaggcucagagaacuuuaaugucuuguccagggccaccaagggagcaauugggccaugucuccgguuguauuuagaguugggggcugaggaagggcaccugucugcauccugugccugugcuggguccaccuguugcagggacccaauucuaagggaccugaaucaauucaaucgacugccucagccuuucagaggcuucucauugccuuaggcugaaggcugugcugcugaacauggccuucagggucccguggggucugaccccugucauuuccucuguugcaggcccacuugacuucuuucaguucuucagguguaugucuucccaacaggcccugccucaggcugucccauugcagggagggcucugucuucucugguuacuucugcucauucuucagagaagccuucucuguuccucccacuccucacugccgugcuucuccuucauagcccuguaguuucuguauuucuuuguguacuugucugugguccagcucucuugcaaggcugggagcuccauggggcagggacccuaucugucuugucucugguuuaccccagcaccucacacugccuggcucaugguggguguccagcaccgacuugaggaagagugaugagggaaggcuccagacccuuccaggggcagaguugcucugcugcucuugcucccgcugcuugggggcuucucauccucugcccuuuauacucgugggggggucugcccacacccaccugcccuugugccacacucccuucccuagcaggacgacaguuccucucagcacuuuucuuucuguuuggcuuccugggcaggauguuaccuucugacacagcauuguucacuuuuuugacugggaacugacagcagaaaauacacaucuuuguauguaaauguauacuguuguuauguaaauaaaacugaaagaaaaauuccacugcuacauguaguaaagcuaaguaguauuuucucuucuaauacuaaaaaaaugcuugucaugacccucaaaauugauuuccucacuccuuaauugauguccuggcccccagugggucaucaccugcauuugagaagcccguucugcaggacugccuggcugggcagcuggcccucccucccacccugcugcaucuuccucuccccuccacuaugggauggggcugaggauguucccuuggguaagaggcugucccuccccgcugucagcuguuuaagguucuucaggaagacaggcaggcgagcccgugaguccugccacaggggcuguagggugcgguucaaggcugaacccaguaugucacggccuaccugggcacaccaggaagaagugcuuauucuuugcaguguggguugugggagaggccggugaugguuuugcugugaagaugaguuuuggcuuaaagggcuugagagauggagagggacuguccaaaggggaaugcaagugcaaggacacccaugcagaggcaaggaagucagaacagggugugucucaagaguggcauggguucuggugccaggugcguagggugcuaagggggugaggauagaagaggagcugaggaggccagggacucccagggugaaggggugggggugucugcccuuuggacaguagggaaccuguggagcuguaccugucugaaaguucuacaguaagaauauuguuucuuagauguuugguuucuuugaggcugugcauguuuauuagguguuugcucugaugucuuaaaauuggaagggugauguacucaucuguccagguaaaugucuagaguauuuuggaaacugucuuucugaugacaccuuuccagguccucaagaccaaaagacaucauaucagaaguaaauauauucugacuuuggacguuaaugcuccaaacuugaaugccagcugaagccuggaccacaacagaaagcagccucucgaaguccuugguuugaaggacgauagcuuacuagagaguaauuguguuaauuugcucuggcugcuauaacaagugaccauaacacugguggcuuaaaacagcaccuauuuauuguuugauaguuugggaggccagaaauucaaacucagcuucacuaggccuaaguuaagguguuggcaggacugcuuucuucagaggcuccagggcagaguuaguuccuggccuccuucagcuucugguggcugcugguauuccuuggccuguggcugccuugcucuaaaucacugcuuccuuggccacauugcugucuccucuucuguaguugaaucuaggcccacuccccagauaacgguguuaauccauucgugaagacugagccuucauggccuaaucaccucuuaauggucccaccucuuaauaccgucacaaugauuauuacauuucaacaugaguuuuggaggagauauucaaaccauagcaagugaccuggcuugcaggccugccaccugacagcuuccccauuuggccugccuucuuaguuguguguuuguacuucauugcaauaagcgugcaugcguauaaaaagaaaaaucaaucauugcugagggguacacaguuaaaaaugaaaguccuuuuaaguccacuucccagaagucaccacuagaacugaagguacuuaugucugcacccugaacuucgcucuguguguaugugacuuagagggauuguacaguauccacuaugucagugcauagcuacuucagggacuuagaaugcucacucuucgcucagacauggcuuaucuguauuuaccaugucaugaggcccacuugcaccaaagcugugcucucaccagcagaugggucaggaggggucagcagugguggagaguguagggccaccugccaugccccuuugagcugacacauuauauaggcacuuaucuggaauguccaaacuuguuagcccuuacuagagcucuuguucuaacagaauucgguuauaggaaugugcccuaaguuauuuaagcaguuuccuagccauggacaucugcuuguuucuacuuuucugucauuucaaauagcauuguucugauauucuuguacauacgucucugugcccuugugagaauauauuugaggaauuaauuuguagaggaggaaauacugagucagcuuuauugagauggcuguugccagucagaggaaacccccccacacaaccuccucccugccccgccaccuuuguuucccuuaacagggccuguagucuggagggagggaaggagcuggaagcagugguagccugcuucccuccugugcacaaaguccuggcaagugcaaaccucugccuuggcagugucguccaccugcugaagagguugugguuuugccugaaaccuggcugugcaggcgguuuguggagggguuaacuuggaagaaauuugauggaacauuucccaacaauucugucaacuuguaaauucuagcuuguuaucagaauccaaacgaaugucgaacgaguuauuacuguuuuaguuagacauuuuaaacugugcagaccuccaccggaaagagguuuucuuaacgaugauacagauugcugguguuuguuuuaaaaagcucaggcugaccacugccccugacaaggugcuguuuugcugcuucguggugccucacuuucuauuucagaucagagcagcugaguguuuauaggugggcaccuggcacgcugccugggagaacacaguaggccucucaaagaucugucaaaugagacugcggucuuuaaacagcaaauacugucauagaacagccucuaacaccagcuaaaaaaacgccuccauuuaaaccagcugugaacuccucauggaguacacaggcaggacacguaguugccaccgaggccucugugggccagagcagacagggugagugugucugagaagucugcacuguaaugacccccuuguugcacaguccuagaauuggguuuugccacauaagagcaaaaacaggaauuggcuauauacuguuucagcuucaagaggcuuucacuuugagccugauuccauuucucucuuauccaggacuugacaaguagcaccgcaccuccagcaaggcugucccucagcugcaggugagagcacggcagcguacgacucaggcuugcaacaggcuggaaacccaaaaccgcggugggaggaaggaggguguguggcaguucuaagucacugaaauuacuguucucucuccccaggccgugugggggugucccugcucuuauuucucuuuccugcauucacccuuuaggaaccagagcugaggagcacaguuugacagcuagggcaaaugguaaggagaauuuaacuccuaaaauugacgguggugguagucacaugccaccugagggaaggcuccugugagauccuugcuguaggcagggccacugaaaagucauggugcaguggguccagcggugucccagugcccugugaagugaugaaccagucaugucaaaaaaaugaacagaaguauagccagcauuugugagaguuuucuuuuugagcagcuauuuugaaauaguuuucucuacaauuuuauaauuuuuauaaaaucagacuuuauacaguaucuugcucauuggguuaccauggggaauugacuagaauccuucuaugcaguugucugugaagauguguggcacagugccaggcucuagaagagacaggaaauaaauagcacgugcaagaugcuauacgucguuuaccagcuccguguugguccuaaguaaauaaacuaugagaaagugagugucaguucuaaacaggcauaauugcugguuucuggugacucuuuguuaaagcaguuagccaaaggccauacauccauauacugugauagcgugaugagaacauaagcguguuauauaauuucucuguauucuucugaauguuuaaaguacaaguaaaaaggaaaaaugauaugcuuuaaaaaacacauugagaaaugacuguuuuacaugagaauaucaucugucugauucaaacuagagguaaagccaccuuuuccccccuuuccuuuaauccaccucagaaaacaccaaaugauacauuucuuccucuuccuuauuuauuugcauguuuauuuuaauaacuucauugaguuauaauuuaccuccaauaaguucaccuauuuuaggugaauaggcugaugaauuuaagaaauuauacacagcgauguaaacaccuccauaauaaagaaaaauagaacauuucuacaccuuuaaaaauuccuucacguuccuuugcgguugaucccuucccuuaauacccggcccugggcaaccucugauccgcuuuccgucacuauagcuuugaguuuuaaaaauuuuuauauaaauggaaucauacuccuuauagucuccugugugucuucuuucacuuaacguuuuuggagacuuaccuauauuguuugguguuuucguauuuuauuccuuuuauugcuuuagggauaaggaugggucuauuaaguaagagaauauaaguauguaugugugugcguauaaguaaggugguucaugugagcauguccucuccucagcacuccacuuaccgacugcucaaaugaauuaagaugucucuucauaaugaacacaugccucuuaccuuuugacaguuuaacuauaaaaauuugacuuccuuuauuucuuuugcaaauuaggguuauacuuaaaacuuuaaauauuauuuguauuaggcaauuugauuaugauaugccuugauacaguuuucuucaugauuuuugugcuugaaguuuguugagcuucuuuugucuguggauugaugguuuacaucagauuuagaaaaauuuuuggucauuauuucuucacauacuuuuauuccaucucuuccccuucucguccccuucagugaccgacucauugguccauccauccuuccuuuuuuucauuuguuguuuuucuguuucauuuuaggucauauuucuguuucguuuuagguuguuucuauugcagggucauccaauuuucuagucuuuccuuccacaauaccuacucugcucuuguucccauuuagcauguuuuucaucguaggcauuguaguuuuaucuuuggaaauuuuauuuaaaucuuuuuuuuuuaauuuucuaugucucuaagauguuuauucuuuuuuuucuagcuuuuagaacauaaagaauacaguuauaacuuuuagagucccugucugcuaauuuuaucuuuuguuguuucuggucuguuucuguugauugauuuuuuuuccucauugugacuuguacuucccacuucgugcaugccuggucauuuuuaaaauugaauaccagauguugugaauuuuaccuuuuugugugcuggauauauauauauauauuuuuuuuauugcuauaaauauuauugggcuuuguucucggauguauuaaaugacucuggaacaguuugauccuuuugaaguuugcuuuuaagcuuugcuugguaggaugagcacaggcuuuagggauaccaucaguagccuuucucaguaaucuuucugaugcccugugaauuaugagguuuuccacucugacuggugagacuaggcacuauucccggucccgugugaggcucagggaugguuuccuuugcuucucucaguugguucucucccuguccucggauagcuuucuuacaucgaagccacaaucaguacucgguugaagacuuggggauaccaucuaagaucucugugacacucccucugugcagcucucuucucucuaguacucugcucuaugagcugcaacugccuugagagucuccacucuaucuucucaucucagagagaugcugggcuccuccuggguuuucccugccugcagccuggccuggaaacugucuccaggcaguaaggugggcuuaccucauuggcuuucccucucucaggaucaguguccugugcugccugauggccaauauccaaaaaccaugguuuccuguauuuuuaauuuuuuuuucaguucuuuaguuuucaccggggaggguaaaucuaguccuuguuauuccaucuucacuggaagcagaaaucuuaaccuacuuuuuaaaacuuuuaaugaaauauuuuuagcacacagacaaguauauugauuacucagauagccaugacucauuuuuauaguuuugucauauuuccacugcauuuuuaaaaacagaacuuuacuaaaauccucucucucucucuuuuuuuuuuuuuuuuuuuuuggagacagagucuugcucuaucgcccaggcuggagugcaguggggugaucucuucucacuguaaccuccgccucccagguucaagugauucuugugccucagccucccgaguagcugggacuacaggugugcaccaccacacccagcuaauuuuuguguuuuuaguagagacagaguuucgccauguuggccaggcuggucuuaaacuccugaccucaggugauaugcccaccucagucucccaaaguacugggauuacaggcauuagccauggcaccuggcuaaauccucucuucuugauccuauucuucuuuaccuuuacagagguggccaauauucuguauuugauaauuguaauuuauguguggacuuaaaaaaauaguuuugcuacauauauauguauccauaaguagucucuguuaauaguauaaucugaagguguaaaacaguaucaugcuguaccuauaauucuuccauuuucuuuuucuuucaguguuuaaaaaauguuuaucccuaugauacguauagcuuuggcugaaauguacauuccacaagaauaauaaucuugcuguguuuuguucacugggauauuccaagcaucuagaauauugccuggcauguuguaggcucaaucaauaauugguggaugaaugaguuaauuuuaagugcuguauaguacuugacuauaugaauaugccacaguuuauucuccuguucaugaauguuuagguuguuguaccuuuuuauuuuuuucuaauaugaacaaugcugcagugaauguuuuugcuugugucuccuugugcacauauguaagaauuucuuuuagcaaauacuggguguuagggguaggcaccucuucaacuuaacaguaccuugcugaguuccucugcaugguaauaguaucaauuuauaaucccaccagcaguguauaagaauccccauuucgauugggugagguggcucacgccuguaaucccagcacuuugggaggccgaggugggcagaucaccuugaggucaagaguucgagcccagccuggccaacauggugaaaccccaucucuacuaaaaauaauuaaaaaaaaaauuagcugggcaugguggugcagccuguaaucccagcuacucagggaggcugaggcaggcgaauugcuugaacccaggaggcagagguugcagugagccaagauugcaccacuguacuccagccugggugacagagggggacuccauuucaaaaaaaaaaagggaauccccauuucuccguauccucaccaacauuugguaucauuagauauuuaaauuuuugccaauccuauauacaugagauuacguuuuguuuuacuuuuguuuuuguuaauaacacauauuguuuuucccaacaggaauucgaugucuucuuuccguccugggagaggacauaaugauagucggaggacuguguuuuauaccaaugaagagugggaacuuuuagacccaaccccuaaggaccuagaggaguccauaguacaggaagaaaagaagaagcugaccccugaaggaaacaaagguaucaauguacuuccuguugucugucauucucuguacugccaucuguuaaccaccagugauguggagacacauuauuagcagguauuucgagaagcauaaggaccaaugggggcuugcauucucuuugucggacuuaaaacauaaaggcuuaaaaaauuauuuaauaaacguuauaagaaauaaaugacugucuaguccaauggcucaguuuuuugagggagauagcagacuuggaagucaugauccucuuuauggaaauacugauuuuaaaaaacuuuauagaaauuugaaauguacacaaaagagaauauagucucaugaauucugguguacacacaucauccagcuucuacaaugugaacuauggucucucuucuuccuucuccgucucuaagcuccugcaccucccugcacccacugucagcuggauuauuauuguaggcauuaauccauugcaucugcaaauacuucaguauguaucucuaagagauaaugacucuuuaaaaaaauuauaacuacaacuucuuuauuauauuuauaguuacaauaaauccuuaauauuauuuaauugcaaucugcaacugcaucugcaaaugcuauaguauguaccucuaagagauaaugacucuuuuagaaaaauuauaacuggccaggcgugguggcuuacgccuguaaucccagcacuuugggaggcugagggugggcagaucacgaggucaggagaucgagaccauccuggcuaacauggugaaacuccaucucuacuaaaaauacaaaaaaauuagcugggcgugguggggggcgccuguagucccagcuacuugggaggcugaggcaggagaauggcgugaaccugggagguagagcuugcagugaguggagaucgcgccacugcacucuagccugggugacagaccgagacucugucucaaaaaaaaaaaaaaauuauaaccacaacuucuuuauuauauuuacaguuacaauaaauccuuaguauuauuuaauuccuuaauuguucccuaagugucuguuuacagccaguuuguucaaaugaggauucaaacaagacccacacauuguauuuaauugaugucuucuuaggucucuuuuaaucuaaacagcucccuggcuuuuuuucccuucccccuccuuugccacauuuguugaagaaaccaggucuucgugcugaggagucucccacaucuggguuugcugauuguauuucuguggggucauuuaacaugcuucucugucccauguaauuccuguauacgggcaguuagagccggaggccugcccagauucaggguugacuucugauucgacaggaaugcuguuuugguggggagaugcugcgugcuuccuaucguaucgcaucugaagccacaucaugucugguuucucucuuuugauauuaagauugaucaggauuuagcguugucaucuugauucauucauaaaauucuccaucagccuuuuugccugaugcuuuuaacauucauuuacaauccuagauuuauuuauuuuauuuauugagacggagucucgcucugucacccaggguggagugcaguggcgcgaucucggcucauugcaaccuccgccuuccggguuaagcgauucugccucagccuccugaguaacugguauuacaggugcccaccacaaugccuggcuaauuuuuuuauuuuuaguagagacaggguuucaucauguuggccaggcuggucuugaacucuugaccucaggugauuuguccaccucggucucccaaaguacugagauuacagccaugagccaccgugccuggccacaguccuagauuuauuaauucauuaggagaauauugauguuuuaaacauaaaauaacaauaaguaauuuugaaauuccaccuuaugccugauucuagcaugggccagcaggaauagggugcaggauuugaggaaaccuuuauugcgagaguaagcacuuaggaaaggaaauauuuuuucugucuccuggaaaaggacugucaugauuugcugugagagggagcuuaccugugcuccauaggauccugguguagaacccacuggcccagugugacaugguguagaauguggccacacugaaugugcugaauuaccuaaugcauggcaaggccagugagagugcccagaagaggggcucaguacgagcugauaaugcuaccuggaaaaaaagagauuaaaacuggggauuuggguuauugaaaauaaguacuguuggcugugacuuccaguagagacugagggugaaauagaaggaugaaugugagcaggacuggggaggaagaaucgggagugcuuagugaguugggacgggaggagaaacucccugcaccuuggagacuguuuucuugacggaugacagccuucuuagcccucugccuaacccuucauccccuuugaggggaguuuaugugauagagagggagagacaaagaugucacuagacuuugaucuuacucucuucauggguauuuccugaaauggcuccgauaaucagcccuccaacuuguccauguuauucacagaaagugaacuacccuuccuuguauuuucccguaucuuuaaguaaacuuuuuauugauguauaacauacagaaaaguccccaaaucagaaauguauagcucagugaauugucacaaauugaauacacccaugaaaccagcacucacuucaagaaggaggacgaugccagcacccuaggaaccagcugccauccccgugcccuuuccagucacuaccccgccccagggaaccacuguacugauuccuaacagugcagguugguucugccuguuuccuaacuuuauauaaaucacacuuauaugcucccuugugucuccucuuuauaaugugaguauauauauuucaaucuaucuacacuaaaauuuauuuagaucccauaguauuuuuuuuuucuuuuuuagugauggaguaucuguguugccuaggcuggccuugaacuucuaggccuaagcuauccuccugccuuagccuccaauagcugggaccacagguacauaccacugugccuggccugacgguauucccgaauacucuuuuuuuuuuuuuuuugagauggagauucgcucuuguugccuaggcuggagugcaaugacgugaucuuggcucacugcaaacuuugccucccggguucaagugauucuccugccucagccuccugaguagcugggauuacaggcaugcaccaccacgcauauuuaguagagacaggguuucuccauguuggucaggcuggucucgaacucccgaccucaggugauccaccugccucggccucgcaaagugcugggauuacaggcgugagccaccaugccuguccccaaauacccauuuuuuaagaaggggaaucuaguuaugcuuuaaaacaugcaugucuuaguuuguuuuauacuguuaaaacagaauaccauaggcugaguaauuuauaaugaacagaaauuuauuuggcucaugguucuggggcuagaaguccaaaagcauggcacuggcaucuggggagagccuuuguuuuguauagucccuugguggaaggcaagagagaaagagagcaagagagggcaagggugagggagagccaggggaccaaacuuguuuuuauugcaaaccugcucuggugauaacuaacccacccuggugauaacaacauuaauccauucacaggggcagaguccucaugaccuaaucaccuguuauuaggccucacuugccaauacuguuacauugaggauuaaauuucuaacacauaaacuuugggggacacauucaaaguauagcaauguuuguauguuaaaaaaaaaaaaacaacaaaaaccaacauacauuugaguguuuuugcuuuuuugcuaaggacaaauuagcaaaaauaggaugcuuaguaugucuuaguuuuccaugaaaaaugauccugugauacagucuuccaaggaaggauccaguggggggaaucaaucaucucuggcugaagcauguugguuacuaucuagaaugcagugggggcagagucaucaaucuccuguaguucuuaagguggugaaugccaaacucccuggaggaugauuuguggggaugcuuuauuuuguuauaguuuccaaaaggaagaugugguuuuuguuuaaaauacaaguuuuggccgggcacgguggcucacgccuguaaucccaacacuucgggaggccgaggaggaaggaucacaacgucaggagaucaagaccauccuggcuaacacagugaaaccucaucucuacugaaaauacaaaaaauuagccaggcaugguggcgggugcuuguagucccagcuacucgggaggcugaggcaggagaauggcaugaaccugggaggcggagcuuacagugagccgacauugcgccacugcacuccagccugggcgacagaccgacacuccgucucaaaaauaauaauaauaauaauaaaauacaaguuuuauuuuuauguaggaguaacuggcucaggauuccccuuugauuuuggacguaaccccuacaaaggaaagcgcccuuugaaagacauaauugggucguacaaaaaucgucacagcaguggugacccuucaagugaaggcacaucaggcaguggcagcgucagcaucaggaagccggccuccgaaaugcaacugcagguccagagccagcaggaagagcuggaacaguuaaagaaagaccuguccagucagaagguaacuucuucuucuggcuucugucuuaccccaccucagcaggccaaggacgggaggaguaaagcccaauuuauguuucccugagucuuucuggggacagcuuuguuucccaggaguugcuuuuccccuggagguuucauauugccauggcggucaucuaggcacagcugcugugcuugaucauugguucagagguguuugcauuugcaaggagagugaagaucucucaaaggaggacagaggagguugcugucugcaccacagcccaguccugccccugagguugaaucucccuaaacacaguuucagcccagaguucuuuaacagucauuaaaaagaguuucugcauccuauucaacaaugguuucuugaacuaaucagaucuaauuacauuuaauuguucagcaguucagugacucuuagagcacagguuuuuuaauacccaugacauuuacuggauaccauugcuaauuauaguggacauguccauuauuuccuguuuccuauuacuguucucuacagacagucuuuauggaguaaauauuuuuuuccucuauuuuugagauccuucaagaggaaguucaguauuaaaauguuuccaguaaaguuucuacauuuccucaaacucugucgauuacuccauguaaugucaugauuucugcuuuuccuccucuccuugcucuuuucacccuucacuccauucuccuuuuggcucccaggagcuuguucgacugcuccagcagacaguccggucaucccaguaugacaaguauuucacaagcagccggcucugugagggggucccaaaggacacgcucgagcuucugcaccaaaaggaugaucagauucugggccuuaccagccagcuggagagguucagcuuggagaaggagagucuucagcaggaaguaaggacgcugaagagcaaagugggcgagcucaacgagcagcugggaaugcucauggagaccauccaagccaaggacgaggucaucaucaagcucagcgagggcgagggcaacgggccuccucccaccguggcgcccagcuccccuucgguugugccuguugccagggaccagcuggaacuggacaggcugaaaguaagaguggggcaggggcucuggugauuggcaugagagaccaccgaugucaccccagaggccuggccuccgugagcugauuuggugugacggcagaacagcugcacacuuauuuuuuuuccccacaaguguaacaggacuuaccaucaaauaaucauuaaucuucuguggagcuuccuuggaaaaggaaacucuugcuguugcuuugaacaguuucaaauccuuccccucccuuguuuucaggcaacuaagacuucucuuucuauauauaccacccuuaguacuucauuaucccuuguaucauauggaggcuguuucuugccucuccugugugcaugaaaucacacacaaacuuaauuugcacagcuugcugcaggaccuaguggaugccugguuugggagcauugcuccuaacagcuaguaugggguuagcuggggaagcggacuccagcuuccaaguaggccugggaagagggccuguucagagucagugcccccagcacccaagaugggaggguccugacacucaguaggaaggacagcuuuccuccccguguccuucucugggcuagcccuuaggcugggaggcuauugccugaacagaagugacccuccuagucaugccugggguggugaccagcugaugcgguaggaggaacacacagcauuugugagaggugggggcagccugcauuucucuucuugccuguagagaagccuaaugauucagaggggaggccacagggaggaucauaacauucuugcugccaccgguucuugagacuuugugggagagguuuuagguggacaaguggcccccaggacauggggcaucaaguauagccuguuugaccccagcagaccccagacaugucuguagcuacuggucucaccuagccccaaggcgucccucaccuggccacccucaucuugcaaauaaugugucuccgaggguguuuggcucuggauggagcuuguccuuggagggcagagguuugcugcuguccagguuguuacugaguauuugcuucaugccuagcaguaccuuucaggcgaugcauugagugagggaaugauaggcaugcuagggacccugaagauaauuccaaaacagaaguaaaaacaccggaaucauggcagcauggcuggaauauguacaugguccccauagugaccacuucucacugacaacacccauuggauaugugaggcccagaggauuuaugaaugagaaaauccaaaacaacaagaaaaccucuggucucaauacuuuacacuuauaucuacuauuuaaaaaaaaaaaaguuggcugugcauaguggcucacgccugugauagcagcacuuugggugacugaggugggcacauugcuugagcccaggaauuugagaccaguguaggcaacauagugaaacccccgucucuauacaaaaaaaaaaauggccaggcaugguggcuugcacuuguggucccaacuacucaagaggcugaagugggaggauugcuugagcccuggaaagcagagcaaggcugcagugagcggagauccucacaccacacuccagccuggaugacaaagugagaccccguugcaagaaaaaaaaaauaggcuuugugguuuuuguuuguuuguuuuuuuaauaagaggucuugguuagcauugccaauggaaguuggguuuuuuaauguacacaacauugaauauacaugacccuaaauauauacccaucaauaauacacauuuugggauuacuuaaugaaaacagaaauuuuuauuuuuauguauuuauuuuuuuugagacagugucuugcucuuuugcccaggcuggaaugcaguagugcaaucucagcucacugcagccuuaaccucccuggcucaagaaauccuccagccucagccuccugaguagcugggacuagaggcauaugucaccacacccagcucauuuuuauauuuuuaguagagacagaguuucgccguguugccugggcuagucuugaacuccugagcucaagugaucugccugccuuggccucagaaugcugagauuacaggcaugagccauugcauccagcagacaggugaaauuuuuauuuugcaagugugucuauuucuguagugcguagaacaauacuauagugguggguuuccagggcgugcgugacacuuggcagugggggagacguguggagcagguuuucccggggagcgagccagggugugcguggagguuaugcuucguggcuguggcgacuaugcagcuccuucuguagacagcuaacggagcugaucgggauacagcgcugucagaacaggacauucccuccucuuuucuuuuugcagcauaauggguggagugguuuugagccaugaaguuuuuuuccuccaacauuucucaacuuaacaaguuuagcaauuuuuaacaacuuaacaagccuguggccccaacauaucacaauugugaggugauguggcgacagacgaugaagaggcaaagugguuguuagguggauuccaggugagacaguugaggccugccuggguccaugaccucaugcuuucugacauugcucuguuauugccagugcugggggucccucugcaaugcagaagguguucacaccucaugcaggucuccucugcaguggcacugggagaacuggaaaggcuccagggagaaagagggagcgcacugacagaaguggguguucucguguguguucccucauagcccuucagcucuagacaggguaugguugaggaagaaauauugauuccuacuucugauuccaaauuuaaaugucuaaguggaaaaauauauauauuuaagauauauuuauuuaaaguauauuuuauauauuuuuaauuuuaaagauauguuuauauaucuuuuuugcuauugcuguucuugaccaguuuucaugcuuuauugucaguggaugcugccuguaaagauuucugccauuuggaauuuguuaacuuuuuuugguguggucuaaugcuuuuuguuucuauaguauuccgaggcaggaauaaacauugguccuaggauuuugccacccuagugauuuaagucauuauuucuccauguuuccuuccaauccuuuucuguguuuccguaauucuuccauuuuugaaguguauggacuuucggauuguuccauucaacacuguggccccagcacuuccauauugcuuucauuagcgauuucaguguuguccauccuuuguguuaucauuuacuucauccuugucuuucuuccugcguuugcuguuccaugaauaccuccgugccuacagcuucuccuucuuccagcucaucuaugcauccagcugugugcccacccuuuuacucugcacggguacacaggcacugcacuccugggccucacaguuuaguuuagaggcacaaacagaaaagcaaaaugacaacuggagcaagcaccaggagggaaggggauguggaacagcguggggugaugcuuuacauugagcauggccucuggagccagcccagguuggauucaaacccagaucaccacuuaggaccucugacuuggccaggugaauucaugucucugccucaguguauuugucugugaaauagugcuuauuuuccucauagguauugugaggguuacaggcgguaauccauguaaagcccucccucacacagugccuggcuccucauaaggucuucacuguuagguguuguugcugugaucaucaucguucuagagaaaguaucuguaauauaaaugaucaggacuuacuuagacuguaacacaaguuuuaaguuaaagacauacauggcggcugauguuacuugcuuucacugaccccaccuuguaucacucagucucuauccaucacuguugagugcuuucuucaguugcccuccagccagcuuuccuuuggcugaccugccuuuuaguaauauguuugcuuaauguuuccaaauaugagaccuuuggccaggugcaauagcucauaccuguaaucccagugcuuugggaggccgaggcaagaggaucacuuaaggccaagaguuugagaccagccugggcaacauagugagaucucaucucuacaaaaaacauuagcugggugugguggccaugccuuugguccuagcuacucaggagguugaggugggaggaucacuuaugcccaggaguucgaggcugcagugagcuaugaccaugcuacugcacuccagccugggcaagagugagacccugucucccccccccuuuuuuuuuuuuugauacagagucucacuauuucacccaguuuggagugcaguggcaugaucuuggcucacugcagccuccaccuccuggggucaagugauucucaugccucagaaaggguagcugggacuauaggugugcgcuaucacgucuggcuaaauuuuuuuuguauuuuuaguagagacaggguuucgccauguuagccaggcuggucucaaacuccuggccucaagugauccucuugccuuggccucccaaagugcugggauuacaggcaugagucaccauucccagccaaccuuguuucuuuaaaaaaaaaaaagcuuuuaagacaccaguagaaaggagauucaggugagaaaaggaaguccaacauucaacauuucaaguacuugucaugacgugacaaguacuugaaugugcucaggcugaguaugaugccuaucgaaguucuagugggagucgggccugagaccauggagcuaagagcccacuggucuggcucucagaagucugauuugcaggcuagacaguaacugggcagcuuucuauggcucaauucuucaccucaaaaauaaagauggugagaauggcugccuaagaguuggaguuuuaaacaagauuaggaaucucacaugccuagcacggggcaccuguaacccaucgcaagugcuccguaaauguuagugauuaaagggaacauugaaccauuuucaguucuucugcauuuuaugggggaagugguauaaucccguggugguuucuuguuuggcgauggggaguuucuguagccgcaucucuggggagcggcagcagucuccugcuugugauaucaccagagucugucuugacuacccuggccugccguuugagcugucuugaacauaauuucuucugugacugggagauuaggaaccucacacaccagccugucagauuauaaaagagaaacagaagcugggggagaagagacacauuuauaaaagacuaaauuuguaaagaacauuuagaagucacugcucagaggugauucgguuuaguauccuuagcagcuucuucaguucauuguuuuuauuauuaggaaagucuaaggaaguuuucugagcuucauuuucaguguuuuacaugaaaacacuucacccccuuuuugguuugcuuuuuguugcuguuggauccuuucagcuuucuugcuuggaguuucaagggcugaagccaauaugacauguguccugccccgaccugcucucaaaguuggacucggcagaacuugucaccagcuuguuauguucuuuuauagacagaaagcaaauaggcaaagguuaacaauuggcuaauuuaggugaaggcuauauuguguucauuguacuuuucuuucaacuuuucuguaaguuugaaauuuuucaguguugaagaauauguucucuuacgugccuuauacguuuuaggucauaggauuuguuauuaagagugauuuuuaguuaugggcuguauauguauguagacuuuuuuuacguaaacuggauaagugaagaugagaaccuucagaaaauauguucaguuucucuaguuuaaaaaaaaguaagguauugcuuuuuuuuaaccaccucaaugaauauggaauauggauagauaaaauauuugcauagauuuaggaauaugucauauuuauuucuccugucaucaguugagaaaaacuaccacaauuaaauaaaaauaucuucuccaucuccguuacggcagucaugccugccugccuucuacuacuguaaauggccaaaaagauuaauuaggaagugccuuuuaacaacuucuaguucuuuagaacuuacucuaacuuagcagggcuauuugauuggugaagcagcaagcuacugacuacauaggguaauuaauuagucaauauucaaccaaugugaauucagggauuuuuuuuuuuucuaacaggauaaucuacagggguacaaaacccaaaacaaauuucuaaauaaggagauuuuggaacucucagcucuacgaagaaaugcagaaaggagagagagggaucugauggcaaaggugggucaggauagguggauucuauuaccuggugggagguaagguuaggaaaccauuaaaaauaagcaugcuuuacaaagcgguucaacucccaggcuuggagagaugugguuacugauaacaaaauauauuuaaaauacauauaauacauagagcuguauaguuagucucauuuuauuaucucugaugaagacagauaaaugccgugagaugugaguuuuucacauaaacuggauaaguaagaaugagaagcuacagaaaauguguucaguuucucuaguuaaaaaaagaacauaagguauugcuuucuuuguguaccuuuguucauaagcauuuuuaauagauuuugaagaaaacaaaguaaguacauaauuauaaggucaccuaaauuaagauuauuuggguuuugauuuaugcuguucaguuuuguauuuauggagauggugagguaaaugccuccucugugaacccaauaggguuggugugaaagucagauaugauuauggcuggaaggggcuuugcacaaaguguaaugggaccacaaacauuucagcugucaucaaaugagcuguaaucaaaugauacuugucaacagcuguuauauaccugauauacuuuuuugaacagaacuugaagcaucuucccagaccuuauuccugcauguuuucuaggguauauuugauuugucugauaagguggcagaugggagcuaguccuggaccacaguguccuaagaaagaauggguauagcauggaguggccacucaugggccaugugccagauggcaccgagcuggaccucaguaauuggcauguagccugguuccugcugcucucuccaccucuguccagaggugaugcauuuguuggcauccagaggucugauuaucagcacuccuucuauaaggaagagaggaacccacugcaggccauuuuaaacaugaaagguggucuguggcauaaauuaauuucuugucuuugcuacagucugucucuggcucacuuccuaauaguuuuggguuuguuguucacuggucauuugcguaccuaaagauugcucuuccugugucucugucugaauggagguaaccaccacauucucugcaguauucuagccuggaagccaagcucugccagauagaaaguaaauaccugauauugcuccaagaaaugaagacaccagugugcucagaagaccaggggcccacccgggaggucauagcccaguugcuggaggaugcucugcagguugagagccaagagcagccggagcaagcauuuguuaaaccucaucuugucagguaaaugugcuagugacuguugaggguagugcaccccauuucugaagucccuuuuucaacagcaggaaccauucgcagagagccguacacaacugugugucucauuuggugcucaugacaaaugcugucaggucagcagaacgguaaugucuucauucuccccuaguaaucaagucauagagcggggacuuaccacaggucuucugauugcaagaccuauuuuucguguaaguaagggagccuuccuucugauccuuccuuacuucaggaggagccagucuuccaaggaauaggaaccuucuccuaaaacauagcccuacccacaggugguucaaaacaaagggacccuuaaguggggaacugagcuuacacacacacacaccccccauauauuuuuggggaaagcacuaaaucuggaagccaaugauggaucuuggauuaagaacccucucauaaccugucuucuaaaaaauaugagacucaugaaauacuugaaccaggagaaaucuacagauucacgcaguucagccucuuguuuccacgacucaggaccagcccugugucuaggccuugcuuacugcagucuccuugcuucuccugccccaccccuguaggcccaggugaagccuugcuucaguuugacaugaccuuucccuucucugagcuuacagcaccagccugcauuguuugggcuacucagaugacagaaauaugcucagaaaguacccaacaccaucuuuacuaaacacuuuuauggauguuugccaugugccaggagcugugcuaaggguuuuaugugcagaguuguacuuaauguucagugaggugaguguuuuuauccucacuuuacaagugaagaagcggaguauggaagugauauaacuugcccagagucacccagccugugaguggugaggacaggcccucagccuggauagucggguucccaggugcaguagcuccaccaguacgcugggcauugcugcuuugcucaucgugguggcuguuaacuucugugagcucuuggagcgcuucuaaacgugcuguguguucuucccaugcaaaagcguuuugugcucuuacuauuuauauuguguguucaaauuuuauauauaagugaaauaaccauauauauugguuuauuuucaacuuuuucuuauggaaaauuuaaaacauacaaagaaguagacagaauuauguaacauauaccccugugugcaacuaacuugagcaauuguuaauguuuugccaauauaguuucauuuuaccuccucacuccccacaguuuuuuucuggaauauuuuauuuuauuuuauuguuuuguuuuguuuuauuuuguuuuuuugagacagagucucgcgcuguugcccaggcuggaguacaguggcacaaucuuagcucacugcaagcuccgccucccggguucacgccauucuccugccucagccuccugaguggcugggacuacaggcgcccaccaccacgcccggcuaauuuuuuguauuuuuagcagagacaggguuucaccguguuagccaggauggucucgaucuccugaccuugugaucugccugccucggccucccaaagugcugggauuaccggugucagccaccgcacccagccuuuucuggaauauuuuaaagcaaaugccagacgucacgucauuccaccuguaaaauacuucaguguguauuucugacugaugauaccuuuuuacauacuaaucccagauacauaucauuuugaacuuauuuccuucaacauuauuuucugaaauuauccagguugauacaaguuacuccugagcuauuuuuuuuaagagaugaggucucucagucuguugcccuggcuggccucgaccuccuggugggcucaagcaguucuccuacaucagccucccaaauagcugguacuacaaaugcacacgacugagcauguuuaccuucuuuguagaacaucauuguaugaaucuaccauggugucuuuauuccuuccccucauggaggacauuuagguucuuuccauuuuuccuuguuacagugaugcaaggaccaucaugguccauauucccaugugcccacgugagagaguuucucuagggugcagacuggaaguggaauuccuaguguauagaaaauacauaccuuuaacucugcuugcuagaucugauuuccaaagugcuugaguaaguuuacgcucagcagcagugugugaaaggccuuuguaguaguuuucuuuuacugguacaacaaauuaucauaaacauaguggcuuaaaacaacacaaauuugucacuuaauaguucuguaggucaguagcccaacaugggucucauuggauuaaaauccaaguuuaauuaagggcugcauuuuuuucugaagguucugggauaauuuaaguuguugguggaauauaguuccuugcagucauucguaggacuaggucgcuauuuccuugcuggcugucagcugugguuggcgucuucuagagcccccugcauucuuuggccuguggccccuuuucccaucuucggggcagcagcagcagguccagccccucucacaccucccgucucuccugccugacauuucucugacugacucuuccacuuugaagggcucaugaggauauuugggcccacccagauaucccaaauaaucuccuuguuuuaaguucuguagucuuaacugcauuaacguuccauuaacaacauuccuauugccauguaauguaaaacagccacagguuccaauaacugggacgugaacauccuuaucccuaauagcuuauaaauacauucuuuguuuuuuuuuaaucuuuuaaaaugauauuuuuaagcauaaaguuauacauauguaguguauauauaugauaaagaaacauacacauauauuaauguagccaaauuuaucaaucuuguuuuugugcuguugccugcguuuucuuccaugcguuucauauuuucaguguuaaacuguuugggauuguuuuuuuucccuguauagugucaaguagauaucuaauuuaauuuuugcauauagauagccaguccuccuagcuuuauauacugagaagucgauuauauccucacugauuugaaaugcuucucauaguucaaaguaccacgugugccugauuugguuucuagacucucuauuucuguugcauuggucuuuguugcuaaaacuuugucauuuuaauuuuuccuuuuguuuuuaucaacagugaauaugauauuuauggguucaggacuguaccugaggaugaugaggaagagaaauugguugccaagguccgcgcguuggaucugaagacucucuaccucacagaaaaccaggaagucuccacuggggucaagugggaaaacuauuuugcaaguacagugaacagggagaugaugugcucuccagaguuaaaaaaccucauccgugcgggcauuccccacgagcaccguuccaagguguggaagugguguguggaccgucacaccaggaaguucaaggacaacacugagccuggccacuuccagaccuugcugcagaaggcgcuggagaaacagaacccagccuccaagcagauugagcuggacuugcugcgaacucugcccaacaacaaacauuacuccugccccaccucagaaggcauacagaaguuacgcaauguccuccucgccuucuccuggcggaauccagauaucggcuacugucaaggccuaaacaggugggugcacagcacaaaauguucccauuugccauuaggcaacuuguaggcaccggugcugccuggcagcucccucccuuccugguuggccaagaaaagucaauauuuuaagagaaaaaaguaguugcagcaagccaguuuucauuacacaauauccccaguucuagaagaacugagagaaaaagcaugcuuuuagaaaguauuaagaacacaagaguuaaauucauuugaaacuacuuggagucucauuuuuuccuguuuguucucaucgcacucggguuuugaucagaaguuugauuuuauuaguuuguaaugcauggaguggaaauugguggucacccguuguuuaugcaguauacaggaucuuuuugugaaucaagagguugccccaaacaauuauucagcugacugaaacuuagcccuucauggacuuaaacuuguuuccuuuuaaacuagaacuuuuaacaggucuugccuacuucccuacuuccauaggcagaggaugccgaaaagccucucauguuuucugggugauguaggcucauccuccugagcugugcagggaugggacaagaccucaggaggacugagguuugcuccccacaaagcucuuccugucacuggacuuugcugugacugcuucuuaccuggcuggcgcgcuuucugcuuacugcuguccuugcaguuguccauuuauauuucuguguaaugaaaguagguaagcaggcuuguuaaaaauauggauaaagguccagugcaguggcucacaccuguaaucccaacacuuugggaggccaagguggaaggaucgcuugagcccgggaguuugaaaccagccugggcaacauggugaaaccccgucccuacaaaaaaauuggcugugugcggugggucacaccuguaauccuggcacuuugggaggucgaggcaggcggaucaccugaggucaggaguucaagaccagccuggccaauauggugagacccugucucuacuaaaaauacaaaaauuugccagacgguggcacaugccuguaaucccagcuacucgggaggcugagguaagagaaucacuugaacccgggaggcagauguugcagugagccagcauugcaccacugcacuccagccugaacaacagagcgagacucugucuaaaaaaaaaaaaaaaaaaaaaaccaaaaaauuagcugggcaugguggcaugugccucuaaucccagcuacuugggagguugaggugggaggaucgcuugagcccaggagguugaggcugcggugagcugugaucacaccacuacacuccagccugggcaacacagugagacccugucucaaaaaaaaaaaaaaaaaagauauggauaaaguaagaaugaaaaaguucugcauguguaccuuaggaauucuguaagccaugcaugagcuggaguucugagugcugacguuuguuauggcugcccacaggccuuuuuugcuccugcuccaugccagguauugaccuccagguaaggguuuucuauuugugucugaaaugagaguacugcaggaagaaaggauuuuaagcuggaauguuauuugguuaagaccugaaaccaaaugguuuucaguaagucauugucucugugguggugaggauagggcagccucucuaugugcccucagaaggugaaagggacuauagcuacuccuagacagucuccacuuuuaaaaagccuguaaguaggauccugccuaauaaagcaguuuuguuuugcuuaaagccaccauucacauugcauacucaaucuaaaaauuccuggaagcuggaaacccgugaaacucaggguccuggugaggacuugaguaugccuguuugggguacaguaaugcuccauuuaucuggcauugucauggaaucaguuuuuuccuacauaaaugacacuuccagauaauugaagcuuucugucuacacuuccgcccucaccaccguuaaaaccucugaauuguaauucuuugggauuuuuuucuucacaguauuugguacauguucauggcuucugagcacccagaacuuuagaaggacaacuguagccuugucuagaugauggugauucagaccugucaucuggaauauuggugaauuuaagugauguccucaaaggcucugucgcuuucagacucucuaccccuucuccuggcgccaucgaguccugucucucaauuuggugucucugcuugcgugucuuguuuuucucuccucugucucugccaguggucaccauucuccuuuccaucccaucccugcauacuugagacauccccuuccuggacuuuuuuuccauuuaauuugagaugaguucauuauaguuuuaucuaagaaaaauauucugagaaauggcuucagggauuuucccaugaguguugcuuauaagcuucgugugaugggcagaaguuuuggauuucagcugaguagagggaggccuuucucucaccucuuccuuuccauccugcugcuccagauucccgcuuggagccauaccagggcuauugauuagugacagcauguaaauagcugaccccaguuuccguuaugaacaacaaagcaagugagacacaugguccucuuccccugcugugcaugcagugggcacagcgcuguuagcuccuuuggggugcccucaucugcagcccauuuuauuccuucagccuggaagcaggaugguguugggaaagcuguuuuaaaccauucuguauucuuuguuacuuacauucacaucuggaauuuuugugcauaaaaggguuauuuggaacuucuugaugaacucaaagaaucagcugcauuugcaaaaaucuuuuuuuuuuuuuuuuuuugagacggagucuggcucucucgcccaggccggagugcaguggagcuaucucggcucacugcaagcucugccucccggguucacgccauucuccugccucagccucccagguagcuuggacuacaggcgcccgccaccgcgccuggcuaauuuuuuuguaucuuuaguagagacaggguuucaccgugucagccaggauggucucaaucuccugaccucgugaucugcccgccucggccucccaaagugcugggauuacaggcgugagccauugcgcccagccgcaaaaaucuuauaaugaaaacuuuuuuuuaaugaggcuggcugaucauugggaaacaauuucaucuuugaacaaaaaccaaaugaaaguggggaaaaguagcuuugcuucucaaauuuuaggaaaugcacccccuccuuuuuuuuuuuuaaugagacaaggucuuguucuguugcacaggcuggagugcaguagugcgauuaucauucacuguagccuccaccuccugggcucaagugauccuccugccucagccuacuggguagcuaggacuacaggugugcgucgcuacuccuggcugauuuuugguuuuuuguuuuuuuagagauggagucuugcuauguugcccaggcuggucuuaaacuccuagccucaagugaucuuccugucuuggccucccagagugcuaguauaauaggcgugagccauuaagccagguccuuauuauucuuuauuggagaacuagaaauaauuuuggccaugagagaaaaaguggcuuaaagcagauggucucuguggagacuguaguagcagcugucugugccugggcucucaucuuguccucccuuugcuuguagguugguggcaguggcccuccuguaccuggaacaagaagaugcuuucuggugucucguuaccauaguggaaguuuucaugccucgagacuauuauacaaagacucuuuuaggaucccagguaguucugaaaauucuguguuuuagucaccacuuuuagaauugcagcugaaaugugaccugaauuaaaccugcggucagggugagggguugcuuuguguaugugacuucagagacugauuccugaagacagcaggccacaucucagaggcuguccccagucauggccugcuguuugugacugaggccgaguugggcucauucagcccccugcgaaccagcagagacagacccguccugcaggccuaacauuguguucacugcucugcacugucuuccccggacacaggccuaccagugggcugagucauaauccaggugugcuugggugacugguguguuagcucaggcucucaagaagcaaugucaggcuggaaugagacaaaccagagacuucggcggggggaagccccuguggaggacaagggacagagaaguuccagccccaggaagggaggaggauggggaggagagucccagacccugugcagugaccaccaugcaguccugaggaagucugggcagggccaguggggagcccucaagccaagggcagugaccaaggcaccugccuccacagaugggcugcauuccugccgcugccgcacccaugcccugcugcugggaaugaacguggugaugcaccagaggggcagcaguggggccugcagucaccuccugcagugggagucugaguggcgcauuucaugccauccacaccuggagucugacgccaggggccagggcagagugauaagggcugggagagcccaguguuucugccuuugcuugggacaguccuggcccuggaccagauccuuggcccuugaaucaucccuaggcugggcuggggcugcugccagcacuggcuuccccguaagccggcccuucgcauguggcccagacucaggcagcuucucucuuagccacagcuguccccgugugugccugcccugucucgugucucuucuccaggucugugcccccgccuggccugccugcucacagccucuccuugcccuucuccugcaccacuugguguugcaaggccuggcccugcaggccagcgggaggugcuggcaggagacugaagggugacaggagggacugaagggguuuucccucuccccaucucgggcacugccucugaagguggcuuugucuccucugugcccagcuccuguccgguggguccucugugccaacagcugaccccaccggcucccuucauugcuccccugcaggguggcuuucugcccuugcuauaacucugggcugccucacugucagcuguuuggcuucucagcuuuucucucaccaguguggccagccccuggaugacauucacucugugacacauauuuagagggauuucuguuuuccuggcuggacccugagcaaguguucuuugcauucgcauuucugccuuuggagggaggguccucauuauugccuccuguucccgccugugcuccucacaucucuagcuccccaggcuggaaacucaagccauccuggacuccugccuccuuccccuguaucccugucgucaccauuucuagugcugccgccugccuggaagcuuacaucuguguccccuuuuugucccuuucaccacaguggggccaccggccugucuccaucacugcaguugccucucuccuuucuuccugcugccacucacccacagcuccaguuuaaccucugucucacucagguauucagucucaucccucugcugcuguugucuggggcuccucaggguaaagaugccuucgaacgcugccagggcccuccuuccugcccgcugauggggcguguguucucugggcaugcccauccucuggguacucuccuacauaaucccucuacuggaacaacaucccaucgcucaucucccugggaagcuccugugcagccuuagcacacaggccaucuccuuugugagugguccuucccgccccaaggcaggcacgggccccugcugcuguucccgcugcucgggugcaggccuccaggacaguggccaccugauuggaucauccuugugugccugcuuguccuccagcuagucagugguaccugagggccacggcccugucuuuccuuuuucuuucuuuuuccuuuuccuguaugccuggcaccccacacaguaaauguuugaacuuacaugagcuacucuuugaccagggaaagagaguuggcauuuacugagcccuggccccgugccagcagcuguacaacugcacagagccugcacgcuugagccaucaguaucccuauuugacuugggagaaaacugggagccgaagacacuaauaagcaauuugccugaggugccaccgaugaggggcugagcugggguuugaacucaggccucugcaacucugggccuaaacuugccugucugugcccacggccuccuagaacaucacaggaggauggcaagagagcuggagcucucaccuucccagagggugggcuuucgccacagcugcccccuucaggucccugucccaguuucucagaugucaguggaucccaggagaagcucaucuggucucccugugauugcuucacuugcuaauuacccaagaaauguauuguucuguugcguugguguguaggaaaugaacagcaacaggaagaggcagcagucagucgggugggauuagagggucaguaaagaaaguuuuguguguucaugggcaccugaaagcuaauagcuuucaaagacucaaauuuaaaauaucaaaugacucaauguuucagaauaagaaaaaugaagcauugaucuuucuuaauuccauugagguguggucaagcacauugguuaggaacuuggggggagggucacauguaguagaucacaacccaggcccuaccuccugugagcuguggagcuuggacacaucauuuaacaucucugugccucaguuuccccauauguaagaugagaguaauaccccccucacauagacuuuugagguugaauugagaugaugcauuaaaaaaaguugaauguaaugcuuagaacauuguaaaaacucaauaaaaguugguaguauuguuauaggggaagaccuauuuuaaaugucuggauuuaagauaaaauuugcaucacauugucacauaaacauaaauguaaaaucuaaggagacuuuuuccccccugacuauacaaguaauagaugaucacuaaacagaagucaggcaguauagaaagauguuaagaagaaaaugaaaauugccuguuauucuaccaacuggagaaccgugguuagcauuuugauguauuuccuuuugcuuuucucccccuaguucacauagguauccaaauugagagcacaguguauccuggcuuguucacauuauagcaugagcauuuucccaugucauuuuauacuguguacccauccuauuugguggccuaauauuccaucaggugggugcuagaauguguuuaauuauccucccacuuaucgauggccauugcguaagguggcucuuaaaaugcggauagcuuugagugugcugucaacccugagcacugggcuuugccaaucacugucaaacugccuccugccagaaccaagugcccgagccccgugcccacugcuacugcaguccacaugcuugucagcuuuuccauucauuccaugcuuugagugcauguucugugccaggaccuugcuaggugcugaggacacagagaugaaugacacagucauuccauguccuccagagcucaguggaggagggagcuugaacagaggccagagcaagcguuuccuggcagccugcuccacaccagcccuccgccaagcacccgagcagccuuaagagugaggcacagucugccuccuaguugggagaagagauguguacaaggaucuucucccaugucagggccagcugauaugccccucccucuuggacgucugcagcuggauacuccaggcugaaugaauuacaucaucauuagcuggucuuacagugagccguccaucucccuugccacuuuacagcuccugaaaggcagcuccuggcugggcaugaaguauaggaaaauauguacaguuaacccuugaacaacguggguuugaacugcauggguccacuuacauguggauuuuuucaacuacacacagauugaaaauacaguauucacaggaugugaaacccucuuauacggagggccagcuuuuuguguauacaccaagggaugacuauaguuguuuuuuacacuauggauagagaaauugguuuaguagguugguacuagguuuuuauuuuuauuuuuuucccauaaaauccaauuguccaauugauuagaauuaaaagcaucaaaguguaguccacugugugagauuaaguauuguuuugugaaacauuuguuucuguuuuguacacgugcauaccgguucacguggagugggugaugguugaagaugcauguuuuuuugugaggaaagccccuggcuaggaaagccccuggcugacaggauagcgucuugacuccucagugugacgcaggggugucuguggccagcuucugccuggcugugcugccucaccucccagcccuccugccuggaagccugagcucuagcuguaggagcgguuucuccucagugcuuggcggggaccuguccaugguuccacagggcuguaugaacacaucguuaccagggccuggccaugguuaggaugguccacgugucuggccuucccuucucaucuuuuaacuccuugaggucaggguugaacuuuauucaacgcucugcccagcacuggccccgugccugacacagaguggcaguaaccagguauugcucgucugucgugcgcagguaguuuauauaagccucauuuaauccucacaguaguccaguaagagagagguaauuaacuauuuuccagaugaggcacagagccguuuagagcauaauuugcuaaaagccacccagcuaguaagugguagagcugagauucagacucagguucaugugacgccggaguccucgccacccccacugcacaugcagcccagcaaauguuuguugaauggauguggugaugcugcuuccuuuuuggaagcagaauccccaucugcccaggauucuaguuuguggcccuuugugucaacaucucacguauuuacuuguggauuggcaaggcugacuguccuaccugcugcuugcaguggccuauuucccagggcauuuugagugcaggaguugguuucagguuacagacuccccuacucccaugcccuguggaaagcaugcuguucagcggacacucgguguguaccugcagugcacgaggucagcgcugcuggaacauaguagucuggcuccgugaugggccccacggugcauuuggaacaguugugcugcugucacuugggcuccacccccaggcucucagguugcgcgucugcucgucugcuuacccggugaccuggcaggccugauacacuucuccccuuuguucccucuccagguggaccagcggguguucagagaccuuaugagugagaagcugccucgguugcauggccacuuugaacaguacaaagucgacuacacucucaucacuuucaacugguuucuggugguauuuguggauagugucguuagugacauccucuuuaaaauaugggacucuuuccuuuaugaaggaccaaaggugaguuagcucagcucagcuauuuucagauauacacacuugacaaccgucagcagcguugguggcgguagagcggcuggcucaccuggaacuuaugaggguuaccauggugcccaagggaucucagcacggccugcacuagaucuggguccaggguaucaggaaaccacagucauuuguucauguaucagaaacauucaacccacaucaagcccugugauaggcgcugggagcuauggcuuacaguuugagccugagccucaccaucugucaaauggcuggugguguuaccccaucauauggaggaggagauggaggcccagagaucuaauaagcaggggauuaggggggcuaaugagggggacuaacuugggggagccaacuucagagccuuacugcccaugagccucccacccgcucuguuguauguuuuuuaaaaaucaguuuuugaauaaggaauauauuuacauauuaaacccuaauuguauaaacagguguuuguaauggaguggaggccccucccuagucuucuaguuacucuucucaauuuauucuuuaccuuagccgggcacaguggcaugugccaauugucucagcuacuugggaggcugagguaggaggaucauuugagcugaggaguuaaaauauagccugggcaacacagcaagacccagaaaacaaacuaaauuagagaaaguacaggcccuuagauauggggaaagcaguuuguuccaaagcugcuugaacuugcaagacuaccaggaguccauucccucuaaccucuaauguaccccaaacacaaauuaaaaaaaaaaaaaagaaaggccaggcacaguggcugacacuuguaauccuagcacuuugggaggccgagguggguggaucaugaggucaggagauggagaccaucguggcuaacauggugaaaccccaucuguacucaaaauacacaaauagcugggugugguggcgggcgccuguagucccagcuacucaggaggcugaggcaggagaaucacuugaaccugggaggcagagguugcagugagccaagauugcacugcugcauuccagccuggguggcagagcaagacuguaucucaaaaauaaaaauaaaauuuaaaaaaaacuccuucgcuaucuucaaaagugcaccaguugagauggaaacagccucuguaggugggacuuucuaagaguuucagaaucagaaaaccuugauuuugguuuuauuuuaaaaugauuccuuauguuuguucuuuaugcuuuauugacuagaaguguuuucugaguaugaaaggauuccacaaagaucuccuauaaggagauuuuugguuugggcugauguguuguugaaaaccagcaggguuuauuuuccuguaauaaaggagucuuggccuagccagugaaaauugccccucaggucaauagucuuuccccagggcggggaccgugcaagccaugucccccuguccccaguagggccagcaccccccuggaguccagccuugugccuggacccacaggguuuuuccacuaacagauuucccuguuuauuccacagguuauuuuccguuuugcucuggcacuuuuuaaguacaaggaagaggagauuuugaaauugcaagauucgaugucuauauuuaaguaucuccgcuacuucacucgcacuauccuugaugcuaggugaguccuggggaguucucagaugucaaggagagcaggaagccugaccccugccuccuugagagcagccuguccuugcugucuuccaacucagagccauccccgguguacaguguuggagagggcauugcuuuccagggaaaagagagcaaggggugugagccccaaguagccuuaccuaggaggaacugagaugaggauucuguccuuuauccuacaaacauaaaucccaacaacgaacagcaauaguuucauuugucuagaaagcauuuacugaguaccugcuuugugguagggucugugcugggcacugaggaugacagauggagaguaaggccuguccuggaagaccuugcuggggacacuguugcgcaucguuugauccaugcugugguagagggaucccaggccggagaaaggccaaauaagcugggcaaggggcagcaaggaaacaguauggggacaggggguccuucaggagugguggcgcagagcuguggggcacguguguuuggggaaguguggaggcagcucagcccggcuggugccaguguggcugggccauagcagagcugggcugucagggugauugcagacuucucucaggacuugaggcuucauccugagugcugggaaguccugcaggguuaggcaagagacagacaggucagauuggggcaggacugguggcuguuagagggcucuagggggagaggugguggccuggagguagguggucccacagauggagaagggggguagauugaagagagggagggaggaauuugac

SEQ ID NO: 16080 - RNA, 1522 nt, Homo sapiens
uuucaaaaugaaauacagaagcuaguugggcauaggaaacaagacuauaaaauaugugaaggccuucaagagauaugcuggcaggagagcccuacuuaauagaaaauaugaaagaaauuagaagagggaggaagagagagagagagaauaucauuggaaaagaaaaagaauaaaagagcuuugcuuuauaaacucuggcuuauauaucuuguaguacauggauagagaaugaacucuauccuguuccccaaagaguuaaaacuaagauauucuaacuuacuggcauuuuaaaggccacagauuaacuuuauucuucaccaccuuuccuaccccucuuuagcuguuguuccuagagugaacacccacacugcccauuuauccacacugcaacucacaauucuccuuuagguuguccaacucacuuucuaugccucccugacuggcaguccuucuaugguacacauauuacuaauaccaacagaaagcauuacuuuuacaaaaugcccaaguauaacugauuacacuugguuuguuuccauuaaaaaaaagacaaggcaauugacuuucacuuuucuucuaacuacauucuugcauaaauaaagcuuuucuugguagcccucaguaugaagcggagcauggugcguauuuucuaugguuaguaaacucuuuguuucaauugcuuccaaggcaaauacauuuggcuucaacaucugcaaaguuaagcaauuaauacaagugucagauaaaugacaucaaaaucaagccucaguugaauacaaauggacaaauacacagaguacauuugauauuuaauagaaugaaucucaaagaucacaaaaugaugaguuccguuauuagcagugauuaacucugacacugcaauuaacuuuuguuucacauguaugucauggaaacaucuuuauauaugaguauuuuuacaguuguguuagguauuaauaucguaguuuuuaucucuuacucucuuucucuuccuccuccuucuauuuuucuuccuccucuccucccucucuugcucugugaauuucaucaaaaaguucuuacuucuaauuugcagggcccaacacaaaaugaaaaugaggggucccuuguucaaaaagcaggaaaaauacaccauugcauauguuuaaauauaaagauuuuucccuuuaaaauaucuauacuaauuuaaaaggauaaugaugauauaugaauaccaccauaaacuaaaaauugcaaaaaaccucacacuuuacuucauaauagagcauuguuucuauuaguauaaauauaaaugcuuaucaaauacaaugaccuuaaguagaagagaucaugggaaaaugacaccccaacacagagaagacagacacagacugcucuggcacacaaggaauagugcagcagggacucuacccaugcauccuuccuuccaucccuuuccccuaguccacagaacuagggcuaagggcucacugcaaugccauccaggaggacuggcucucuuaauggcagaagagagggcuga

SEQ ID NO: 16081 - RNA, 1849 nt, Homo sapiens
auauuaucuagaaguaugcuggaaaaauacauguuuaugugugucuaccucuguaauaauggaguguuuuucuucauuuuucucaagaccauuuaaggaaaguuauuuaagaagcaaauaaagcaagaaccugaaauuuauuuaauuuuaaaaaguaugacuuucuaaaagugagguugugggcacuuacuccaccaucaucuuuucuacuaaacugugcaucaugaauuuaagcaaguggauucaucaguuagaggcucauauuuuuaaaaaucugauguuuuauauuuuucuuguuuggagcauuagugaaguuuuucaaaaaucauuugcuacauguauacuuguguuaauaguuuugauuuauauccauaucuuuauaaauucucuuaaaacguauacgagcauuuacaauugaaaugcucauauuuacaacugaaaaauuuaaaacuuauguacauauaccugguacacuaaaaaauucaaaggaauaaauuacuuuccuuauuuugcucacaaauuuaaaauaauuccuacuaugucuuuuucaucauugaucuguauauuggaauuguggucaucagaauaucacguucauuauuuuguuuuggaaauauuucaacaucucuauucaaggacugacuggaucauguuuacagaggcuuuucaaggcgucuguucuuagccacagcugagaauggggcccaccgugcugacuggaagcauccaccuagaauuuguugaauuaaguccuugcaccuggauauaauuguuguaacgcugugcugggguuuucuuaagcuacugguaaaacaaauuagcucaauuuaaacuggcauccaguagagaagcaacaacucaccucauauaauguuuuccaaauaauuauuuuuguauugccagguuuaccucaugaauauuuuccugaggguugguugagaaaaaauguuuuuaaacuagagaugugaugaaaauucugcucauguuauaggcuuugauauuauugcaguauaauuaagauacagauaaauaugugaucauaauuucaguuaagcuggauuauuccccuugcuaaauaaaacauaaauucagauauuuaguugugaguuagagcugaagaaauauucucauaucuguauuuaaguuucguuagccauugucauauuugcuguggacuuaaugacauaacuauuuuuacaggcagaaaagaugcacguaaggguccugaucagcugaagacaagauucauuuauguuugucaguagagcuugucaucuuauuugguuaugcauguuuucagucauuuauccuuggcaauuaaauauacaagcuuucuggaaauccaguaaauuuuaaauuuuaguagcuguuaagaauggaacugguguauaugggcauaggagacuaauacccauauauacuucuuugugcauuaauuacuuaugcaccuaauacaaaaaucauaggcaccaagugagugccaggcagaauucuuagcacugagggcacagcugggaagcauaggaaauuccugccuuccugacguuuacauuuuaacuggagagacagacaaaaaauaaaguagaaagaaagacagacagagagaaagaaagaaagaaaaaagaaaggaaacaaagaaaaaggaagaauauaauuucagugaguguuauauucuaugaagaacauagugugagcuagaguauggaggaaagguacaacuagauuguuuagacagaagggcuucucugagaaaguuaucguguaucaauaaacacacaugcuaccugcauuuauauaacguuuauuucuuaauaugcauuuguauuugcaauaccuugcacaauguuua

SEQ ID NO: 16082 - RNA, 1022 nt, Homo sapiens
ucuguuuucugccuuuccguugucuccuucgacugcccccgcuaacccugucucuccucacuccuguucccuacuugggccccuuucauucagguaaaacuguaaauuucccaacgcgcuauuguucccuugggcugcccaaagcucccuagagauccccgaauacuuuuucgguauuuaaauccccaauagauaggaccaauguaaauuuugugacauucaaaccuuuucuaguucacaaaucagucacccuugucacaguuauugaaauuccgcaacucgccacaccaggacgguggaaaaagcgggcgcggucuuuguugccgaccaggcuuuugaucgccagagaaaauuuacuuaccuucagaugagugagcagaaaaagaaauaacacucccuuugauuuaguuaggaaaaugcagacauuuggauucagugcaaacauacaacacucgcuuguuuucgcgaugcggcccucgauuaaccugucuuugccuagcgcaaagucuauucaacaacugcgcguaguuucuuuuugucccuuccacaaagagccauugacuauauauuaaaaugauuguugaaagguaggggaguaugguacuuaaaagcaggaaaaaaaaaucccugugacucaaucaauuaagccgagcaacauuuaugcauuucaaaaaaugcacgcggaugcgggggguuguggggacgaagguugcauuucuccgcagcucuguuuaaaacccagcaguccuggccgaggcuuuagcugaagcgucugcauauucauuaggucuaauuauuuucuaguaaggaaaacacaaaaagccaagagucggaauccuucaauuuacccuuuguuucuaacuucauuuggcuucuuugcagcugaaucaaagcccuaaacucuuuuuccaaacaaagaaaccucaacucauccuuucauaggcggcccgguuaggaaacucaccgugccccagcgagaggaaaaugaaaaugaauauauuuuuugcccugacgccagcgcu

SEQ ID NO: 16083 - RNA, 91803 nt, Homo sapiens
cuccccucggggagccuauaaggccuccgcagcgccccgggcgccugcugcuccgugccuccaccgacgaccucacucagcugcguuacgcgccgcuccggcugccggccgcgcgccuugcccgccggcucccgcccgcaaucggcggcucagggcggacccgggucucugcguucucgcgagaagcgcggcgcugcggggccgugggcgccugagcccgcgcggcccucgagggccgaauauggggggaugcacggugaagccucagcugcugcuccuggcgcucguccuccaccccuggaaucccugucugggugcggacucggagaagcccucgagcauccccacaggugagcaccccgcgguccgccgcugucccgcgaggcucggccggcgggggggcaguucauucauccaccagcccuuccgcggggcuggccaggugaguagugggggccugucccuccucuccaggaccgccggggucuuccccagaauugcggucgggcggcgcuggucccuggggaaguguaggggcacccgcccucguugacuccuuggaguucucggugaacucagcgugcccgaauuucccugcagaacaaguuggaguuuccuuuuggacuugcaggucaugggcaccaacaccuuuccugcagcucuccuuuccccuccuuuccgagaguuggcauggauuuauccuugauggacgaggcaguacuccuucugugaccuaaacacggggcuuaguguacuuucuaauugauggugacacauuccuuccagcaccccaggaagcagccgguaacaccucccucuugccaaaaacaacgcucgcucgaaaaccuuaguuguuuucaguaaggcugccuggcuacccaguaccuccaggcggcagcuuucuuccuuugggaucugaaggggaagcuguggacacacagcugcuccccuuaccuacccuuuucuugagcccggugcugucucucguuuucagaagcuguguaaaacaaaacguuuuauauuuagccagauuaaagagaguuucaccacgucugucuaaacaugcuuugcugccuuuuguggcacaugaaaaauccuuggaguuuuccacauuugugcucuuugugcucaacucucugaaauuagaucuugcauuuaaaugaccuucuaauguccuuuuuguuuuguuuuguuuuuuguuaagucaucuuggcaccauuuuuucccccaaguuuauaauagagugcuuuucuacuugaacuuuucuuaagccuaaggacagaaauuucuauuucagaguuacauucagaaagugacauuugguuugcaguccagcuaauccauguagcgauaguuuugucuucaucuuuaaguguuucagaaagcgucagcaggcugaacugccuaucuuucuacaaaacagugcuugcuuuguuagcuugagaaacuucagcauucagauggauuucuaucaguuacaggaugcuuuucuuucuguuagguauaugugaccauuuaaaaauggauuucugaacccgugugauuccucuaaauuugaacuaaacuuuugcauaauuuaaaaauauuucuucuaacauaauaucuggaaaguagaaaguaaauacuuucagcaaauuuggaaguagagaaauuuaaaaaggaaaaacagaacaaaaagccuuccccagaaaaaugucuuucuuuguugaaacacccaaggagacuuuaacugggaaauaaaauaaccucuaaggacuuuguaauauuuagagaggccucuuuggccuuuguauauuuuauuccacuucauugccaacaccccuaacuuuuuaauagaggacaucccuuuguaucugccuuuauauuuauagucaaaaucaaauucccuucucacucuggauuuuaaauuucauggaacuggacaguaaacuuuuaauggauugugauaucagagaaagagaauuuuagguaugaaaguuuccucaggaaacgaccacaugaaacccacuguuuaaaucugaggacuggucacuugguaagcaggcauggagaauucgguuagggucgaaaugugggaaaauacuaauuugugauaggugaagccagcaguagucaguuugauuacaaauuucgguguagguagguguucucauagguuaugugauaaacuaauaaauguagagguaaacugcuugauaaagugggcagaaucauggacuguggucuauuuuauucuuuacaaguuucaacugaaaauuacuaaauagaagcuuauucguugacauaaauaucaagaucuucuauaggacccuaaauugucuagcuuaauaguucuuuaagaagagugcuuaucaucucuaacccuguauauuugucaacaugucccagcuaaccaagaagaaaugguuuaaaucacaauuucuuggcccuauugacauuuugagccagacacuucuuugcuuugagggacuauccugugcauugauguuuagcaguauccuuaaccucugugcacuagaugccaguaguauaaccuuucuaaucugagcaccaaaaaaacaaaaaaggccuaauguccccagagggacaaaauugcccaggguuaagaaucccuggauuagacuaaucuauuuguauuugaggcaauauggcauuauaguguuacuggaaugauaacagcaaauuauuuuugaaaacaaauauuuauagugauuuucaguuuacccacuguaguugggaaugugauacacauucaucaauuuuuggaguguaguuuuuccuagcucuggugcuuuguugaccagaguugagaacauagauuuuuguuaaauuuuugagaguucugugugcuguauugauuccuuuugguugccacuuuauucuuagcauggaaagacuaaauaagauuuuggcuaaaauaaucauuuucucugaaaauaacguauaggaauuguuaccugaaaauuauauccuuaugggagcuuucagaggcagaaccuucuuaaucagugccaguaaaucagguucauacccugauuuaucuuuccugcccuuucugccuucuagaugggauaaggagaagguggauguauuccugccaagucuuugccgucaugucuccagaccuggauaaaauuuguguguguuuucugaggcaccuuacuauucuaugauccaaacugggcagaaaccaaguuuugggcaaaaacaaaggaaaugguuucaaauguuucugucaagaccaguauuuuuguaccacauucauucauuuauaaacucucuaauuuacugugguacauucaaggaaaaaaggaaagguuugucccuaucuacugaugcaaaccagcaauuuaugggguggagaggaaaagagcaagggccuggagaaaccucuggaagagagagggucuuguccucuguacuuucuguauucugugcuucagccacacagaaugacauaucauccauaaacagacugugccuuuuauuucacaugacaacagacauauaaaacuacuauagagaaugugaagacaagaaaugaaaauuaaauugagcuacccuuuucuauccaacacaugggacaaagcaucuuaaaauaaacucugauuguaccaaaugucaggaugggaauugaccguugauggaagcacagugucuuuggagaacaauuuaauaauaucuacuggaauugagaauccgcauguccuguaauccuagauaugugcaugaauagcacucucaaauuucuguuccuuccuuuuuaguuuuuugaaauccuguuuauuguuuaagucuagcuccuaggaaauucuucuccuggcuauuuuuguuugguucuuuuuauuuuuaacuucuuaauguagcugguuuauacaaaucauauuuacuuuguacuauagguccuuauguuuaauaaauuguaaacucuucaaagugaagggcugaguuuuauucauuuuuaugcucuucaguaucuacacuguuguuuugccacagacauucucagguuuugcuuacugaguuucuggccuguucugagaauuaugaaaaguagcgugcagucaaugagguugcuaguuucuucuucccccagaacuuuaucugaauucacugagcuuccuuucucugcuugggaacccauaugcuacaugauuuaacagcuuagaagugaaauaucugcugccuuguuucugaaccauguuuggcaacccuucuccacggguuguauuucccgcuuuaccugcuuuacucaauacaaaguggcaccuucacuauuacuuucagguaguugggugccauaauuuuuuuuauugguggugaaauggagauuugggaugguuacauaccuugcacaagcucacauagguggaaagcaguagaagaggggccugugccccuucuucaggcugugcuugucuuuccugaccucauaauuguucucuuggacuuuugggaccuaugagaaagaaacagaaacuggccaucagugacuuagagaaacaaaaggaaagcuuugcuaaaagggaaaaggcauaauuugcagguuauguaaaaggaggagaaaggaguaggcacaggcugaaggaaaacugggcccuaggccagagugguaaauuauggcccauaggccaaaucuagcagaccccaaacagcuaccuguguuuguguggucugugaacuaacagagauguuuacauuuuuaaaugguugaaaaauaucaaaaggagaauaauauauuaugaaacaugaaaauuauaugaaauuaaaguuuuauuggcucucagccacauucauuuguuuacuuauugucuggcugcuuuggugcuacaaggcagagcugaguaguaguuacagagacuaugaggccugcaaagucugagauauugacuagcugguccuguacagaaaaacuuugccgaaccuugccuuaggagaugacauucccacuuaaguuguggcucaugccgaucugcugcucugugggaaggagcuggcuucuggacaguagcagcuggcucugggcauuucagagaccuguuuuucauuuuagaauuugccggugauuccugugguguuuugcguucaaacauagaguuucucuguuacaucuuuuuaaacacagcacuugaagcuaucaagacauguucuuugguguaaguaguguucucaugaucaaaaaugaauuaaaaacacugauggcuaguuggaaaggagaugcauauuucuucuucagagcuugaguauauucuagaaauuuguucuagaaaccugguuaugaauuuguggcugagcuccugggaggaaauaauuagcacguuuaucaaugaguauuuuuauuuuucuuuaaucauugcuauaaauuaggcuaaacugagaauuugguggcuuuuaaaaugacauauucuuuuuaauuuacaucuuacucauuugcauuuguuguagaaugcuugccuccccaaacugaacugaacagaacuaauuuucuuucuuuuuucuuuuuuuuuuuuuuuuuugagacagagucucguucugucgcccaggcuggagugcaguggcgugaucucggcucacugcaaccucugccucccggguucaagcaauugucugccucagccuccugagaagcugggauuacaggugcccgccaccaugcccagcuaauuuuuguauuuuuuuuuuaguagagaugggguuucaccaucuuggcuaggcuggucuugaacuccugaccucgugauccaacccccucggcuucccaaacugcugggauugcaggugugagccaccgcgccuggccaaugaaacuaauuuucaaagcuauugagauugcaguuaaaaauaguuaucuagaauaguagaauuauagagacuguuauuuaauuaauuaauuaauuaauuuauuuauagacagggucucacucuguaggucaggcuagaaugcagugacgcuaucauagcucacuacagccugaaacugcugggcucagaugauccugcuuaucaccucagccucccaaguagcugggacugcaacucuguuguuguuaucuuuauucugcuuaccaccuuaaagccuacauguugcaacccauauuugguaauuacacuacuaaagauggugcagcaguacagaauugauuacugcccgacugugucacaaagauaccucuucaaaaaauaguuuauaauuuaaaaauguaguaucuucaaauaaguuuuuguuuucagaguaacuuuacaagcaauucaaagagcaaagauacaucguuuuuauacacaaaaggaagauuuucauuacagauuuucuuuuguguauuaaaagagggaaguguacuuuuguuaauuuuaauuugguuuucuucaaaacaauacaaucagguuuaugcauuuacauacuuaguuacugauugacucaugcauuuuuuucaggccuugauuguuuuaguagcacauuguggcagauuuaggaaaauaaaaaucauuuuaaaauuucuauuaaaauauggauauacucccccuuucuugaauuuauuucuuaaaggagaugugauuaagugagaaaaugcuuaauuuguuaguguggaaauaugcuucauguuuacaauuucuuuuccgcuauaagaaauuagguuuaaaguuuaguuuguauagguuuguaauuaaauuuuaaccaggaaaaaaucuauaaauagcaacuggauaaccuuugcucuucauuucaagagcaauuaacacuaacuuuuuuuuuuuuuugcuguucuuuuuuauuauuagucuucucacaagggaguaucaguuucugugcaaguucaugagugauggggauacuccccaggcauuaucaauacagaagugacaagguauacuacauuggaguguccuuuccuuuuuugguugaagaacuacuguauuuauaauaaaaaucuacaccagaaguuuaaagaaaaaaccguauuucaaguuugaauacaauaaagaacaugauuauuacuguaaauauacucaauagacuuuuaauacaaauaaaagucuuggugaacauauggcuaaaaugaggggcuacuugaggcaggaaaguggucaggaaaaguguuucauauaaacauuggugaauuuucaaaaaugggccagaguugaaauuaaauaucauuuguuacacugauaguuuauugauuuuaauauugcuuuuauuaucuugugugcauaagacauccuggugcauuaacuaaucaucugcucauuuaauuugggguuauauucucaaauuuuuacaaagaacuuucucauuugcuuucuaguuacugcuaaccuauuuuaggguuccuuccaaacgguaggugagagauaggacuuuccucugauuuaaaugcuguuuuucuuaucuuuuuuuuuuuuuuugugcuguggacagguaaaaauucuuuauggaacaaaggaauuuucaaguacacauaauuuuuauuguucuugacaguacuccuggucagucucggacacucaagugcaguaaggagauacugaauaugcaucaugcuccacagcuugacccucccacaggcacagcaacaagcgaaauagauauguggauuuuggcaaccuuggcuuugugaugcuagggcaucgaucuggccugggagaagaaaagcuccagaagcuauacuuuauuccagagccccagcacacagugucucauaggcaaggcugcucugucauugacuauucuguuuuaaaugguuugaagccacaacuuuugugggcuuucaggugcgaaauacuuaacagaugcugcacacagggcuaagaagggggccaguaacauuuaggucuuuuaaaaugcauucucuaacagguucuuuaaacauuuaaaucuuuccuuccuguuucuagcaauguacuaaacaccaacagcuaucucaucuuuaaaaauucugcaaauacagaauuuaaauuauuucuuuuugaaaaaaggaaccagcuaacaguuugcugguagacuaaaaugaucuccauaaugugaucaccuggggaagucuuagagcgcuguuguuaugaagagggcggauggguucuuugaugggauuuuccggucuuguccaagccagcucugaggcaccuugucuucagaggccucuucuccugcucuggcuaugcugguucuuuccuggccuccagcuggcaccacaguggugaccagaaugcccugcugguccagggccucuggaauuccugccggccacgucuagagaaggacaauccuccuuuucuucuuaguuuaguuuagacaagguuggaauuuuuuaaacagugacuuuacuaaguaaccaagggcaaaacaaaacaaaaccucacacuggaaaaucaccgaagcaaagaaaugaacagacuuacaaagcagagauucagaguucuuacucuucucugacuuugguauaguucuguauugaaauucuaagauucuugcagggaaaauaauguauauauaaaacugagcaaaucaaagaagcacuuauggguaagcaaccuggauaccugcacacccagcacauuuugaggguucaugaauucuguguccuuguccagcguuucuuucuccccucuucacucucauuccucacuucuuccuaccacuuucuuuuacacagaugacucuucuccaugauuggaguccaugagauccauggguagacaagugguaauagauggucuagguauauuugucauuucuuagggacauauuacauuacauauuagcauaacuguagccauuggacacuuaauuuucuucacuagauagaauuuuuuuuuuuugagacggagucuugcucugucguccagacuggaguggaguggugcaaucucggcucacugcaaccucugccucccggguucaagcgaugcuccugccucagccuccugaguagcuggcauuacaggugcgugccaccacggccagguaauuuuuguauauuuaguagaaacggggguuucaccauauuggucaggcuggucuuaaacuccugaccucagaugauccaccugccucagccucccaaagugcugggauuacaggcaugagccacugcaccuggccaauagguagaaaauuuuuaugcuguugcccaugacuauuuuuguauugcuuuaauucuugauuuuaguagcaguuuguguaugcuuuuauaaaccuauauaauuuaguaaaucuacauuaguuuauuuagcuaagcuuuacaaauucccucauaauacaacuuuuuuagagguaacuaacagcauuguaaauuuuuagaugcaaauguaugccaacaauaauucccauuguguaauacugugaaauuuugguaauuaauauuuuaaaaaauaauuggaguauuuauugacuggcuagucuguguucuguugcuuugugugaaggaaaaacagaaaaaacaaaccagaaugaacaaacaaaaaccacacaaggcucaguuccuguucuguauugaaauucuaagauucuuacagggaaaauaauguauguauaaaacggagcaaaucugagaagcacuuacggguaagcaaccugggcugcagggaagaacacacacaucuggcaucaggaaaccuacaucuaaguucucauccuuccacucaccaaccuugagccgauucuugagccucgucagauuuuacuuguaauuugugauccuuacagugcugugauuugaugucucuugacuuuuuuuuuuuugaaacggaguuucguucuucuuguccaggcuggagugcaauggcgcgaucuuggcucacugcaaccuccgccucucggguucaagcgauucuucugccucagccuccucaguugcugggauuacaggcaugcgcuacuaugcccugcuaauuuuguauuuuuagaagagaccggguuucucuauuuuugucaggcuggucuugaacucccaaccucaggugauccgcccaccucagccucuugaagugcugggauuacaggcgugagccaccgugcuuggccaaugucucuugacuuuuaagugucagaauggugguagagacagagugcugcaggaaucagaaaagaggucucaagaaaacuuacuauuauuuguuaggccaaagaaggcauagauauaagguuguuuuguguuuuaaauucuacuuuuucuacugguuguuguaucaagaucuggacuuggccaggacuugguguugcuuuuuucucuuaauuagcuuuugauuuagaugcaggacaguaggccaagaauaacuagaauuaaauuuacauuuaaaaagguuccaaguguuuuuauaugagaagagaaaacaagucugguguuuuuaugaagcuauuuucuguuuucagagaggaaccguauccucuucaguacauuuaaauauuguaugcuguuaaaaaaauaaacuuauauucaucuguuucaguccugaccuuuaagucaaauaaauuaauaacaauuaugcugguaacuuuuuuuuuuaacuuuuauuuaggguucagggguacaugugacgguuuguuacacaggugaacucauguaaugggaguuuguuguacagacuauuucaucacccagguauuaagcccaguacucaguaguuaucuucuuugcuccucugucuccucucacugucacccuuaaguugagcccaguaucuguuguuccuuucuuuguguuuaugaguucucaucauuuagcuuccacauauaagugagaauauucgguauuuggauuucuguuccuguguuaguuugcuaaggauaauagccuccagcuccauccauguucucgcaaaaaacaugaucucauuuuuuuuuuaauggcuacguagaaguuaaaacgaaguuuuaugguaugugcuacuuaaaaauuggggacccuuuucuaacuuguuacauaaauagucaucagaauaccuagauucaacuuuuggauucauuaauuaucuuuaaaauaugauugcauuuagugaacugaaaacauggcaaauaaaaacgaaaucaguuugugggagcaaaguauuuaugugcauacguauauguguauauguguauguacacauuuguguuuacuagccauggagguuauuguugagccuuaagaaaggaauagaaaguaugaauacauuuuaaucuggacuucuuugauaucuugcuaggucauugucacagcagcauuuguucuacauguguuugcaucuuuagaauggagcauaucuagugagugguacacucugagacuuaauccuuggagaagaugguggugugcacugcuuuuuuuucuggcuauuuuuccuacuguuuccagguggauuuuauguaaauugaaggaagcaguucaagcagaacaacuggaagggaaagagugugacuuaauuuuaaaaacauauauaguuacuuauacaguuguuuuuuacguguaagauuagcaaauauuaacagaaguauuuagccuggguguugguuuuggaaauuaacuguuauuuauugaauaagcaaauaaauaccaguagcugagucuuuuguacaguauauuagguugaagaaaaauuugguuuauuaaaaugauaaacuuuuaucuuauuaauaucacuugauauuuuauguuccucaagcauaaacauauuuuuuuaaaaaaugaaguauuacauuuuaaacagcaaguaaauauccuaaaaaaccgggcuccuucucacugaauggcuguguuacaccaguacugucagcuccauggguuauggcagaguggauaagugagauuuuuuuuucauguugagauaaaagauaaacuaagaagucuacuuuugaaccauagacacaaacuuaaaaaauaacuauaauugauaauuauaucugauuuucuauaaccagauuuaaauucuuuauugaugcaagacaugaauuuuucuuaauaauucucagaauaucccacacuuaaauuaguuuaaaagcauauuugguuuguagaaacuucuuucgaaaaagaguccuauucaguuugaagaggugaugggagugagagggucagugaaauagaggaagggaaguugcuuuuaagugugguacaaaauuacaaaauaugugacuugaaugaguucacaauuaauucagaaaaaucugaacuagaagccacugcugagugcuggcaagggaaauuaugcuuauguaaaaugugacacugaauucuucccugaacagaaauuugguuuggguaguuucauccuugggauuuauuucuguggauuaugcuuauugugguuguagcauuucauauuaaccguaacaaauggaauaucccagccauucuuugcaugcuaugacuuucagccuaugguccagugugcauggacccucuugcaacauauacacugagacaguguauagugcugaauuuguuuuuuauuugguuucaggaagucagcugguuacuucaguaaucagcagagauucagaaauauagauguuguaauauuaugcaaccauggauguguuuuauaucacuugguauuucugauaaauugagguacaagucuguugugcuuugaauuauuggagaguuguguuauuuccucuuuuauuaugauuaaguguauuacaaagaauuugaggaugauguuuuuaaaauacuaggguaaaugcagaaacaguacagaggaguguuugcuuucuugauauagccagagggcgcucacuauacaaggagacuagagaccucuaacuuugaacuucaaaacuuugaagucauuuuuuucucauuccucugauuuauucuucguauuuagguauagugcuuugcucauuauuuugucucugucuuuuuuuguuuguuucaucuguagugaaaagugugugugugugugugugugugugugugugcgugccugccugccugccugccuguauaaauaauuagauaucuauuagauauuugaaacggguaaagauuauuuuuaacaugaucuuaauauuguuauugcauucaacagugauuccuuaauguuauuuaauaccuauccaaauucaccuuugccucuuuuucucaaguaugucuuuuuauaguugguuuguuugauccggauccauaaauuuaucuuccuaaacaccuuccaagcugucacuuaccuuagucuacacugcaggacucugguagcuucagggucaaaucuagccuaaauauuguuuuucaaaagccucaaauuaaguucuauguuucaggaaauuuuacuuaaaaaucagaaucuuucuuguuuuggaggagaaaaaaggaaaagaaggccuggaaacccuggguuuuccuucccguauggcaacaacagcuggcugacucugagaaguccucuccuuggauggggugcuugugcacuccagucaccauagcaggugccuggccucuucacugauguguuugcagcccccucucuguauacaucacugaauuagauaauuaucauuguuucugaaauuauuuuucuugucucaucuuucuuaaguccagugacucuucgcaugcuaugacuuucagccuaugguccagugguuuuguccccccuggaauauuugguaacgucuagagacauuuuguuuugagcagugggugcuacuugcauccugucgguugaguccagggacccugcuaaaguguccugcauuacacagcaugaccccaucacucucucccagccccaccccaagaaagaauuaucuggccccaaaugucaauagugcugaaguugggaaacucugcuacagucugauggcacacuucuaauuucacugccccgcuucuagugucuucucuauuuccaaauguauuuauuaucauuucccaauuugcacucuguucauacuggauuccucacuauccagucaagagaucaugcuuuuacacaucuuuuggaggaggggggauuauauuuccagguuccuugacugugaaaauacugucugucauuuuuuaaggccugaacauagauauauuaagucuuauauucuagugauuuuuuuguagauuuuuauuguuccuucaauguugaacuccuacaguauucucugcaaauauauaaucugugauuuaaauuaguauuuaguauguuauucucagucuuuucauaugaacuaacuuuacauucuuaguuggauuuuaaccugcaagaggauagagaucguaucucuugaauugcugugccuuagaacucccaaccucggaagcuucucugccuauaggccuuacagagggauaguccauuaacccauggcuugcccuagucacaacuaacaagauaagcaggaacccuauguuggucaggguucuauucaaacgaagaacccauuuuagauaucuugagcaaaaacagauuuaacaaaaguaauuacaagcuuauacaauuacuggaaagccuggaagaaugggcuuuagcaaaacuuucagcagugacuucuagaauagcagaaauagcugaccaaacuaggaggcuacuaccucugucccagcggggaaucaggagcccaccauuggaaguauugaauucagaaauaggcuuccauaaauguaacccagggauggagaagcugucucuguugauuccuuaugcccaugaggcagugacuauaccaacaaugcagaauucagccacagccuuugcugcuguccauaugucugucugucucucugccucucucucucuuucucucccucuccguccacccgcccuccuccccaguucccacaaagugugagauugacccuagaacacugguguaggguaaaccguauccuucugaccaugcuuaccaauggaaauggccaaaagugauagggauaggaccaucuguuuuucaaaucucacaggaauacaucuuagaggagggguauaauuuacauccaaauguuuagcuccaaagaacuuggagaaaugcaccuuuaauauuugauuuucucaugacuuuuucaguaauuguucuuccugaagcuuggcaaagcauuaaauuauuuuaaauuuuuauggauguuuuugacaauagggacccaaguaagggcuuagcauuacaugaaauacaugcuuuuuaacguggagcucuauuauaaaguucuaagcauguugaauacuuugucagcuuuuaagaagaccaauuucuaauaaagucaugggaaaaaaagaaacuuaugaaauagaggcaacuaaguaauagaaauuuauguccccucaccauccuuauuguuuugaggccaguggauuguaacuuuuauggaagagacggcaugguacaacuuaauccuaauuacaauuuuaugauauuuguuugacuuauucauucauuucuuauuuacuagugcucuuauuuuauacagcacccuauaacuuucaguaaauucuuagcugacuagugucacuuuucugagauaaaaguggggcuuacucacagcuucuggauuuugauaaugucaguaauaaaauucuggcucauuaaggaaggaaggauuuaauuugacucagccuuuuaaaaauucaugauaacaaaaguacaaaagaaaacuuuguggacuaccauaacuguacuuucuaauuguaaauuuauguuucacaauuuuuauuugaaaguuugguuuuuauguaauuguuuuuuacuuuuguaguuucuuugcucguaacaguaacuauaguuaagcuuauggcugaaacuccugcugaacaaaucuacagaggaguaucuugcauucaaauuagaauguugaucuuccucacauuauuuggaguugggacaccccaacuacacaugguauuuauuuauuuuaaaauuucauuuguuuugcucauugugauaauuucaggugguagguagauguaccuuaguguucaaauuaacacauagacaaaacuagauugggaauggcuggauuagauuaauacaugccuaucuagguuuauuaugucaccauagcaguuuuaguuuuugguuuuguauguguguguuuaaaaugauacagcuaaaaacauuugcuuuuauuuugaugaagacaaaaauauuuggggaaucuggauuuguuuuggugauaugccuaggauguagucaguuuagcccuucaaaugacguuugucaucuaaauuauucugaaagcucuaguaagaaaugacagagcuccuauaagaaauguugaagcaccaguagaaaucaguaagaacuaggauaugguagaucuaaugaagauggcauaacuucguuuaagaguuguauuuucgguuacaaugacaauaaaugcuuguaacugaaaacagagauaguuaagaauaaauuuaaauuuguccaugaacacacuaucaauuaguaaacaauguaaaacacugugauaguauucauuuuuuuguuuguauaucuucauguauuuucuuuauaaaaucaagauauacauacauauugauaaacaauaaagccacaguuuuguauuugucuuauuuacaaaauaguauauuuuaagcauuucccauggcauugaauauucuucaagccaugauuuuuaaguaacauuuuuauaucugucacgggauuauaccauaaguuuuauaaccauuaccuuauucgauauauagcuuguuugccauuugacacuaacaaaaauaauauuguaaggguauuauugaaaauaaguuuugguuuccauuuuuaccuauuuuuauaggaaaaguucaugaaacaaaauauuuaaauaaaaagauauguacucuuucugucucuuguuacauauuguggaguugauuuccagaagguuuuauggauuuucacuuccacgagcaguguacaaaaggguauggaaaucuuggcaagcauuacuuuucaaaauacuuucuucaagguuuuaggggaaaauagugucugauucucuuuauccuccuuuuuuauuucuuaaauuuauagugauuuauuuacuugcuaaaauauuuuuugccacuucuguuucuuaugugaguugcauauucguaucagugguguguacauucuaguggaguuagaaaggacgguaaacaaauguauugggaagguauaaaucuuaaaaagaaaaauaaaaugagauuagagugauuagguugaagaauaccauuauaaguacuguuuucaggagaugcuuuuuaucuuugguuacauuugagcauagaaggguggaggcuuucugagagaggaggauuacaggcagcggggaccacaguauaaacgcucuuagcugaggauguguuugaugugucugcagagcagccaggagaacagugugccugcauuagggacaaggaggggauagugauggaagagaucagauugacagucaagaccagaucucuuagguacuuggaguguggacuaggguaaggaguuuggauuuuauugagaacaagagguaaacccuuaaaaaaauuuggagagaaacgcaagauaugugugugaauuagaauagguuauuuuaucuggacuuuugguuggugaauguaguacaggcugauuucagccccauuuuccccuuuagccucucuaaaggguggcuguauuauauaguacaguugcuaaacuauauacauuguggcccugaauugauagaguuacagcuauaucauuccggccaguagaaagaagggauugacaauggccaggguagauacagggaaauucuuuaagagaugauuucaguagucuagggagaagaggauggugccuagguuuagacuacucacagaaaagaugguuaggagaggcuggauccuguaaugcugauagaauuuguggucaacuuagauggggaaugugagagaaaaacaggaguuaaggaugacuccaaauuuuauucuuaaaauuuugcaucuuagaaguuuuaauuuguuuaagucuuaacaccaauugaguauauacucuacaugcuuuuuuuuuauauucucacucauguuuacauagauuguaaacacgaguuacucuggugacugcuuuacucuuauuuuaauacuuacuauuaaaacuuauagucuucuuugugucuguaauguuaucuaaauguuuauucagcagaaugcuagugguggaaaacaggacccuaaaaauauuuuuacaagggcggucggaguguuuaacucuaggaaguaggccaaaauagcugcugugaugcacugagcagugaguuugggaaaaagcauucugcaaaaugucagccgauagcauugaaaaauagcagagcugcuugaagcagauuuuucaguuuacagaaauuguguuauaaccaaagcauggaagaugggaacaaauggcaggggaaaucuggcuacaugacuguaagaucagugcugcugcagagagucccugagucagcuuugguuuguaccaaggcaucaaguguauuugguuugacaagagauuggaaugugcugacaaugccccuuucuuauaaucuuaggcaguauauuacaaagcuuuauuuugaauguagcuuuuaucguuuguuauuuauuguacuuaaauuauguuuaaaggcaagcacugggauauuugugugcuuaaacuuuguuuaagggcaagaacuggagauuugugugccuggaacagacccuacucugccuccacuuuccauuuaggucagugggcaauuaaucuuguaauaugaaagguuucagguuuguaguguuuuuauugaccaaccuuuacaugaaaguacaucuaccauguagcuggaaaaagaucccugauaacuuuucuauguaccacccuuaguuuuuggaaauagguaaaggaagaaaaagugacagacugagaaugaauaggcagagagauggaaaaaacaguagagagaagcaccaggagggguagauucauacagcuggauggugaauuuugcacugauuuguuuugcuaacuuaaaacuuguuggauuacauaaauuucuauuaaaaaagaaaacacugcauucguauuaauuuaggcauuauuuuucuugaugacaaaaaucugaauaaaaaaacuaguuccuuuuaauaaaggacauuaaauaucaguagauaauagcuuuacuuguaguuuauuuagagauacuuucaagggauaaauacuuuucucaucuuuuugaaaguuauaauuuggcaauuguuuucugacaggaacauuugguuacauacaguagauguaugguuagauacaguaaaugauguuuuugccaauuuucuaacucucugggaacagaaguggagaauguugaaucccauuccccuguuacacacauuucuucaccuggugaacucauuuguccucaguuuuagggcgaauuccucacaauuuuuuucauaaacuuccaauuuaaaauaacuuucucuguuaaaaccuuucauccucuucguguuguugaacuuauucuuaguuuuacugcaguuuccauuuuaaauuguuuguggaauuauuugccacugucuccccucacaacuguauuguaagacccaugaagacagggauugauuuuuccaaaaauguuuauugagugacuuccuuccaaaaauauuuauugagugccuacuguguaucaacuaggauuuggggaucuauuagguuuacauucucuucaauuccagcauuuacuucguuuaccauuaugucuccaacauguagcacagugccugauaaacagugaaugucaguaucuguugaaagaauaaagaugaaagcccuuugaggaguauuugcagggcucaaaugugguguggagucagggguuaaaucuguaguugaggaacaugaacuucuccugagguuggggauuucuuuccccaucucaaucugaaauuuccaacugucccuguucuaacuuuucuuucaauaaaaacgagaacuuccuuaguguuagauccauuuuguaaacugcgucuggggaauguaugcaguuuaaguaaacugcaagauaaaucacagaagaguuaaugcaguagugaucauuuuauuagcgguccacauuaauagaauacagcaauuuaaauuguaauguaguuaacuuuguccuuuuuugggguuguaauuaaucuaaacauccagcuauuuauguuacuuauaauuaaagguaggaaagccauuagauaacucauuuguucauacuguguauucaauuaucugauuuauuauuuaucuaguuuauguacugagaguacauaauaaaacuuaauaaaaccucauaauaaaacuuauuagggggcaguaaaugaagaaacauguuguguucuugacagagcagguacauggacacucagacauuaaaauggagaccaggaaauuaaagaucagaagcagcauguggaaaacauucugucuggggccacuuauuauaggaauaaacagcucuguagauuuagauguucuggggaaguacccuaucauuggaaaauaugguaagugaucaugaguccucaagaagagguuauauuuguuugguauucuuugcuuaauuaucacauuugacagaaugauuugcauuauuaacauuauuaauagaaaguguuuagagaaaguugaaaggcaccaugguuuaauugacuggaaugcuuuaugacuaaaaaugcagagaguaguuugugaauuuucaggaacugauccuauucuuuauuaaagcguauuguguauuucugaaaaagcacacauaguauaguuuaauucagacucucugagcuguauauacuucuaauuauauacuaguuuaugaaauuacugaguuccuucuacuuugagaaauucuggaauuaagaaugagugaggauuguuggggagaggucguugaagcugacaaaacacugaaugcuuacccucguuucuaggucacagugaaaucagacuucacuggggagcaguuuucugaugaggaaugucaugaauccuuucagaaaugggaaugucucuguguuugucucuguaauguagaggcaucuugagaggcuggacuuuugaugaauugucauaagaacugaccccauauagcauuggcucagcuuucuaacaagggauucuuauuuccugcuacauaaauuccccaaaugaaacauugacucuuucagacauaaccugacccagugcacugggucauacuggaguauccugacccuguauggauuuauacugcugagaaaauuuaaauugcguucaaaagagagcuauuuuaugaacaucuaccuuaaauaugcaucuugcuuaugacuaauuaaugccuugcuauguuuuuguggagcagucuugaagaaccagguggcgaaccauucauuucuaauguguuguagcuaggaauuaguugaauuugacuguauacgaggugaggaaagagaaagggaggaaggcagggaaagaccagcuuuuccacagugacauucuucaacaguauuuuuugccagcagcugauauuucuucccuagugcuguuucaauguguauauucuaagccuuguaauaaauuucuugcuaaugacuuaaagugauggcauuuguacaggaauguguaacuguuggcuugauuuuauuuuacaaacugguuugaaaaagagagaaaauccucugaauauucauuucugcuuaaguccaguggaaaucucaguaaaauauuggaugugcagaaaagcuuuacacuuuaggaugagcugcauuauuaucuuuuuccugcaucauaauaaaacccuuaauccaacauuuagguuguuugauaguuggcguuuauaacgcuaccggggugagcauuuaucaagauaaauuguggagauuuguguuccuucaggauagggaauguggcauuuagaauucuuauuguuuagaaagucacagaagauacuuuaaacauuucuuaaaauuuuauuuauguaacagacucaucuuuucagguuagauuuaugagauaauuuggaguccuucacuacuuuaaacauuuucuuaaaauuuuauugaugcaggagacucaucuuuuaagauuagucuuaugaaauaacuuggaauccuucuucacugcucuuuuucacaaacccuguuuaaucuguccaucaauguuguuuagucugccuuagaaacauauucaaauggaugacuuuuuaccuccuuuacuaccguuccuugucuguaucaccauggucucuaaccuagaacacuguucagaacacucuucaacagauuuccuaauuuuguccuuggccucuccugugauagcaaccaggguaauccuguuaaacuugagucagauuaugagaugcaguauugcauagcaguuaagagcacagccucuggagcuagucuuucucgguucaaauaugagcucugccacuuaccauauauuuaaaguugggcaacacaguuaaauguaauauuggaagagcaguaauacuuggauuaaaugaauuaauaguaucuauaugguagacauuguuauuauuguauuguuauuacuguuauuuuaguagcuauuauaucaucucuuuacucagaauccucuacuagcuugcuauuacauuugaaguaaaaaccagaaucuuuacaaugaccuccuaggcccugcacagucuauucauucugacuucugaacucaucucauuuucccuugcauagucucuucuggccauucuggaugccugcuguccucccuuuucuuccacugccaauguaugaggccugaacccagcccagucauauucucuguauuuguuguuuccuuuuacuggaaagaugucccucaaauaucugcauagcucacuuccuuugcuucaggucacccucucagugaaacuugguuaugucauccaagauagcaacccauucaagacucccugcgacacucuaugacacuucguucuuuaucuuuagcccugaaaguuaaaugcaaauuuuuguuuguuuuuuuuuuugguucccuguauuggaauauaaacuccaugauggcagaggcuuauuuuuggucucuuguccugucuugaaugcugagucucuagaacaguggcacauaguaggcacacaguaacauugaaggaauuagugaacuuauggcaccugguuaauucucugcucacaaccucaugugguaucaucuuucccauguauacccaguauucucuuagcugugcccccuguggucugugaucugcuccaucuuggcuuccagcuguccacucuuaauucuaaaugguaauuugcaauuaaccauuuccugucuuuugaauaaugaaaacacgaaucccucuccauuucugacuagcaaaauauucucaugucuuugagacccacuuaacuguuucuucccccugcgguauuaccucaacuugucuugauuucuuccuccugugauuuaucguugcccuucauuguuuaaccuccucauagggcuguuaucuagaaucagaaauaccaauuuuuuuauuauuuggcauaccuaggaugguauuuuuuuuagugugaucccuguugagcgucauccgcaucucuucaugaugauaccugguacucggaauuuauuccccaggagcuccccauacaaacugaaucagaaacucuuggggugugacccaacaaucucuuguuuauacaaguauuuggguaguuguucuaguccaugcuaaugcuugaaaagcacugagcaaggacauuggcaugaugguccaguuuccagacugggaauaucugagauuaaggguccaguuggggccagugcuguggcucaugucuguaaucccagcacuuggggagcccaaggcaggcagaucacuugagaccaggaguuauagaccagccugaccaacauaguaaaacccuaugucuaccagaaauacaaauuuauuagcgggguuugguggugagcaccuguagucccagcuacucaggaggcugaggugggaguaucacacuuaaacagugggagcuaauugaaucagaggucauuacgucuuaggagaguuuuugugaauguggcagauagagcuucuuacugcaucaaaauggugcuauaaagccaauuauuuagaagcaacauuauggagcuguauuccuguuauuuucagaauuuuuaugcuuugauauauggaaaauaccuuuuagucaauuccaucuuuuuuaaaaaaucgcaggucaucuuggaaucauaguugaaauaaauaguauuucucauuaaagcauuaacaugucaguucaucauaaguuugguaauucagaauggaaccaaagaacuucauuguuuggaauacagguuggauaucccuuaugcaaaaugcuugggaccagaaguguuucagauuuccaguuuuuacagauuuuggaauacaaucaucuguugcauaacgacaaagauaccuucugagaauugagucauuaggcaauuucgucauuguagaaacaucauagaguguaccuauguaaaccuagaugguguagcuuaccacaccuagacaauauaguuuacacuacuguuucuacacuacaaaccuguaaggaauguuacuguaccgaauauuuagguaguugucacacaaugguauuuguguaucuaaauauaucuaaacauaaaaaaggcaacccauugugcuaugacugcuacuauaucacuagaugacaggaauuuuucagcuccauuguaauauuaugggaccaguguuguauauguggcucaucauugaugggaacaucauguggcacauuacuguauuuauauacacauaaugagauaucuuggggaugggacccaagucucaacaugaaauucguguauguuucauauauaccuuuuacauauaaugcaauauuauauaauguuuuaaauaauuuuaugcaagaaguaaaguuuucgcuguccuccucacauuaggucagguguagaauuuuacacuuguggucuuucagcacucaaaaaguuuuaguuugaauuuuggauuucugggcuaggaaugcucaaccuguaauaugaauugguaaagucucaucagguucaguauuucauuuauucagcacuaugcauaugacaagauaucaguguaaaaaaugaaacuauaaaaguacuggaagaaaauaugaauaauuauuuuauaauugcaacauguagaaggcauuucugaagugugagaaacaaaacccagaagauguaagaauuaauggccgauuuuaaaaagucauagaaaaauaaaaauucuaucuggaaaaaaaaucauacaaucaaaacaaaguucaaagauaaaugguaaguggggagaaaauguucaacccacaagguuuacuuggaauuuauuguagagauacaaucuuacauguaagaaauuacuugugaccaucuuuaucaauugcaguuuuuugauauuuaauuuuuuuuuuuggacagcagugcaauggaaacagcuuaaauuuuuaccagcaugcugguuaaauaaugguucauucauacaacagaauauuauaugucuguacucuauuuggaaauaucucgaagaaauacaaaaauuuuaaaaagaugccgaguggaauagagaguaugcacguguaugagaaguauccacuugugcaugcauuaaaauaucucuuaaagcauacaucagaaccaguuuuauugauauuuucugaagggaagucaguuaaauaucugguaaagauuaucacuuucuacgucaccuaguccaaaauuuaaauuacaaauaaggaaagaucagucacauauauaaauauauuuuuuagaucuccaacuuggcacggugaaugcuagaauguuucuuguauuuucugggauauacuccauaaaaagauaccuccuuacauaaagaugagaauuuaugacaguuuucaacacagagugaauaauaaacuuuuuuggagucuugugguaauuccauagaagaugauauuuguaguugucuucaucaaaucaucauuuaauuuuauguacugaaaauacauaauauacagauucaauuuucuaguaauaucuuauauagcaacuucaacucguagaacaauguggagaacuucagcaacuuguuaggggaggauucugagcugccaaaacugaugcuauaaaacuuucaagacaguaugaggaugggcugcuccucaauuuaaauguauucauuuuaugcaagguagaugcaauggaagauauaaaaucaacuauaaaaaucauguuauuauguguucauggcaauguggaguaaaguaagcaaauauuucacuauaauugaagaugguaaaugaaaguuaugacuucuguccauuuuuguuccuguuucagucacaccacgcuuuaucaggucugcuuuuaauuuuguguaacucauccauuuauuuucauugcuuuaauuucggcagacuuguacauaaaggcuguuuauuuuccguuaugaagaauaaaauguuaucuugauucaggcaccucacccuuacaacuuucucuuagagcauggcuugccuaagcauaagccuaacucaagcuuucugcuccagggcaacucuccuuauucauaugcgaauuggcaggaauguauuaccucagccugugcugguuuguccugguuccugacuuuacuauugauccccuuuucauauaagcauugaaaauauuuuuagugucuguguaaaauaugaaauaaacaguaacagaucauauguguuucagcaagcuacauaaccuugguaucagauuucuggcaggcaguucauauucucuaauaaagcauuuggcuagcagauggguuaccccaucccacucaaagaagguuucucauucauuuguggagguugcugaaaccuuugaacccuuggaauucagcagauuaaaguccgcucuauuugugaaggggcagauccauuuuccuuugacauuaaaauuauaucuaguauauacauuuuuauaacauuugaagggaucaaauguguuuuccaagucauaaauucuggaaaaugguccuauacucuuuguuuuaauuuuuauaaagauaggaaacauacugcuuuuccaagauaaucuuuucauuuuggauauuguuuauuguacuuuguauugauauguaauccgcacuccucauuaauucccuucucuauuuccaccccagccaguucuuuccacuaaaaucauauagagaaaaucuaguauuguuuucucuucaaauguaaugaguugguggggagauagugaaucuuucuucuuuuuuucauguagaaaaauucucaaucccucaacuauucaguaaugaugugauugcuagaccccugaaccuacugguuaaacuccuuauuugucaaaauucuccuuaauuuagcaucccaagcucuuauaauuuuccacagaugggcuauacagauuacaguguaaucaucacuucucuuguuaagauagcuuuuguuuuuguuuguuugguuuggucagccaucucacauuuuggcucauuuuugaguuuguauucaaguaaggcccauaacacacuuuuuucccccaacuuuuuaaagucaaguuuuacucugauugaaccuccuccccgcccugugugaucauucuuugcuguuugaauuuuacuuuucccuucugaacucuggaaagaauuugcugaaacucaguguauaguccuuggcugcaauccagcccuuucauuucaucucucuguuucugggaagggauuggcauacauguggaggagcagcucccaccuuuuuuaacugcuuaucauguuuagguugaguucuuaccuuuuaggucauggacaauuguugagacgcagaaguagagagguauaggggugaugagggccugugggauuuacugaagggaguuauugcaagcaguucuaaguaaaguguuuuuuuguacagauuggaaaaauuauaugguucauauguauguauuaaugacuuucugaaguauauggauacuuuugagauugugagaauguaaauuuauuuaaaugucacuguauuuauuucaagguuuucucauaauuuucuugaucaguuguugcuauaacaugguuauagaguagcccacaauauuuuauauuaaaaauuacaccucauacuaggaaaauggagccuuuuauuuuuauuuuuuugagacggaaucuugcucugucgcccaggccggaaugcaguggcgugaucuccgcucacugcaagcuccgccuccuggguucacgccauucuccugccucagcuucccaaguagcugggacuacaggugccagccaccacacccggcuaauuuuuuuguauuuuuaguagagaccggguuucaccauagccaggauggucucgaucuccugaccucaugauccgcccaccuuggccucccaaagugcugggauuacaggcaugagcuaccggauccagccaggcuuuuauuuuaaaauucaaaucuuugucuaauauuuauucaaguuuuauugaccauaaauauacaaauuuugauuuuuuuugcaguauaaucuguauguuuuaaaaaaugucuugaagcuuucauagcauuuugaaaguuacuagcuacuagaaauucuugaucauaauauuccuuugaguucugucuugaaauuugucaaacauucacuauuggguuaccuaacagaccaaagcacacauguggguauaucacuggaaaaaaugaguauccaaagggaugaucaggaaaccuaaaaaaaaaaguucuuaauguuggcauguauaaaauuuuuauuugaaaagaaugauaaagauauaucaugguuugguuugaaguaucuauaaaggauggggauggucucggugcaccuuggucuuucacauaucuauuaucucuggaagucuugaucuauccuucuacauuugguaucuaguuaguauuggaccuuaugguucuagaagaguuuauuuuuaacuucaugacuccuauccaggaccauuugucuuacagccuuucuguaaauaacuggcgauacuugcccucuccaucccacugcacauacugcuauggugaccaacucauuccaguuugccuaggacuuuuccaguuuuaaaacugaaagcccuguauuucuggaaucuccucagcccugggcauacugggauggugagucauucugcauacuacccuccacuuuucagcacuucucuuaauuugugguuugucuguucauuguccagagugggcuguggaagcccaggcauccaugugaaagcuagugugugugaagaugcccucuauguagcauuagagguuggaagugacuuuuuucuuuaagcauaccauugccccucuuuuucuacaaaaaugguaggaaaucauuggaugucucuugacacauccuuuuuagguuuuuuuuuucuuguugaaauugugacgugaauuacucuugaggaauuuuugucuugaauuuuuuucaacaguucugcaaaauaaaauuaauucucuucaacaauuccacaaaauaaaauuagacuucgugccuucaguucgucauaguuuuuggugacucaguacuuaacaaagcaacaaaauugugugcaaugaaaccuaggaaaaccaaguuuuuuaguaacugugaaucccgaguugucuuagauugguuaccacuuaacugcaggauccuggauaagucuuguuuucucuuuagauuaugguuuccuccuucaugaaagaagugggcuuugcuagacugacccugaggucauaauucacauuaaaggaaaugacuuucagucaguggaagagcaggguaugauuacuuuauguaccaaauacuuauuuucuggaauccauuuggagucauuuuuauaucucucuagcuucgccucugaguacagaacacagcauaaugcacuauccccauaguaccucuuucagauaagacuuucugacuguagcuaggauaauaugucggacauccccaagaccaccugcggguucagugauucaccaggaggaccuacaggauucagcauaugguuguacucaugucuaugacuuauuauugugaaaggauacaaagcaaaaucagcaaugagaaaaaacacaugggugagguccagggaaaccaggaauaagcuucuaacaguucuuuuccagugaagucacacaagaucugcuuaauucuccaagcaacuaacugguugugacaacaugugugaaauguuuaccuaccauggaagcucauuagagauucagugcccauaacuuuucuggagaauggucacauaggcagccucuguaccaaaauuucaagcacccagaaggaaggcagguguucagcauaaaccgcauuguuuguauaauuuagccacagugagccaucuuaucuaggaaugaugggaacccuucccauuggaagaccaucuggaaaccauauggaauccaacuuuucagaugccugccaaggaccaaccuuacaagcagaucuuucuaaggauagaagucuuaaguugcuaucucuuuucugaacauaauaaaacucaaugauugcuucagcccuuaaccuguugucaccaggggaggccacaugacauugaggaauaacucugaaguucuacuucuggcccuacuaguaauuuguuaggugacuuuggcuaagucgauuacuuuacuggaguuuaaccaccugugaauuugagaugauuaugcuaacuacauagggauuuuguuaaauuauuucauucacaccuacaugcaagacauaugauauuacuugccccugaguccacucauucugaaauguuuuuuaagaaccuacugugugcuuaauauugugauaagcucuggaggucuaauugugagcaaaagaauguucucugccuuucuguaacuuacagucucauuggagagagagacuuuaaucucacauaauuugagauuauucauaauuugagauuaugcaaauuaauauguaauuacaauuuguggugagugcccugaaagaaagguagaaagugcagugaaaacauggguacuggccuacucuaguaggucagagagggucucucuaaggaaauagcauauguguaagaaucucagguuuaccuaggcaguggccacaucaagaugucagggaggaauauuagauaauggucuugaaaaggcucuucucuuugaaugggagggugcaggcauuauuagaaaauaaaaauacaggccaaugugguuggagaagagagaacaaaguggagagagaaaguggaugagauuggagaggagagaaguaaccuaggaccacauugugguaauggaguuucucuacuauccuaagaggguauuuaccaaugaagugacauggucagauaucuaacuguuuugaaaugaucacucuagcugcuuuguaaacagagguuuagaguguacaaaguuggccuaagagacgauugcagaaaccugagcuagugcugauuauaacuugaguuagaguuauuauagcuugcugggagauggagaggaauguaaagauuugagaaggcguaucuagaguuacuugcuaaacuguuugaauaaacagcuucacgacuauuuuuccauaauuuuuaaaaacaaucuggauagcaucucugguagagaaagggaugggaguuauaacucgcugaguuuugcacaucaccuacagucuaucuugcacaugcauccuuugaauauaugugugagaugcugccuaacacauauguaggaguuugugucgacugcuuuauauauacuaacucauuuuacucucauggaaauacugucagguagaugcuauuacagacauauuacaguugagacgcagaguuuaaguaacugaccaagucaaaaccaagaagaaauaauagagcugggauuuaagcuuuacuuugccuucagauccauauggccaacuauauggauaaguagcaaacuuaugacccuuaggccaauucuggcccuuggcuguuuuugcacagccagccagacaacuacaaauguuuuuuacauuuuuaaaagguuguaaaaaaauaaggaaaaaaucaaauuguauuagacaguguauguggcccauaaggccugaaauauuuacuauuugaccuuuugcagaagaaguuucucaacaucucuauuaugcuuuuacuacgaaaacauuuuucuuuaguagaaaguugagaaacaguaaucuuuacagauaaaagacaugucuggucauaaaaucaguuaguuguagaaugagaacaguguacucacaguuacuucuguggcacaauaauuuuuuuuuauuguugccaguuuaaaauuaagaacuguguuuaaaguuacuugagaagauauggauaaaaggcagcugggcuagugcuguuauuuaacugugaugcccucauuaagaaaauugauuucagugccacugagacuccgucucaaaaaaaaaaaaaaaaaaaaaaaaaaaaaggauuucagauggacuucagaagcugcuuuagcauuuggugacaggauauauuagcaaaaacacuuucuguuuuaaaaccaugguuuguuuuugaauagaaaaauugugucaccacugaauauugguaaauuguguucagauaucaacagcuauuuggagaaaaaaaugacuccaacaaugcauuuuuuuuuucuucuagagcuuugaggacauagcauguuuuggccuuucuaaacaaauugacuucuugauuuuuggggaaauuaugaaauucaucugaauuuucagacagagcaaaauauacagccauuuaacaaauauuuauuaaaucuuacuguagugauaggcauuuuggaggauuauguaaagaugauuacauagucugccacugauuuucauuugguaaguuguuguucaaaucuaccacacuguauagaugcaucaccuguuucuuauucauggaaacuguauugaucuguuaucuaauagaguccaaagguggcaauagagguuacauuuggcuacugaugagcuuccauuugcuuguuuuuuuaaccucauggugccagguaucuugcugaaacgaagaaaaugagauagcuuuugcuguuauagauuggugguauuagugguuggcaggugccuguuauugaagcaccauuccuuagucaucucacuguaucauucauuuggcuuguggaggguggauuggaaaagguauuaauuauaguuauuuaaauuauaauacuguuugguuaaagaacucuguacauuuuaucuuuccuuauccuuagaugugucagucugcuaaaagauuuacauugcauaauuuucuaucuuucuuuugauuggaaguuuagagauuuuacauaaaguuguacucugucuuuauaggaauucuauauuuuuaguuauuugauaacuuuccauacuauuuuccauggagguugaacuaauuuacauucccacaagcaauguguaaguguucccuuuucuuugcauccaugccaacaucuguuguuuuuugaccuguuaacaauagccauucugacuggugugaaaugguaucucauuguggcuuugauuuucacuucucugaugauuagugauguugaggauuuguucauauauuucuuggccacucguauuucuucguuugagaaguaucucuucagccaucgcaguacuggguaucuacucaaagggaaagaagucauuacauaaaaaagacgccuauacucauaaguuuauugcagcacuauucacaacaacaaagucauggaaccaaccuaaaaguccaucagugguugacuggauaaagaaaaugugauauauauauauacgaugggauaugacacagcuauuaaaaaaaaaugaaauccuguccuuugcagcaggaugaauggagcuggaggccauuauccuaugugagcuaacuuggaaaaccgaaugccacguguucucgcuuauaagugggagcuaaacaauggguacacauggacauaaagauggaaaaaauagacacuggggacuccaaaaagcaggagguugggagaggguugaaaaggguugaaaaguuaccuguuggguacaguguucacuauguggguaauggauauacuagaagccaaauccccaccaauaugcaauauaccuauguaacaaacacgcuccuguauccucugaaucuaaaaugaaauuuaaauaaauaauaaaaagaacuauucagcugagcucauauugcugaaccauacgaaaauaaaguuuuauguuuuuuaacacugaauuuuguguuuguaugcaacaaugaguaacugaacgagggacuuggaaaauauguguugacugaauaagugaaugaauagauggaaaaauaguaauuauagggauuuuuaaacauaacaaaaaaugcaguuucaguauuuaucacauauggccagucuuguuuuaaucuaucuaccccaauuaacuuuaaaacagauugcaggcaugauaucauuugauaggguauuacuucaguaugugucucuaaauuauaaggacucuuuuuuaaaaaaaaguaaaugaaauuagcaugcuaaaaaauuaacuaauuucucaacaucaccaaauaccuaauuaguguucaaauuucucuaauuuucucacaaaugcuuuuuuauagcuuuuacaaaucaggucccaacucagguccgugacuaacauuuguuugaaaugucucuuauguuaauauucuauauauuucccuucccuuuucugucuuuugccaucgauuacauaaaucauuuguccuauagaauuucucauguucugaauuuuauugcugacaucucuuuccugucaccauaucuuugucucuuuauuucugguaaauuuguagcauaaaugguagugaaaucugaaaaguacguauccaguuuagguuacguuuucuaacaguaauacuucauaaauggugagaugguugaauucuugaauugguuaaaaaaaagcaugugggugauacaugucaacacuauuuuuuuucuccaacuaagauuuuuuucuuaucauagucaugauacugaauagcaacuuagaggaaacagcuguucauguguaauauuacuaaccagaccuuucuuuaacaaaauuauguauuugugauuugguugagguuauuuauaaagagcaauaguacugaaacaguaggaguucuuauuuggcauaggauugcuggacauggucagacuacacaugauuaagcuuugccuucugagucauuggauuugguaacauuuuugucuacucaagggucuggccaacuuuacuuuuccuauuaaggaugaugaaauccuugcuguuaacuuuauacuggaauuguaagugugaaaauccauccaguaaaaacugaaacuuguaguuaauucuuaugauuuauauagacaaauuuaagaaauguaacuuuaaauagaguaauuuuauuacagauagacuuuaaaaagcucuuuguucuuauaaaauaaaaugugguauucccuauuuugaaauuuacucugaauaauguuaaauuuucauaaucaguuaagcucuguuugaaacuuuauaaaugaaaacuuuuuuaaauaguuaauuuuaaaaaguauucuuaaaauacauuuacuagggccucaucaccuaggcuggagugcagccgugugaucuuggcucacuaccaucuccgccccccgaguucaagcgauucuccuaucucagccucuuaaguagcugggauuacaagugugugccaccauacccgacuaauuuuuguauuuucaguagagaugagguuucaccauguugaccaggcuggucucaaacugcugcucucaagugauaugcucaccucggccucccaaagugcugagauuacaggcaugaccuaccgugccuggccaagaaauaccuuuuucuuagaaaaaaaucuaagaauguugauguuuaucuucauggaaauuauuuuuuuugguugacuauugaauguuugaauuuaguauuucuuuguauauuguacuuacuuauauuuuauuguaguuacuuucaaaauuugacagauagauacauugguucaucugcuauaauuuuuaacugauuccuauaaugcauuauugccauguuuggugauuguugcuuaggggauacucaaaaccugaauucuuuucuuauaaauagagggcaagugagaaacaaaugauguuacucagagaauauugaaaagauguuaguuuugcuuucuuaguguguagguccuucuaaaucuucaguuaaaaaaaaauguuccagcccuuuuggcauuuguugaugcacuuguuucuuuugugcauuuuuccaacaugccuuuuccuauuaaaaauaaucauuaucuguaguagcuuauguagguguuuugagacaauuccuuaaaucuaucuaauuuuacuaaaaagaaguguuauguuggauugaaaguaauauuucauuauaaaaugguagcuaauaguuguauauuuacuagggcagugguuauuuugauuccauuuauucuuuaaagagaaaccaaaacacaauaaauaauguugucgcuuguaagaauuuucaugaaaaagcaaucccggauaggagaaaaaaauuaagauuuuguuuuaaauauuugcucccaguugucacaauuuauuuuagaaaauuagaaucagauuuaaugauuguaucuguuuuuuuuguguaugucauuauuuugaugaauguaauuugcugaucuccucacuggugaugucauaaaucaggaaugauuuaucgaugauguugaaguuuguugauuagauaaugucagagaaucuuaaucauggauuauaaaguucauuuuauggaaguuuuucucaauauugaaauacuuuauugauggcaugauuuuucuuaaucaucaauauacuuuuuugcguugaaauaauugucauuugaagguucaucauuuggcaguaauacaaccaauuugagucaucuauuuuuucgacagcucuuuguuuagucuuguguagauaaguaaaccagaauauucccacggguuuagugaggucucaauuacuguagugaguuguaaaaugugagcauuugauaucuugguaaaccuucuuuuguuuccuuuugucuuugcagauaaauuauuagucauaacuguagcaacaaaagaaagugauggauuccaucgauuuaugcagucagccaaauauuucaauuauacugugaagguaugguauauccuuuaaccuaugaagauccuauaaugugugccuaaaguauguuuuucauaacagcaguacaaucuguaauccucacaaggaagauagcauuugguuacauaauuacuguuaguucauguaguuuuuggcuuuauuaauauuuccuaacacaaagaaauggugguaaaugcuugaggugaggggauagccaaaguauucugauuugaucauuacacauuauaugccuguaucaaaauaucacauguaccccauaaauaugcaacuauuaugcaccuguaauaauuaagauaaaauaaugcugugccacucaaacaauaauuucugaauuuuugccaaugcuuuguauaaauauacucuauaaaacagcaaaaaaaaguuaauauguauuugcauauauauauauaauuucuuucuggcaggucauguacaaauacaauguaaauaagauuuggcagggauuuuuuucacugacugcauaauuuuuucuguaauggguuuugcuaucguaggaugauucuuuguuugcagggaauuagaaacaaaugugaagagggugccuuuucugucuauuauugagaauugcuuuuguuuuugcuuuuuuuguuuguuuguuuguuuucauuuagagguauuugggaggauuguuaauguauuuuuaaccaaagcauuuuagaaaacuuaucuccaggugaacaucucauugacaagugaucagaggaaacuuggggaaauugauagaacuauuaaacucagcuaugagaggccugccauuuuauuuacuuacuuguuuuuuuuaauagaaagaaggaucugucagccaagucuuuucuacaaauaagaggagaacaaggagauaccuagguaggaacacaaaaagcaaaaaacuuuuuuuuuaaaaaagaagaaagauuacuuuuuggagaaaaacugauccauuugaguauguaguauauuaaaaagguaguuuuuauuaaauaaccacuggaauacuaaguauagauguaaauauagaacagcuaaguguuaauauagaacagcuaauaaacagcuaaacuuugcugaaaaagagauguagugguaacaacuagauguuuaauauaggauaaaugaaaaacauguuagaaauauguuacuaugauagauggaaaauguagcaguaugcacugauaggagacacuguggaaauaaaauuaggauaaaauaaugcugaaaucuaguuggggaaucguuaggguucagaauggagagagaguagaauguuucuuaugugcaaggcaccuuguaaggaacuuuauauaugauaugcuguuaagucacuauaugaaccauguaagguagauacuacuuuauuucuggaugaggaaaacuugucccaaggcaaauaacuauauaaaguauaauaucagaucuuggaccccauccccacuuaacuuacuggaguuuaugauccuuuugcucucuccucauguaaugcagugguucccaaaguguggaccccagaccaccaacaucugcauugccuggcuacugauaagaaagaaaaaauaaucaggcucccccucagaccgacugaauuacaaauccugggagugauacccugaagucuguguuugaacaaggcuuccaugagauucagaugcacacugaaauuugacaaccacuaguguaguggaaagaacauagaggguggugcuuaacaugguguauugcacagaguagacucucagaugucguuggguccaauguugcauuaggauuagggauuccagauggguuguggaacaaaucucagggccagaggaggccaauuuuuagagcaaguacuauuaaugcuucuagauuagccuaguuugaauccagauccaaaacagcuugaguuuucuuggguuguguuuuucccucaaccugccacauaggaagugauaaguuauaacaggacauuugaggcugggagccccacaggcuuugccagcaagauuuaucuccggcucaguauuaaguaaaguuagaacuagugguauuuauuauuaaauuuuauuuuauccuuuucuuguguguuuauuuuuaauuucauucuccauuaauuucccagaucucuuaguagaucauuauaauggcaacuucagacuuuguuuugaugaaaugaagagaaaagguguguguugugugggggaagggacguguauugcacuuucuguucccuuagagucagugugucaucaugcauuuccaauucagggagcagcugcugaggcucaagcaaauagugaagagaaaggguacaggguaauuaaaaucaaauuuaaauuaaucauacuuaggcaauaucuugcauugaaaaauccuuauuaagcuuuagacaauuacauaaguuuaagauguauaagguaaagaaggugauuuuuuucuugaugcccucugcaauucccugaaaaacccauuuugguucaguaggaaaauugcuuaaaggccccucaucaaggagucacugagcuucaauguugaucauaaagauuuccugccagauugaaaaaaaagugauaugggaaauuuauucauuuuucuucuuuauggucuaaacaaauaggaauaaaaugauguaaugugagaaauacuuucugggucuacuuccuuggauuagacucacaacuuuugagaugguaaaaauugagaagggcauuuuggggauggauaacauugaagaauuaugaucugauuuaggcaucuagauuuuuuuuucuagaaucaugauuccaugaaacauuagaagagugguuacgguacaguacuguucaaguugaugaugucuuuaaguuuuucauaguacuuucauaauuugaguuuugcucaggaaugaaauguugauuuuguuuauagguccuuggucaaggagaagaauggagagguggugauggaauuaauaguauuggagggggccagaaagugagauuaaugaaagaagucauggaacacuaugcugaucaagaugaucugguugucauguuuacugaaugguaggagaaacacccuguggauuuuaaaaucuauauucaauuacuuuuuaaagagcugagauuuauauuuguagaugauguauuaaaauaugguugggcacgguggcucacgccuguaauccuagcacuuugggaggccuaggcagcuggaucacaaggucaggaguucaagaccagccuggccaagauggugaaacccugucucuacuaaaaauacaaaaaauuagccgggcgugguggcaggugccuguaaucacagcuacuugggaggcugaggcagagaauugcuugaacccaggagcaagguugcagugagccgagauugcgccacucuacuccauccuggcaacagagcaagacuccauuucaaaaaaaaauuauugacaaggaauuauuguuuuaaaaaguagauauuacuauucuguagguugcccguucgcucugaugguaguuucuuuugcugugcagaagcucuuuagcuuaauuagaucccauuugucaauuuuggcuuuuguugccauuacuuuugguguuuuagacaugaaguccuugcccaugccuauguccugaaugguauugccuagguuuucuucuagggcuuuuaugguuucaggucuaacauuuaagucuuuaauccaucuugaauuaauuuuuguguaagguguaaggaagggaucaaguuucagcuuucuacauauggcuagccaguuuucccagcaccauacagaaagggagaaaauuuuugcaaucuacucaucugacaaagggcuaauauccagaaucuacaaugaacucaaacaaauuuacaagaaaaaaacaaauagggccaucaaaaagugugugaaggaugugaacagacacuucucaaaagaagacauuuaugcagccaaaauacacaugaaaaaaugcucaucaucacuggccaucagagaaaugcaaaucaaaaccacaaugagauaccaucucacacgaguuagaauggcgaucauuaaaaaaucaggaaacaacaggugcuggagaggauguggagaaauaggaacacuuuuacacuguuggugggacuguaaacuaguucaaccauuguggaagucaguguggugauuccucagggaucuagaacuagaaauaccauuugacccagccaucccauuacuggguauauacccaaaggauuauaaaucaugcugcuauaaagacacaugcacagguauguuuaucgcggcacuauucacgauagcaaagacuuggaaccaacccagauguccaacaaugauagacuggauuaagaaaauguggcacauacacaccauggaauacuaugcagccauaaaaaaugaugaguucauguccuuuguagggacauggaugaagcuggaaaccaucauucucagcaaacuaucgcaaggacaaaaaaccaaacaccgcauauucucacucauaggugggaauugaacaaugagaucacauggacacaggaaggggaacaucacacacgggggccuguuguggagugggggaaugggggagggauagcauuaggagauauaccuaauguuaaaugacaaguuacugggugcagcacaccaacauggcacauguauacauauguaacuaaccugcacguugugcacauguacccuaaaacuuaaaguauaauaaaaaaaaagaggcaaaaguagauauuacuaguuauaaaacuauuguauuaaucaguucuugugcugcuacaaauuccugagacugcauaauuuauaaagaaaagagauuuaguuggcucacaauuucacaggcuguacaggaaacaugaugcuggccagcugcuuggcuucuggagaggccucaggaaacuuaggaucauggcagaaggcaaaggaggaaugaaggucucacaugauuggagcaggaggaagugaggggaugugcuacaugcuuuuaaacaaucagaucucaugagaacucuauaaugagaacaucacuagggugauggugcuaaaccauuagaaacugcccucaugauccaaucaccucccacccaaccccaccuccagcacugaggguuacguuucaacaugagauguggguggggacguagauucaaauuauaucaacuauggucugagaugauguaauuaaagaugaugaauuaccauaaacacuaaugagacaacauggcaagagcuaacguuuuugugaaauucauacuuuagucuugaguuaagaauaaagaucauagugagcuuuacuauugagacggguaacuuaauggauucugguuaaacagaagaaaaaagaccacgcaaaguuauaaauacaagugagacauuagaaagccuguguuacuaagaaagaagaaccuuuuuaauguaaauguauuuuguguaauauuucacucuccuaauuaaaauauccacucuuuuuugccaucuucuuauaauuuuauaauaacaucaaauugucaugaguuauuaguuacuacuuccuuuauuuuauuuucugugucuuauuuguuuuuguuauugauugcucauuuuaaguccccaugaauuuuccccucuaacuuaggaaggucuuuuuacauauuuuuucucaauuugaaaauauaaagacacaaauuauuugcagaugaaaauaagaguaauauuuuuaugcauuaguauaaauaagaaaguuauaaauuaugaaaugaaaauagauguuaauauaaugaagucccagugccguacacacuuaaaaauuuucaaaagauacauaacacuugcaucuguaaaauuuuccuguuauauuuuacacaaaauauuaaguucugcuugugguuaccuauuuugcaagaugaaguaugguaaggcaaguguuagccauaguguacugggaauuuuucuacagcauuuguuauuuuuuuuacacuuagaaaaagaauaccaaguucauuaaaauagcucuguagaauaaauacuggguauguuuugguuuaaaauuaccauggauuucaaacaaccauauuagucagcuuaaacuugccacauguacauuuucacuuuggcucugaggcagauucuccuuguaagaguuacuacaugugagucagaaaugauuuuacauccucaagcuuccuuuuggguuuuaggaagaacuuuucucuaccaucacucucgcaucaccaucccccaccuccggcccccuaucuaauauuuguccuuguggacaacugguauagugagggaccuauuuuuuucucaugagaagaaggacacugugauauaccuaaagccugcuugagguugaguuuguugauuuagaugauacuuuaggacccagcuugacagaaaagauaauaaaauuuuaauggaagacacagugucuuccaggcacuguuaguguuugggauauauaauggaaacaaacagauaaaauuucugacaucuccugugagaacagccagcuaacugaaaacaugggugcccacucagccaaguuguugucuaagaagagucauuaacauuuucugcaucauuaccuaccaugacuauccuguggaaaaaaccuaggggucaugagaaaguaaccaggagguuaaagagggaugagcaauugaagccacauaagaaauuuuuuuuacccuucuuauuuuuuaaaaacaacacccuuuuuaaaaaguuuauacagaguaaugaaucuaguugaaaauuguaaucuagggccugggagaaugaauuaaacuguuuguaaaugguuugaaauaugaugcccauucuguaacacaauuccuaaacucuuaauuaagguuagcucugguaaagguccagaauucaggauauguucauuuuaauaaagcaaaacauucuuauuuuuuaugugguauuuuuaaggacaacucaacuguuuuauggaagcauaggucacuaucauaugaaaauauacacagauguauauacuuagugguuuagaugagccuuuuaagaaacacagcuuuguuagggcauaauuuauauaacaugccauaaacauuuguaaguguaaaauucaaugaauuuaauuaaauuuacagagucgugcagucauccccauuaugcaauuuuagaauguuuccaauaccccauaauuaucccguauuccauuuagacaugcuaaaaagccugaauuaauuuagaaacaauuuugucgcauuccuuccauggaauauguauucuaaacuuacuuuuggaugaacguuuaaaauuagaaacuggcucuuuauaaucuguaggguaagauuuauuauauuuaauuuagauaaaaaaauuuagauauuuggcaagguuuuagguuauucucagaacaaaaggaaaacugaagauauccauauaugagugagaccaucugauacugucuuuuugugcauggcuuauaucauuaaccuaguaaccuccaguuguaaccauuuuauuguugcaaauaacaggauuuccuucuuuuuuaugggugaauaauauuccauuauguguguacuccguauuuccuuuauccauucaucuguugauacauacuuagauuuguuccauauauuuacuauuauaaguaguguugcaguaaacauggaaguauagguaucccauugauauacuuauuuucuuuccaacagcacaacaaaaauaucccccaugaucaagugggauuuaucccaggaaugccaggaugguucaauauuuaucuguuaaaauuguauuuguuuuaugccaacuaacucccuuucccucccuccaaaauuuauaaaauaauuuuaaucauuuuauugugauuuuaucauaaucuguugugcaaagucaacuggguacguggguguuuuuaacugugugugugcgugugugugucugugugucugugucugugugucugugucuguguguuuugagggugggugguuaggaguggauccauaguauugguuugugauguuaauuaucucuggaaauauagacauaugcuucaggugaagauaugaugaaagaauuaucaggugugaagcuacuucugugcugcuaauaguuuggaugauuauaauuuuugcugaaguuuaugccaauaaugauaaaggauuggggcuaaaugacaagguuagggaacacuucuguugcuuucuuuuuuggcuauaugggagcuuuugcuucuuguugagacucaagaugauggauucuguggcuuguaccacugccuguuuuuguaaaaaguuuuauugaaaugcagcugugcucauuuguuuacauauugucugugguggcuuuugcaacacagugacagaguucagucacugugacagacaauauggucaucaggaccuaaaauauuuucuguaaaaggccagagaguaaauauuuacugacucccgcuuuaggccauaguugagaaccauugauacagucugggaacuggcacagaaucauuuuuaaaauaguuugucagacagucuuauuuaugagugaggaagagauggguaauguagaggucucuaggguuuuaaaauuaaucuagccuugugccuucuagugggaguggagaggauuugaaugcaaaauaaauuaaguagauggaaucaauaggauuaaggaaaagauuccaugagauaggccauggaaagagaggagugaagggugaaugaaagauuuucaaccuaggugacuaugugguugauguugucacagaaguagggaacacagaaggacaaaaaggaaaaacacuuagaaaaucucaaucaucuauugagauagaacacugacaugucuggcaggggacucaguaugaccacaucagguagaaucuuaugguuuuuucaggacccaggcauacuuaccacaguuauauguggaaaauuuuauuuucuucacauguagaucgacucaauuucugugagaauauuuuuaugaccuguguaucgggggaaccacccccaauauuucaacguagguucuuuccuauuucccuaaguguuggccggucugagaaauaaagggaaagaguacaaaagagagaaauuuuaaagcuggguguccgggggagacaucacauguuggcagguuccgugcugccccccaagccgcaaaaccagcaaguuuuuuuguuuuguuuuguuuucuauauucauuuuauuaauucaucccccccaaguuuucuacagaauccuggaauucuucucaguguagucaauacauugauaguuugucgauuuuaaugaagacaucccucucagagccugugcuguuccgcaguugggauugaugcgucucuaggccugcagggacuucccuucaccaucauaugggaauccucugugacucuacccuguguggauucuucugugcccuguuuuucaugucuuccucuuucuuaguuuauucccuuaauuugguggagcacguucuccaguagcuaccucuacuuuccuuuuccccacucuucguaccaaauuuugcagauuggguucuccagaaaguagaaucuuagguggaaauuagugugugggaggcuuauuaggaaugcuuguuggaucaaugcuuaugauuaugcaguuugguuggauucaucuguguucuucuacugauuuuuccuggggucacuuuuguggcugcaguaaucuggcugcuccacugagaguaugucugguuguuagcugggacuguuggcuggauacuuuugcuuaucuacaggucaucucuucgaggauaauuuggguuucuuuugcuguauuaguccauuuucacgcugcuauaagaaauaccugagacguacuugguuuucagggcacuacauugccuugaaaaccagcaaguuuuuauuagugauuuucaaaggggaggcaguguaugaauagggugugggucacagaggcacacagaggcaauaaaauaucacaaggcaaaugggggcaaagcgagaucacaggaccggggcgaaauuaaaauugcuaaugaaauuucggguaugcauugucauugauaacgucuuaucaggagacaggguuugagagcagacaacuggucugacuaaaauuuacuaggcaggaauuuccucguccuaauaggccugggagugcuaccagagacuggggcuauuucaucccuuaucugcaaccguguaagacagacauuccuagagcggccauuuuagagaccuaccccuaggaaagcauuuucuuucucagggcuguuccuuacugagaaaaagaauucagcgauauuucuccuauucgcuuuuguaagaagagaaauauggcucuguuccgcccggcucucaggcagucagaccugaugguuaccucccuuguucccugaacaucgcuguuauccuguucuuuuuucaaggugcccagauuucauauuguuuaaacacacaugauuuacuaacgauuugcacaguuaaugcaaucaucacaggguccuaaggcuacgcacauccucagcuuacgaagaugacgggauuaagagauuaaaguaaagacaggcauaggaaaucacaagaguauugauuagggaagugauaaauguccaugaaaucuucauaauuuauguucagagauugcaguaaagacaggcauaagaaauuauaaaaguauuaauuuggggaacuaauaaauguccaugaaaucuucacaauuuauguucuucugccauggcuucagccggucccuccauuuggggucccugacuucccgcaacaccugugugcauuuuuuuaaauuugacaauuugacuuuuuacagccaaaauaaauuuaaguaggaaaccuuccuugcccuuugagaaguuuuaaguaaguucaaauaacuuuucuaaaguauuuaaacacagaaauagcagugcuacucgaaugagauaggaaagguuucagcaacgugaaauuuuucuucaaaggcaauuaugugauaacuuuugucuuaacuuuuugcuuuaaaauaauuguguuuuguuauaaagauaauacaggcuuauaaaacgcuaaauuauaaaaguugccauaacucuuuuucaaacaacugacauuuauuaauaguuugagcuauacuguuuauauaaucuguauccaucauuaggguuucaaagacaaaaaauauucacucacauuccaaaagugcauuuauaacuuuuuuuaauuuuuaaauuuuauuauuauuuuacuucaaguucugggauauaugugcagaacgugcagguuuguuacauagguauacaugugccauggugguuugccgcaccuauuaccccaucaucuagaguuuuguuuuuuuuuuuuuuugagaccaagucucacucugucaccaggcuggagugcaguggcaugaucucagcucacugcaaccuccaccucucggguucaagcaauucuccugccuuagccucccaaguagcugggauuacaggcgcacaucaccacgcacagcuaauuuuuguauuuuuaguagagauggguuuucacuauguuggccaggauggucuugaucucuugaccucaugauccgcccgccuugaccucccaaagugcugggauugcaggcaugagccacugugcccggccucaucuagguuuuaagcccugcaugaauuagguauuuguccuaaugcucucccucuccuugccccccgcccaccgacaaacuccacugugugauguuccccucucuguguccauguauucucauuguucagcucccacuuaugagugagaacacgugguguuugguuuucuguuucuguguuaguuugcugagaauuaugggauuccaccuucauccaugucccugcaaaggacaugaacucauucuuuuuauggcugaauaguauuccauguuguauaugugucacauuuucuuuuuccaguuuaucauuaaugggcauuuggguugguuccaagucuuugcuauuguaaauaaugcugcaguagacauaugugugcauguaacuuuauagaagaaugauuuguaauuguuuggguuuauacccagcaaugggauugcugggucaaauggcauuucugauucuagaucuuugaggaauugccacacuguaugcaugcugcuaccugcaaaauuucagacucaguuuagucagagucuccaaucguaagaugcucugacaucacaagcuauuuuuccccaucuccaggcaaugcacaaagggucuguuuaucacucgcaugguagucgcucuuucagagacuuuaguuuauuugccucacuucucauggccuaauuacccauaaaacuggucuuauuucccagucuucauuauuaaaaaaaaaaauuaucaacaacuuauagucuugaggaaaauaucaccguuaaauccgguugaggaaaucaguuguacuuagcagaaaaaguacaguguuguguuuuguaaugucagauuaaucaguuuuuuuuuuaauaaacagggcaaaguuugagguuucagucagaaaaauuuuauuguaacuuaaaguucaguuucaaaaguacaaguauuuggcuaaaaauaaaauuuuuuaacauacacauuuguaaaaacuuugaagugaguuuuccucugucucucccuuuacuguagucccuuucauguuaauuuuuaacuuuguucaguguuuacagugugccaggaguuauuuuuaauuuuuuuaaauuauaacuugaggauauagauacuacuuuucccuccauuuuauacuuuacacuuaaguguaaagagguuaagugacuuguccuaagguuauucucauaucaaguggcagaggugggauuagaaacccaccuggcagacuucaaauuguaugcugugagugacuuuacaauuaugcuguuagcuaccugggaugguaagucauuaauuuaucaucauuggaaaccuuuggucuuaaggugcacugauguaaaaaaauguaaaauaauuugugauuguaaugaauaaagaacuuauugcagaguagaaaaauuuuagauaguggcuguuauacuucacauuuuguuaagucauugugauucugugaaugaaccaugaggaagaaagucaucagaaaaaucaaugaaauuauauuauauuaauuaaauuauagugucaguuuuuacaaaaauuaaauuauagugucaguuuuuacaaaaauuuucucccaaguguauugagcuuuaaaaaccugcaguugucugaacgcacuuauuuuaagauuccaugcuaaacagucauucagauauuaaacauacauugaugacauuuagcaguuaaacacauuuugucaaaaauaauucuucagaaacuaauggacugguacaaauuuacuugaaauauuaggcaguuauggcaacuuccguaaaugauucuaucuguauuauaaaguuauacaacaaguaacuguauuucuaacauuuuaaugcuguuucagaauuucaauuugggaauaagugauuccugaaaaaaaaauuaaggcuaacacuaaaaaagcugacuuuuauuuggacuucauuugcuaauguaaacuaauaauucaauacaauucauauaauuuaaguugagagaaauuuuguuugguguucuguguaaauaguuggcacagguauuaaucuugcauuguauucuugauucugacuuuuguuagagaacuuuucaugguuuaugugccuagauucugacaaguguauuuuaaaacacauuuuuuccucauugaacagcuuugaugucauauuugcuggugguccagaagaaguucuaaaaaaauuccaaaaggcaaaccacaaaguggucuuugcagcagauggaauuuuguggccagauaaaagacuagcagacaaguauccuguugugcacauugggaaacgcuaucugaauucaggaggugaguuagauacuggaagaaaaguuuaaugcaaguuauaaagacuaaugaaacaaccauuuuuguagauguaguaacuuuagauaugaaguuuuaaauaacccuuauuuuauuauuaguauauugacaaagcauuuucccauguauuaugugaguugguguuccuaaaaacacuagguaauauaaauguuauaauuaccaaauuauaagugaggaaacucauguuuuucaaauuuaagugacuucuagagauauucuguuguuaaaggaagaaaaguauggauccaguuccuuuaauuaugacacauugagaauuuucuugcucuaggauaauaaguuuaguaagcuuccuuacuugaaaaaaaauuauucucaguccgcaaucaaguagcuuuuaagaauagguauuacuuaauauuaucugauuuuaaacauuaugggauuaaauaaaugauuugucuugaacccaguagugaaaaauaucuaacauugagugucuggguauacuuaaaauauugcauuagcugugcuaccacggauuaaaggaaugaauuaccacauuccucaguccagccuuuagaaaauuaaauaaaauuugaccuuggaaauuauaauggcuacaaauuuauuuuuacuaguuugagauuaauguaaacauagggacaaaagacauaaccaaauaggaugaaggacauguuagagaaacaaauuggguacaaauugcaaaccacauuggaaaaauggauuuugggggugaucuacguguauauaaccaguacuauccaggcuaguuaaaauaagugcugcuucagguagcagcauaucuggguucuaggcuuugcuuagccacuaggaagugauuuaguuucuugguaaugccucaauuucagcucuuugcaccugcacuuuauuuuaucaacauauucccacaguuguaccuuggaacuuugauagcucauauagauuuuguacuuuugaaaccuuaaauuccaguuugcacugccugguuugaaaucucuuuuccucuucgucucaauauuucuacagauaaugcuuucugggaucucuugaccauuuucuuuucuccaaaucuaucuaccaccuuuggauuuaacuuccauauucaagugagaacccaagguuuaucauauugguuacucugugcuucuugccuuagcagucuuucucuguuagauuuccagcuugugaaccgucaaagccucucccuaauauggcuacccaccaucacuucucugcuugagcaugcggcucauggaugggugcugcuuccacaucauggccuccauacugucaagaccucaguaauauauggcuaaucuugcaacuuauucuaaguccuccauuguuuaaaaccaauuuuuuaaaggaaguauguagccaugggacucugagacauguuuuauuuuauacuuguugaaauuuuucugaagaugacuugcauagugaaaucucguaaauuuauuucaaauagugauguauguacucaggugguuagguuucagacagacucacagugcuuuggaagcagcaagaaauuagcaagcaagugcaguuguaagucaguuuaauuaaggaaaagguguuuuaagugggaaaguaaucauaaaaggacaucgaagcaucauccuuaugcuuucuguagucaaaauaauuagagaagggcagaaaauauaaauauguuuaauaaaaguuugaauaauuucauagaucacauauuuacaguuauuuaagggacaugaguuguuugugggcauacuauuuaguuuuuaaaaauaguuuuuggccaggcacggugucucaaaccuguaaucccagcacuuugggaggccuagacaggaaggugacuugagcccagguguucaggccaggcugugcaacguagggaaaucccauuucuacuaaaauuuuuuuuuaaauuaucugggcaugguggcacauggcugugguccuagcuacuuuggagacugaggugaggagauuguuugagcccaggaggucgaggcugcagugagccaugagugcaccauugcacucuagccuggguggcagagugagagccccaucuccaaaaacaacaacaaaaagaguuuuuaauagaaaaauauaaaucacauaaaauauguaaugugaaaauagauguuuuuuuuucauuuauugaggacauuuggggucuguaaaauaaggaaacaauuuuugaagaacaguaauauaaaccauuggaaaauguugagugucucugugugguacauuuuucaucacagaaaauuggccaugggauuuaaaaaauguauugucuucuccccagaauuuuuuuauuugaugccaggcaugguggcucacgccucuaaucucagcacuuugggaggcugaggcgggcagaucaccugaggucaggaguucgagaccagucugaccaacauggcgaaaccccaucucuacuaaaaauacaaaaauuagucgggcauggugaugggugccuguaaucccaacuacuugagaggcugaggcaggagguggaaggcggaggggaacucgggaggcauagguugcagugagccaagauugugccuuugcacuccagccugggugacagagcgagacucugucuccaaaaaaaaaaaaaaaaaaaaaaaaaaaaaaauuuauauggcaagaaccaaaaaaugagcaaccauugauugguuuuggucauguuuucauuuuuucuuuuuucuccaauaacaguaauuucccuggaccuauuuuuuuaauucuuuuaagaaaauuuuaauuuugacaguuaaaaaauagauuuuucuucaacucacaggaguaacauugguuccuuuuuaaaaguauugaaugucaaugaaacauagcagcuuggcugcauuuccauaauucagaggaagauucagacaagaaaaaugauuccguucgugucuuuaauagacaaauguuauuggcggucuuaaugcuuaugcuuuaaggccaaggagaacaauccaauuuuagacuuccuuuuuccagacuaugacacaaaaaaccuagccagaaaaugguuuagcaggcacaauaaugacuggccaaaguaauggaaacauuuccaaaaugucuuagauauaaaauuucuuugggauguuugcaguuagugacaaauccagcauucguuugauugcauuagcaucucuggcacugacaguaaaaccacuguaguagagauuuuauucuguaagaaagagugaguucuccgcagagaauccaagaagagcuuuuuagaaggucagagaaaaaauucuugucucagucuauucuuuuccuaguaaaucuguuucccuuaggagccuuggaaaacauuaguucucccucuuuugucaauuacuuuuggagacacauuuauuuaaaaagaguuugguuauuuucuguuuugcaguugguagcaaacacucuauuggaguuuauauauaaaacaaggggcacucaauaauucauauuucuuucauggugagcugugaaauuccagccuaagaauuaggcuucaugacuucacaacucuguucaacuggucagugaaauuaacaugacaccaguuuuggucuuugaauccuaaauuaucuacuuucucucugcuguguugcaggauuuauuggcuaugcuccauaugucaaccguauaguucaacaauggaaucuccaggauaaugaugaugaucagcucuuuuacacuaaaguuuacauugauccacugaaaaggguguguaacagcugcaauuuuuuuguuuuauugauuugguuguuuuguguguuauauuguguuaauguggaguggucagaaacaaagguuuuaugauaguauggcaaaugguaaacugaauuucaaaauguugaaaacauauuuuaauaggugagauugguuuaugucaccuggcuggauaucagcacuagcuuaguaugucuuuauggcuucucuuuuguggccaaguuggcaaacuugccgaacuugguuggaucaggcagaaggaaagaagaacuauauaaugcagugcuauauguauugaaacacauauugaaaugacuugauacuaaaaugaaauggcagcccucacaccacugucauggcccuaccuccacugcauacucacuuaggcugccuuaaaauaacagaauagguuacauuaucaaaacuucugagcuuggagauuuaaagagacaauaaugaaauccuaaagauucuagacaaugucuucuuuuauauucuugaauaaauaacugucauuuauuaacauagagcauuagaaauguguauucuuguauucacuccaucuuggcagcuauaauuguuuucucagaagcuacaccaaagccauuugauaccagagugaacuuuugcaguuuaaaaaaaugcaguguauucucauuuguagucuuuagccuugcaaagcccuuuguaccucucugagcuucuuugauccuagauaggcuagaggcuagacucuguauccacacuuuaucaguagagaaacugagaccacauagucugugacauuguagggacuggauccuugguucccugaaaaccaaaaucuggacuuuuuuucuguuucauaugaugauaacauagacuuuauguguuuaauuggcuacaauuuuaaaagaacacauuuucugguauuuugaaaugacaugugaauaaagccacucaaaagacaguuuuuaauuugaaaauuaccugugauacccuugaggacagagaccuuccucugagauuuggagccuggagauuauggguguugagaaaacauugaagccaaaagcccuggucauuguucaaguguuugguggcccagaguggauagagccuguaaggaugggugugauccuuuuuaggagacuuuauagccaauuuguggauuucaaauauuugagaauuuggagccugaagauucaaagagaugauaaugaaaucccuaagagguuagagccugaggauccacgggacugugcuauagacacaggcuuuugucuuuuauucauaagaacacuuaaacuguaauaaauaaagcaacucaaaauagcaguggucuaaauaagaaauauguuuuauuuaaguuuuuuccuucugucacauugaaaguaauuaagaaguagggagcacaaggcuguuagggaggcuuuaugcugucaagagggauagcucuuuuguugcuccaccauugguccauagcucccaguuuuaaucuuacuuccuuguccaaaauugcuacuugaguuucagucguugcauucguauucugggcagcuaagagaggcacgguaguaaaaacaggccaucucaguuucaucacucucuuuaaguugccuuucuagaagucuuaccaaauaguuucucauacuuugaucagaacguauguaugugcccacucauaauacccaaaggaaaaucuguuuuuuuauuuuaagcagauauaugcuccugaaaucugaguucccuuauuggggaguugagggaauguuggguacaauaagcagucuuccauagacccuagagagaauauuccugaaauugaugugagugaaacucuggaguacaguaaagcaagauuuucuaauuugagaauacuuuuaucauauuuaccaauauaaguugauauuuaauaaauuuacuguauauauuggauacagauauaaaaguuacuuguguguuuguaguugcugucauuaggaaacaagauuuucuuuaaguguauuuugcaaugaguugcaacuaucgcaguuucuaccuuuuagcuaaauacuuuagucaucuaaauauuuugauuagacacuuaagauauaagaauauuaaacuuuaaauucccucaaagaacaaacuauauuaauaugauaggaauguuugcuguuuuuguugucauuuucaauaucauuucuauucuuauguuuuaggaagcuauuaacaucacauuggaucacaaaugcaaaauuuuccagaccuuaaauggagcuguagguaugcuuccuaaauaccggauugcuuacguauacaaacaaacaccuguguuuucaacuaucuuuccuuuguuauguccauuugggggcugugacuaaggucgacaguguaaauauuguaauuauuguaacuuaacaaaaauacuagacuugaacuuaacaucaguacauuaaauuaaaaucauuuccuaugacuagugugaaaaagauaagcuucuggcuuuagguaacuuaaaauuuagugucucaccauuugggaauuuuagauaaguuuauaaauuaauuacacuuuauuauuacacauuuucuagugaaauucuuuguauuacgaauuacccagaguauuagaguagauccuuuugacccagcugaaagauaacuggugacaacuagacaguagacuggggaagaguguguguguguguguguguguguguguguguguguguguguacaugcucguguggauaugcauaugugccuguguauuauagauacauauaucuugauaaaauacauuaaaacuaaucaauacaguaaaauuuaaaauauaauuuauuaacacauaaauacuuuuaaauauacauauaaaaauugagaauauauugcaauucaaucaauacuucaagucaguccauuuaguaaaaagauucuuaaaaucuagucaggcaugguggugcgugccuauagucccagcuauaugagaggcugaggauugauugaucccaggaguucgaggcugcaaugaccugugauuguguccuugcacuccagccggggccagaaagugagacccagucucuaaaaaaaaaaaaaaaauucccacaaugcaaaauguuuaguuuggagugcucaggaaauuuuaagacgauggcucugcuccucucugacuugaguuuuaucuugcuuaaugugcuaagucugauuuuuaagaacuggaaauauuaucauugguagccaauuguagaacccuugcuuaugccagacaauauucuacucaccaugcauauauuguuauuaucuucauaauaacccuaaaagacagacguggauaccauuugauagaugacuaaacugaguuacuaauuuaacuuggcaagaauaacaauacuaugaaggggcaaaggcaggauugcaagaugaauuauucugacagacagcucacuggcuuagcaccucaaucacuuuacuggugccagguuggagugaguuugguaucuguaucuguugucacugucauccuucauuuuggguaucugcuggcuuggaguagaugaaguuacuagaaguguuguagcacuuggaauauuacauccaugagaaauuuuguaaugaugauacacacacauacacacacagacacacgaauacagacacacacacacguauuuuaaauuacuaaagccuauuuucucuuuuuaacccagaugaaguuguuuuaaaauuugaaaauggcaaagccagagcuaagaauacauuuuaugaaacauuaccaguggcaauuaauggaaauggacccaccaagguaaguaacaguuacuuuuauuuggccaauucuuggagauagacuauggauugauauguggaaugucaucuauuuuauuuuuaaaaauuucuuucaaagacuuuauuuuggugcuaaaauaaagacuucaucuuuuacacaguauaucaucugguuuuauacuaauuaauuaaucaaacugauuuuuccucagcagagugauagccuuuuauucuauuuacagcacauuuggcguuuuauuaaauaauaacaacuaacuugggagugagccacauuucucucauacuggguauccuuucucauuaggaauugcucaggacauuaagagaucauuuguuucaccugacuugccguuuucuaaguuaacaacacuguuaagauugggguauuacaauauggccagaaagcuuccucuuucucuuauuucauuaacuacaguuaaugaaagugacauaauuugaccaauaaaauuuuggaugccuuucuguuucaaauguguauaauugagcuugcuaaaaauguuauugacugcaaaauuuauagaugaaaaguuuguuuugcuuggguccaaucaagcuggaacauaaauugcauugaaaaaauauaguaauacugugcuuacaacaaccuucugacaugcugaaaugccugguuuaaguaccuagaaaagggauuaacagauuuuuguugugggaagaaaauacugggggaugugggcuucuguuccagaggagugagugaucugaauuccaggaaaagcuaugugaauggaaagaaaugcaaggaaaacgcaugcuggcaacuucugcuccaucaaacugaaagaaguagauucccgucucuucuaguuaaucuuuccccuuugguuuucaucccauuccagccuuccuacaaagcaaucucuaucuugugcccuccuucagucucuaucuuauaaucaguuuccccagcucugucaucuccucauuagcauuuuaaagaccaguaagucuccuccaucuuacaaaugaaaccaaaccaagccaacacaagguagaacauccucuucaauccacacugccuuccaggcugcaccuggcuuuucuccuccccuucacagccaaaguuucuuaaaauauagauaacucgcugucacuacuccaccucuucccaucacaguaagaaaugcuccuguuaagguccauugugaaaucuuuguugaguaguggacauuguucagcccuuauuuuuauuucaccuaaagacagcaucugacaauucauugauuucguuugguccuacuugaaugcuccuucccuuugcuuccacgaugcucugcugcuuugucuauuuauuuucugggcuuuccucuucaaucucuaugguucuucaaaauauuuauuuuaaaaauuuuacagcucaguuugugugcauguagugacccucauccuuacuguuuuaguaaauguucacaggggccugucuggggccucuuccuuuucuuuuccauauacauuguuggguaauuugagucauuuccucaucagugaauucucucaaugcuggugguuuucaaauccuuccucuaacuccugugucuuuccuaagcuccaggucagaauacucaagugguagauuucuguguuacauauacccagagauuaagacuugcagcauuaccuccccuuauaacccagugguuaaccagaaccuggguuuuguuuuggcucuaggcacuucccacuccaaaagcccucuguucuaacuccugugcaugcugguuuuaucugauuuucucaguggccauagcaacuuucuuaguucaggccaccugcaaccuccuucuaguagcaaucacacccccagcagccuggaacuagaguauucugccaaagcagaaacccugucacucuacucaccuauauaaugauuuucugugaacuuagguaugaaguugaaaauccucaacuugucauacaaggcucuuuauguugcuccugcuuuaguggccaccaaucuaccaccccauucacucucccacucccaacccuacacaugcacacccucuucacauucaauuucuucuccuuucucccucuccgcucagcaauacuacauuacuuucaacuuugcagaaguuucauguugcugugucuacaaaucuucuguacauacaugcuuuuuauauauccuggaauccucucccccuaauucccaccugcugcaucucuaccugcuaaguccuucuuaucuuuuaggugucaguguagucuuuacuuuuugggucucuuguaugcuuuuguaaucucuggagcuacuucuguuacaguauguaucacacacuggacaggaaugauauuugccuguuuucuggucucucuuacuaggccuuuggucuaggaauuacagaaaccuuaucugucuuguuuacuuuuguuuccccaggguccagcacauguguagcgaauacuacgcuuucaacaaaucuuaauugaauguuagagucaauaaucuaaugaccuagcauuauucuugggaguaguaaggcagauuauuuucuggcagggcaaaagcauuaucaaauuacuauugguuggcugggcaugguggcucacaccuguaaucccagcacuuugcaaggcuuagguggguggaucacuugagggcaggaguucaagaccagccugaccaacauggugaaaccccgucucuacuaaaaauacaaaauuagccgggguugguggcacaugccuuuaaucccagcuacuguagagggcugaggcaggagaaucgcuucaacccgggagacagguugcagugagccaagaucacgccauuacucuccagccugggcaacaagaacaaaacucugucucaaaaaaaaaaaaaaaaaaaguuggucacuguaacuuucccuaggcaaauuuaauagaugaaucccuuuacuauguguguguagucacuguuuuagcugucugugauacugucagugccaguuagucaagagcugguagaaccccacuuuucccauaacuacauaguguucuguuccuccuugguaauauaauauuuuaaucaaauuuaggcuggugcggugguucacaccucaugucacguuaggaggcugaggcaggcagaucacuugaggccaggaguucgagacuggccagcauggugaaacccugucucuacuaaaaauacaaagaaaaaaaaaagaaaaaaaauuaggcagcugcuuguaaucucagcuacuuggcaggcugaggcacgagaaucgcuuaaaccugggaggcagagguugcagucagccaagaucgggccauugcacuccagccugggcgacaaagcgagauugugucucaaaaauuuaaaugucuuugaggagugauuuugguccugagaauuuagugauuauggauaaggccuuauguucagugauuucaacgugaucaccaauuccuuccaaauuuccaggaugaugcugacuggagcuuuaaaaagugacuaaaggacauaucacaagaaaaggagcacuaauccuuaaucauuuagaaagaccuagguguacuaagaaauauuaagucuucuuggaaacauuuucaguuugcacuaucacuguuucuggcauuucaagcuaugugaugcuccuauuauguuuucucugauauuaucauaucuaguucauuuuguuauucuauuagacaauaaaauaugaaguuuuauuauagauauuauauuugguauaauacaaaaacucgagaaaauuugaauauguaaacauuuaacacuaauacuuuauaauauuagguuaaaguuaaauaaauucaaaugaguaugucacguauucuucuuauccaggcugauggggaaagaaggcugauuauuacaaacauuuuuuaaccuuuauaaaagguggaaggauuuuuugguaugauuuuuuguaaguuaguuuuacuuauuauuuuguuuaguaauggauguuuauaaugauagugguuuugagccauaauauugaacuaaacauuuaagcaguuuuuucauuaaaaauguauauaaucuauaaguggugaagugauuauaguauguugaugauacuaaaguauaaaaaaugagcuuauuuccuacuuucuccaaauuuuaugccauuggaaaaaauauuaacaauuuuaaguaauuuuaaaaaucauuuauacugcccucccauaugguuuuaauucauagcuguuuucaguuuuuaugucuccucaguauauaucuaugaacauuuauauuuuccuuuguuuucauaguaguauauaaacaauuuuguguuucuuaauuaacauuuuauuuaaaacauauuuagguauuuuaaauaauuauuuucauacuuggucuguauaaaucuaauaugaaucaauuuuuagauagaaacugguuucuaauuugaagguuuacuuuuucuugaaacccauuuauuguuaguaauguauaagaugcauauuuuaauguucagccuuuucuuuuaaauaucaaacaauauacaucuuaauuaugaauuugguagcuuuuuaaaauuuuacuuuaaguucuuggauacaugugcugaacgugcagguuuguuguacauagguaugcaugugcuguggugguuugcugcaccugucaauccgucaucuagguuuuuaacucugcaugcauuauguauuuguccuaaugcccucccuccccuuucccuccaccccucaacaggcuccagugugugauguuccccucccuguguccacgaguucucauuguucagcucccacuuaugagugagaacaugcaguguuuguuucccguuucuguguuaguuuggugaggaugaugguuuccagcuucauccuugucucugcaaaggacaugaacucauucuuuuucauggcugcauaguauuucaugguguauauaugccacauuuucuuuuuuuauuauuauuauuauuauuauuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacagacccggcaaccaucagauuucucaauuuuuuccccacccuucccgccuuucuauuccacaaaaccgccauugucaucauggcccauccccaaugagccgcugggcacaccucccagacggggucguggcugggcagaggggcuccucacuucccaguaggggcggcccggcagaagcgccccucaccucccggauggggcggcuggccgggcggggggcugaccccccaccucccucccggacugggcggcuggccgggcggggggcugacccccccaccucccuccuggacagggcgacuggccgggcagaggggcuccucacuucccaguaggggcggccgggcagaggagccccucaccucccggacggggcggcuggccgggcggggggcugacccccccaccucccucccggccggggcggcuggccgggcagagggguccucacuucccaguaggggcggccgggcagaggcgccccucaccuccuggacggggcggcuggccgacuccccccccccaccucccucccggacggggcagcuggccgggcagaggggcuccucacuucccaguaggggcggccgggcagaggagccccucaccucccggacgggguggcuggcugggcggggggcugaccccccccaccucccucccggacgggguggcuuccgggcggagacgcuccucacuucccagacagggugguugccggacggaggggcuccucacuucucagacggggcgguugccaggcagaggguuuccucacuucucagacggagcggccgggcagagacacuccucaccucccagacaggguugcggcccagcagaggcgcuccucacaucccagacagggcgguggggcagaggugcuccccacaucucagacgaugggcggccgggcagagacgcuccucacuuccuagaugggauggcggcggggaagaggcgcuccucgcuuccuagaugggauggcggccgggcagagacgcuccucacuuuccagacugggcagccaggcagaggggcuccucauaucccagacgauggguggccaagcagagacgcuccucacuucccagacgggguggcggccgggcagaggcugcaaucucggcuuuuugggaggccaaggcaggcagcugggaggugguuguagcgagccgagaucacgccacugcacuccagccugggcaccauugagcacugagugaacgagacuccaucugcaaucccggcaccucgggaggccgaggcuggcggaucacucgcaguuaggagcuggagaccagcccggccaacacagcgaaaccccgucuccaccaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagacuguggagggagaggggggaggggggagaggggagaggggagaggggagaggggagaggggagaggguauaugccacauuuucuuuauccagucuaucauugaugggcauuuggguugguuccaagucuuugcuauuguaaauagugcugcaauaaacauacaugugcauaugucuuuauaguagaaugacuuagaauccuuuggauauauacccuguaaugagauuacugggucaaaugguauuucugguucuagauccuugaggaaucacuacacucucuuccacaaugguugaaauaauuuacacucccaccagcagcguaaaagcguuccuauuucuccguauccucaccagcauccguuauuuccagacuuuagcgauugccauucuaacuggcaugagaugguaucucauugugguuuugauuugcauuucucugaugaccagugaugaugagcuuuuuuuucauguuuguuggccacauaaaugucuucuuuugagaaguaucuguucauauccuucgaccacuuuuugauggagugguuuuuuuuuuuuucuuguaaauuuguuuaaguuccuuguagauucuggauauuggauggauagauagcaaaauuuuuuucccauucuguagguugccuguucacucugaugaugguuucuuuugcagagcagaaguuccuuaguuuaauuagaucccauuugccaauuuuggcuuuuguugcaauuguuucugguguuuuagucgugaagucuuugcccaugccuguguccugaaugauauugccuagguuuucaucuaggguuuuuauaguuuuagguuuuagguuugccuuuaauccaucuugaguugauuuuuuauaaggugugaggaagagguccaguuucuguuuucugcauauggcuagccaguuuucccagcacuacauauuaaauagggaauccuuuccccauugcuuguuuuugucagguuugucgaagaucagaugguuguagaugugugguguuauuucugaggccucuguucuguuccauuggucuauauaucuguuuuguuaccaguaccuugcuguuuugguuacucuagccuuguaguauaguuugaagucagguagcaugaugccuccagcuuuguucuuuuuacuuaggauugucuuggcuauacgggcucuuuuuugguuccauaugaaauuuaaaguaguuuuuucuaguuuugugaauaaagucaaugguagcuugaugggaauaacauugaaucuauaaauuacuuuggacaguuuggccauuuucacguuauuaugagcauggaauguuuuuccauucguuuguguucucucuuauuuccuugagcagugguuuguaauucuccuugaagagauccuucacgucccucguauguuguauuccuagguauuuuauuuucuuuguagcaguugugaauggaaguucacucauaauuuggcucucugucuauuauugguguauaggaaugcuugcaauuuuugcacacugauuacaaaagauaaacaggggaagagcuaaucaccugaucuacacaugaacauaacucauuucugaaacuaauuugauuuguaauaaaaauagagaugugaauuuugugcauaaaagcuguaguacuugggucacugugaccuugaauaauuggauaugauuuuuaaaaggaagaaagaggaaaggauuugggcggaaaaguuucucugucaaugaaaaugacaucauacuuggaaacauuuugauauugugaaagaagaaucaggaaaauacuaucaccuaguagcccaggagugcccagagcagccuaacugcauaaacagccuucugcaccgucuagagcugccagcaaaaaugucucuaguuuucaugaggaaaacagauguaaaugggggguggugaugguggauaaccucugccuguguggugagagguccaaaagagggaaguuucuagucaaaaguaauguuucuaaaauaucuuaguuaucuaggaaacaaauugagauaaaaagcagaggguaggaaagugacaaguuuaauuccgaaaacuaaaagugcugucuuuuaugcucuaacauuuuaaaacuagugaucauuuuaauauucauauagggauucuaguagacugaucaauaacucaugaaauaaauuuuacauuuuuaauaagauuucugagaugguggaaauaccagucuuuauauauaauagagauuuuagacauggccaaauauuugggaaauuuuuucugucuuuuaaaaaaacuuuuucucaggauauuuuaaauaaaacuaugcuuuucacccuugcauauucuuuaucuuuuuaagaaauaaugcuaaauaggggauacauuuccacauagauauuuuuccuucaaaaccauauuuuguagaacacaaaugauuaauguuugccuuugucauuugacaacaguaaaauauuuauuucuguuuuuauuaucaagacacauuaaaaugaccacauugacucuugaaaugucguuaauaucaugacuacaucuuuccugccuuguaauuuguuuccugaauuauccuguaguccagaagaaaugugaauggcuuacuuguccaugucuucuaauuuugcuguagagauuaaauguagcuauaucuauaauaucuguacaacacaaaguuuuucccauuuuaaaguucuuguuucagcaguguuuguuucaguguuucaguacaauaagaauauuugaacaggaucccaaauauuugagaggaaucuggcaaaaugguacccaacuacuucauguauuccacacuuuaacauccccuuuaggacuuuaagaagcuagaaaacucuaguugacacuuugguacauuuuuugauccccauguuuaacauggacuuuuuucuuuugauuucauuuuaccuuuccaaugaaaaauuauugaucauauaaugauaauagggauuuuaggugcuuuuaaauagcaugaggcaaaauuauaguuuguggaaagaaaauuuaaaaagccuauuaauaugaaugcucauaccacuacuggguauuaaaauugcagaagauguaguaauuucacuugcuguuuacucagcaggaucuucccuaacauguucaaauucuagggauauuaaaaauuuuguuugaggguucagagcaaaucuaagugugucuaccucugucaccuauccuucuuccuucacaccaccccuccccaaaacacacagaagagcacagaauuuuuuuuuuacaguuaaaaugaauaccaauagcuguuuaagaacagauaccucacaaaggggauacucagagagaucugaaagaaaauggguagagaaauaauauuguacuuuagcuuacugucacuaggauuugucagaugacuguuauuagugguugcccuagaucuguuuugaucugcaagcucucuuuuccugaaucaguaccccugaaucacugcccagaagcuuagcuuauaguagcauaguuuccuggaagagcuuagugucuuuuggugacaaagcuuacuuaguauuuauuuuguguggcguuguguuaguuagaggucacauuacuacugccccauuuacuguaggugucugugcucagccuuuaaacagguuuaucuuauuacuaaauuacuauucaugugacucuuauuuguauuuuuccuaauaagucucacuaucccauuuaaaacucuauuucauuguuugcuuuuucuuuuuugaucauccuuuccgguauuauaucuaauauaauaugaaauaaaaugaccuuuaugauuuauaagacuuuuuuuuugacauuucuagacauacuuuguccugcuuuacaauucauauucuggagaagacuauucagugugcaccuacagaugauauauuaguagaauuacuaaaggaauauaccugcugcagaaaacaugcuuuuaaauuagaugauuauagaaugaaaccacaccgaugagaggccugcuuucauuaauaaccuuuuccuucauuuacaagauucuccugaauuauuuuggaaacuauguacccaauucauggacacaggauaauggcugcacucuuugugaauucgauacagucgacuugucugcaguagauguaaguggaauugauuaugugugaaauguaguaauagaaaguacauugucaugaaauacugugauuuauaggaaaaaaggcaaauuauuuuauaguuuugauuuuaugauagauaauggggauauaguguuaaaacaugaugauucagccauuugcuagauuuguguuucagaacuguuuuuugacagaaaaaccagcuaauaauugaaccuaaugaaagaguccugugguuaauauuuaauagcuuacuacgauugagugcucuuguguuuauucuguuagcuuagucaaagcauugagaaaaaaucauuacaaggcuucagcauuuuuauugacuaauuuuaucugugcuggauuuucaaaguugauauguaaaaauuaauacuaccugauuauauaacaaacgacuguuuuaacuacuuuacauauaauaacucauuuaaacuucacaaaacuccuaaaauagguaguacaauugacucaguuuuacagacgagaaaacugaggugcauaaauguaaguaacguguuuaagggcacacaauuuuaaguguuggaguugggauuugaauauagggagucuggcuccagacuacuguauguucuugacacugugcauuuuuaccugugugauguguauauucuaggcauguugcuacuuguauguauuucauagauaguuauauuuuaucauucauguuuugagggugaacaaagaguugaaaauauucauuauuaaucuauaaaacauuuuuauguaucuuuguucuaacaucagccagagcugauaucuuacaacaacauuuuuauuccaaaaaauugcugacauaacauggaagauuauauguaugaagcauugauucuagggaguuuugucauuaagacugauuuuuuccuucauucacuguaaguucauugaguaucuacagcagccagaaacguagaagcaauauaggcaaaaauaaagcucuuaggaauauaguacuacuaacuccugaacccaugcaaaugcaaaauacuuuuacuguaauauguucaagcuccugaauuaaauaguuucuauucuuaucauugucugaaaggaguauaaagaguaacuuguguacauguaggagcuuaugaauagagcccuauuuuacuugaaaguaagguuuuuggccagucucucagauagcaaacuguuuccuaucugcaaagaaugccagaauauuucugaaugaagcugcaucaugaagauguuuaaaaauuuauccugaucuuuuuuugccgaaaguaguguugucuucuggagggcgaguuaauacuuuuuaucuguuucguuuccuuuuguauaaacuuucuggugcaaagauagaaaaauauuuauauuaacauuuuuucuuuuugcauguaggaguauguaauuuaauacuuaagcuguuuugucuuacagcuuguuaaaaugugauagaaaggaaaacuauucauuccauuaugcauaauaaaauuacgugcuauauacagcuguuuuucaauagggauauaaaaauuaaaauuguguagguaguuaaaucccaagccuaucauaauguuagaugugggccauaggcaaguuucuuuauauguaaagucauagugauuaucucagaguguugguaggaauguuaaaugaaauuuuacccacauauauauaugaauauacauaacaaauauauaaaugauauucuauuuguauaaauuuaauauacauacacaaaguggucaguauucaauaaauguuaacuguuauaauguuguuguuauauaaacaugaacuuagguuaauaauggugauguaguggauugaaacccagcacuuuacccucaaauauauguguucuggguuacuuaaauuucucuaaaucucauuuuccucaugugcauauuugggaaaauaaccucuaaggcuuuuauguaaauuaaaugaaacgcaucaucucauuugauaaaggagaguugugaccuacuuuuaaaauuauuuuuccuauuaaauugagaacuacuggagaguagauauuuuguguucuuuguauuuguuuauucauuuaauaauaaauauuugggcaagugaaugaauagaugaagaaauaugauaguguacaagguguacuuuuaugugagcauauguuauuauacagauaauggaguaaugugugagguaccguguaugaaaaaauggaagaagguugcuaauucagcacuuaauguauaagguauuuaaaaauauuuguaauucuuuuguucagacuuuaagacauggcuuuaguaagacauuauaaacaagucuuccauagauuucuggucaugacacuguuacauggguguuuacuuauguuccugucuuccccaucuacuuguaagucuuucaagccaggaacuuucauuccuuuugccaaauauugcccaucuuguggauuggaauguauaauggcuauuucagaauuguuugugcaauuaaugaaggauaaacuccacaccaaaacauaucuaaagagaacuuaagaaaauauauuaaaauauauacauuaagauaagauauauuaacauuaaugaaagaaaauagcucuccuuauacauaauauaauaaugaaaggaaauaaaaggauaaagucucaggucucccaugauugcuuuuuaugugcucaaaauuaagcccugaacuuuaagccgaggaaacaaaaagagaaacacaauuaguauuugguuucuuagacgaaacuuucaaaauagcuuucagaugugaagaaguuucugcaagggcuauuuuaaaggaagcacugacuaguaguguaggcaguaccaugaauuacauucauguaauaaauaggauaauuucaucuuuaaaccuaacucauaaccaagaugggauucaguaaaaucacuuugauugggggggccacaaaaauuuguuucaaguguuagagaacugccauggagcaauucaaauuuagcagauuauguugaauugauauucuaguauuuuuuaugucaugcugauuaacauuugaauaaaauuuaaaacaaaaccauacuaaugauaauuuuauuuuuauguuugguguaaaacaaagguccauccaaacguaucaauagguguuuuuauugagcaaccaaccccuuuucuaccucgguuucuggacauauuguugacacuggauuacccaaaagaagcacuuaaacuuuuuauucauaacaaaguaaguauuugagaaaugaauauuuuaugucaaaacuauuuuuggucuuuuuuggaacuauuuguuauuuaugucaaauaaaauucauuggguuaaguucaguggaggauuuuuggaguaauuacagcccugccuuuuuaggaccuaaggauuuuagauucuagagacuagcaccacaauauugauaugagccacaugaaacugccaguuucuguagaucaaaaauggcugaauauuagccaucaucauauagcuuaaauuaauauauaaucaaggagauucaaagggccuuaaaucccuuugccuuuggguuaguucugguacuuucuucuauagaauuggucauuaaauuguuugugauuuaagacaauaacauauaagaacuugaaacaguuuccagauagaguacuguuuugauuaauuacacaagggcaugccauuccccaaaggauuuugauacugucauuuucuucaaaaauauucagagcccccuacauaccuccuacauauuauccaaacuugaaaauauuuuuccucaguauuuuuacaguuauuucuugucuacuaaaaccacugguauuuaacauugucuagaaaaacucaauagcugugaagugugcgauuuucucucuucuguccuaauacuguuuguuuaccauuguuccuuuuuccuaauguaaaugucagcuaaccauucacauuguccagagaauauuuuaacugcagaaaacuagcuuaaauggauuuaaaauggugaaaaauugagcauuugcuuuguaaaauauguuguaauauauauacuuucacuaaaguauuuuguuuuuauguauugucuuuuguuuauauuuucccugcuuucauggggccuuaaaauccuugauggcggacguuuuugucuuaucuuugguuauuuaguauuaacucuauguugcuuuuaugugauaaguuauuuuaaaaaucugcaaaaagcaacagcuuuucagaaaacuuagagacuugacaaauaaaaaucucugaaaugcucuaaugauggagacagauaaucuuaccugaauuuuagcacagucgaaucacacuaaaauugguaaccuuuauguugaugguuuucccauuaaucuguccauagaauuuuguuaaauuuuuccuuuuuuuguuaaguaaaauuuuuuuauauaugaccauuuauuuuacucucugguuucaaaggguauuuuguaaaaugugauuauuuaaguuuauaacucagauugauggcuauuaugcuuaguagacauuuuuucuagauauuucacaacauauaucuaagauuucuaggcuacaggccguguuuuucuucuccaguuggaaacauuuuauauuacuaaggauuuaaguauuuaugcaaacaccuauuaaagauuuaaguauuuauacaaagacuugucuagcaguagauauugacagaauuuugaagcaucuucucuuuaagaauauugauauauauguauuuaagauuauucaugugacauuuaagugauauuuaaauauaccguguuuaauaugguuauuauuuuauauguaauugaauaucugaauuguagaauucaugaccuugaaugugaagcacucucuaauaugaauacuucagucaucugauugucuuauucucuaauuuuugauuuuuaaaauauguuacaggaaguuuaucaugaaaaggacaucaagguauuuuuugauaaagcuaagcaugaaaucaaaacuauaaaaauaguaggaccagaagaaaaucuaagucaagcggaagccagaaacaugggaauguauguuuuaauaaauuaaaauuaaauuaaauuauuuuacuaaggaaacguuaagaaaaaauaaacuuuuaaauuaaaauuguuaugccaaauuugggugucucaaacuauuuguuugcguaugcaguagccaacuuagacugugucuauguuuguacguauuuauacauaaagggcuguagaaguuacuuauguuuuucuuuuaauggcuacgaguccacauauuuaaucaaaugaugaaucaagguaagaucaauuuuuuuuaaaugcagauaaaugaauaguaugacuuucauagcagugacuuaaauuuaaauguacacucugaagguugugugugguaaaaguguguuuauuuagacugugggggaaacaggugcucuuacucuccaguuagucacugagcuagauaauacuguaaucccaagaaacgggcauuguaggccuuuuguuuagcccuguuaaugcuucauucuacuaauaaaacucuaguaauaguaaaaaaaaucguguauucaaugaauauuaauugaauaugccaggaacuguguuaagaguaggugauaaaaaggugaagacaugauccauucucaucaggaaauaaucuuaucuacuacgaacccucaugccugugcugcagaagcugaggucccagagggauggauucugacuagauuaggggucuagggauagacagaaaagaggccucugaaaaaccaaacugauguuauuacuaaugauuccauaauuuauucauuggagaauccucuggguccacauucagaacauauuuucuuuaauauuuuucaugauuguaccuagugcuucugucugguauuuuguuugauaguugcuucgaacaaauaugguguggagacacacacugacaacagcaaaaagugcugacugggaccgacagugagggaggggagcccagagggaaguugauaacccaaaugucaucugguaucuccaguuguucauuccuugauauugcugaugauaauguuacaaacuguaccagggaaagcaaacauagucacugccccugguaagaaggcaggggaauaacuaucuuagaaaauuugaugaaaaucaaguuuguaaaauauuaauaccugaaaagucauauacuuacaucuccaacauucauuuaaaacugaguugugggauauguaaguugcauuugugugcauguguauguauguauguauguaugcagaaacauuuugauuuguggauguuuuaugccuuaaaauauuuacuggcuugaaaauauauuuuaacuggcuuaaaauuuuagaggugagcucccugugaauauccguguuaaauugaccauuuugaaauuuaagacaauauauauaucguuucagauauuguuccacuauuuugaucagaaaaguaugcuagagaaccauauuuuacauaaaagaauauauauauuaacauuuuucagucagcagauauuuauuuuaugucaugcccauuucauuuucuuuuucacuguuagggacuuuugccgucaggaugaaaagugugauuauuacuuuaguguggaugcagauguuguuuugacaaauccaaggacuuuaaaaauuuugauugaacaaaacagguacuuucuaaaauucgauaucaauuuauuguuaaaaugauuauuuuucauauugaugugaacauacuguaguaauuguguauuuaguaaauugagggaacuuaguuauguucuacagcuaauaaacuuucaauucaaguuaauuauuuuucauuuaaaggagucauagaaaacaaccugaauacaucuggaauuauuuaauauuaguuauaaucacaaauacaguuacuuggcccauuuuucuguuuaaagcuaggugaaauuaugauacaucugauacuaaaauuuagaguuguuuuauucucuauagauauuuuuaaaguagaauuucacaaaacuucugaccaagauaguuauugcauacagaguuguaguccuuaguaucagaaggaaauuucagagguacaaaucaucccacagucauauguguagcuuuauuuacuguugaacuaguuaucacuucacagugucuguuugcucauuuaacucaauugaaaugggaaaaagacaccauguauaucagcuuacaaugauacuaaguuuguuugucaauacuacugcuaauacuaauaauaccauuuuuacuacuccugcuaagaccucaccuuuaacaagugcuuauuaagugccagguauuguuguaaguacauguauuaacacaauuauuucucauaauaaauagaauguuuagcgggugaaauguuagaaugauuguuuuuauuuuguuaaguaagauacaugggaaauguaguaugcuuuauuaacccacccuauauauaauaucuaucuauauauauauaucacuagaauuuguaaauuugagaauuuaguucuuacuucaaaaaucuaagaccucucuguagcaaccuguauauacagcccaacuguauagcuguguuauagauacucaguaucuaaguuaacuaucuauauacaucguagguaauuuuccaaagcauaugaaugagguuuugaucauuuggcaaggaaaagcaguugugacacccuagagauaugaaauaguguaugauuuguaacucuuaaaaccuaguuuaauucaguacuauuuucuugaauuugcauuguuuucucuuaauuugauugaaaugcuauaguguguaaugcccauaugcuuuuuaauaauuagauauuuucauuuuaugacuauaauuuauauauuuauuaauuauucucuuagugaacuauuuaaugaauuuacacuauguauuugacauauaucccucuuaauauuaaacauuuuaaaucuucuaaaagaaaaaaaauucccggccgggugugguggcucacgccuguaaucccagcacuuugggaggccaagguggguggaucacgaggucaggagaucgagaucauccuggcuaacacagugaaacgccaucucuacuaaaaauacaaaaaauuagccgggcgugguagcgggcaccuguagucccagcuacucgggaagcugaggcaggagaauggugugaacccaggagguggagcuggcagugagccaagauugcgccacugcacucuagccugggcgacacagcgagacuccgucucaaaaaaaaaaaaaaaaaaaaaagaaaaagacuuaccugccaucuggggcccuugccccuuaaagaguaaaacucaggcugugucuccauggaauucuguuaguuaaucaaagguuuagguuuauguaauaccuaugguucuugcuucuguaucuagacaugugguuucuauagucuauugacauaugccaggaauguugcaagauuuaguagauuggacugaagaguagagaaagagauuugacacaucuugggcauguggcuuucuaccuucucaucagcucucuuuuuuccucuucucucccuaucucuauuugcucccuugcucuaaauuuuacuccuuaaauuguauaauaauaugaaucauuccucagcugccauccuuacauuuuuauucacaaaaacauugagguauacagcagaugaauuuugguuucccaaauuuguugguuuaaaccuuuucaggaggcagcugggauuauaaauuacaaguucuuuuuaaauuaaauguuugauauucauauugaauuauuucccaaauuaauguauguagauucuaauucauguuauuauuuccaguauuguagguauucaaaacaaaacaaaacauguguuucugauuaauaguuuaguaggaauucggaagaauaaaccaaaauuuauuauuuugcaugauguguauuuauuuuuauuuauuuauuuuuuugagauggagucuugcucugucgcccaggcuggagugcaguggcaugaucuuggcucacugcaaccuccgccucccggguucaagcgauucuccugugucagccucuugauuagcugggauuauaggugcgugccaccaugccuggcuaacuuuuuuugguauuauuaguagagaugggauuucaccauguuggucaggcuggucucaaacuccugaccuugugauccgcccgccucggcuucccaaagugcugggauuacaggcaugagccacugcgccgggcccgauguguguuuauuuauuucacuuuugugcauguaauagaaagggcccggcuggucuucacaagauagaggugaaauagguuuucuuuuuucauauaaagaauaguuguuccauaaauuugcuuucuaaaauaguuaaaggaaaguucaguguugccaggacuagcuuacuguaaucacaagucauuuuuuaaagucauggaaaacuggaaacauacuuaaguaauuugagacuuaauuacaggaaagcuuugccuguuuacaaacaucucaguucaucuucauucauuuuuuacaaauucaacaaauauucauugaauaucuuaaaugcaccaggggcuguuguucacccagugacaaugaaaauauuugguuucauuuaauauagguuccgaaauacuuuaguuaaacuuaaauauaauuaaauaacuaaaguaguuucccucuguuggauguaagcaaggcauuuuuaaaagucauuuuuauguauucauuagcauuuucaauuacuuuuuccuucuuuguuacucuuuuuaagaaauaugauugaaaauuagcaauauacuuacuuaagaaaagauguugggaaagaagauccuuauuuuauuuuuauuaacuacagguuuguugaaugagcuuucuuguguuauaugucauacuaagcccaaaauacauaauucugugguaauuuaaaaauaaauaauuauauagguuucucucucucacacacacucucucugucuuuagaaagaucauugcuccucuuguaacucgucauggaaagcugugguccaauuucuggggagcauugaguccugauggauacuaugcacgaucugaagauuauguggauauuguucaagggaauagaguguaaguuacuugguuuaauauuuuaaugugaaauaccauaaucuaaagauguagucuuguuaguauuacuugaaauuuuuuuugcauucaucucuuuucuuuauaguuaaugggaauuugagaacccaagaccacuuggaauccugaaauacuaguauaaaacuaauaucuuaaaaaaauguuuuuaaagucccaaaucuucaaaggaacaagcucauugcuguggggaauacuaagagauaauauauguuuaccauacucacauuaugguugauagaagaguaauacucuuuauuuaaaagcuuggaaaggggauuuaguuuacuaacuuuuuaaugguuauaauuaaggguuguuuugauagguuuuaaaauuuauaauuaagccaacaguaacacuaacagccagaacauuccaguauuccugauugcaugaguuuuuuugugugaaauagcuauuauucugcuuuaaauacaaguuuuuuuuaccaauauuagauuuucacuucuagagauugaaaagaauauauuugcugaaaagugugugcaugauuuauauuuauuucagagacaaugguugauuacuaaaaauaaucacaauugaaauaguuuugcuaagguaauauuggagaagaaugucauucuuuuuuucauacauaugauggaccagagugacuaagacauuacaugcuuugccuuaguucucaaacaugucagccugauuaaaaaggggcaguauacucucaggacuaaaaggaugugcccuuacauuuagaaaaaaaaaggcacacguuucuguucaaacaguugagugguaaaaagauguguugcuuguggaaauaguaauugguguggaaagcuucaaucugaaugauguaaauacaauaaagguuuuuguuagcugcaauuaaaaugcacaguggaggagaaaagacuauuaagaucguauucuguuguuucugugcaguuguauugacucugggugaguuguauagacaauauaccugauuguaucuuugggcacaucacaaaugaggguuugugaaaguagaauggaaaauuuguuucaaguugcuuuaggcauuggugauuuucuguccaaccuccugucauucuugucuaaaguauaaggaaaaaaauauggcagaagcuuuugaucuggaauacacuucauguccaaaagcuacacgaaggagcaacuguguguguguguguauguguguguguauaaguugaaacacugaauaauuccccagagauuaauuucugaauuuagcugacacguuguauacaguaauuccccuuuaucuaugguuuugcuuuccaugguuucaagucuacuguggauugaaaauacgaagauauguugagauagagaaaguguaaacauucauguaacuuuuauuacagcauauuguuauaguuguucuauuauuguuguuagucuuacuguacuuuauguauaaauuaaacuuuauuauaaguauauauguguaggaaaaaacguaguguauguguagcguuuguuacuaucugcuuucaagcauccacuggggucauggaauguaucacccucacauaaggcggggacugcuguacuccuuaaggcauuuuucuuugaggcuagucuaguaagacauaauaucauauuuccguuaauaucuaacugcauuucuuggucaagaucuugccuugauguucucuaaaagaaaggcgcacagucuuaggggcaaaacuuguuuugcaguuuuuaugaaaucagucauguucagagugagaauauagaugugggaaaggaugcaacguucaugugcucccagcuguauuucuucauguuuuccuuuuucuauaaaauauuuaagauggcuuaaugaaugguaagagaauauaauuuuggagaauuuuaggcuauauucagugguauuuugguaaauguguaacaacuggcuuuuggagguggaggauucccugauuuaaagugcuugcccauuuguuugguguaaauacuucuaccauggcugauuucaaguuuccaaugugaaauuacugaacauggacuuggcagaaaaaguuaacuuuggggagccaguaugagcugggucuagugcaccacugguuguauguuaugauucaugcuaucaaauucuuuaauuuuaaauagaaacaccgucuauacaauagauuauaauagucuaauuguaacaacugauugagauaugauagcuauaauacaaaugccaaacagauaccaacccaaaauugaaauguauccaaaggggcagugguuuaucuccuaaaucucauuaaauauaguguauacaauguaaucuuauauauauaucauugaauauauuuguauguugauucaauaauuuauguauacaaaaucuaaacacaaagcauuuauuuuaaaaagguaaaaaugaaacuuaaaauuguuuguauuugugguauauaagaaugucuucucuuuacuuucagaggaguauggaaugucccauauauggcuaauguguacuuaauuaaaggaaagacacuccgaucagagaugaaugaaaggaacuauuuuguucgugauaaacuggauccugauauggcucuuugccgaaaugcuagagaaaugguaagauaugcagugauggcuugcuugaauguucuuauaagauggcuugcuuuaccaguuggugugucacuguguuuugaugcccuuugucuugcuaauuuguaaguacuagccaauuuuuuugguucuguguuaaaaaauuugggaguaauuuuggagauaauuuaacauuuacuuauagaaaugguaugaaaaauguuaguuuuugugcucgggcuaauucauaggcaaccgaguuggauuucaguaauaaagauguauuuguuacaaaucagcuuugcucuuuuaagaauacaucuuuaauuugaaauucuauagugaaaacuugaccuaauuaaaauuaauuagauaagcuucgaugaaacaauauuuccagauuuaagaauauuuuuguucuaaaauuaauguccacauuuucucuaacuagguaaaauuuuaaaauuauuauuaacuucacauucuuagaaagcaggauuauuaccaccaaacuaguagaaguguugagauacauaguguauuuacucuaaauaaaauacuaaugauaccuugcugcacuacaaauguacuuuuauuauaaaacuuaaaaugacuagaaaauaauuuuucaaaaugcauaaacauggcuuagaauauauugauaugauuuuugguuuuagaaaugauggggcuauuuuauuuccgauuuccaaauuuauauaagcaauugugauuugaugaaaagucagaaaaguuggcaaguauuuuuuucuuaguuuaacaaagcauguauuguuugaauauguuuguuuucucuacaaaccugugugcauuauuauugaauauccucaguacuugugauaguauuuugugcucauguuuggcuaauuugacucaacagcgcaucauggaauggccucucuuacucauuuuuuccguugucuuaugugucuaaugaaaguucugcuaaggaaugagcuuagacuuauguuugaccccaccacaccucccaaaaagaaaagaaaagaagggcugaaagagcuggagauguuucuuugugugugcuauaagcuuugcuuguucugcauguugucuaugaaggacauuucagaauguuagcuuuugaucaacagcugcuauuauuuuuauuuaccaaagaauaccugagagagcggguguacaggucaacuuacccaaugcuucucuucauuuuagacuuuacaaagggaaaaagacuccccuacuccggaaacauuccaaaugcucagccccccaaagguguuauuuuuacuuauuuuauuuauuuuuguuuauuuaauauuugauauaguauauugccuaguaguaaaguuucuuuaagggccuuauuugcauuuagcuugguaaaauguugauuuucaucagucaucuguguguuugcguguuuugugugacuugggcaugggucuugugugauagucaacucuugguucuuugagcugauuuauauuuuauggcugacaggugacaaaguuaaaccuaagucccuuucauucuuuuuuuagguuuuuauuucuuuuuaaagggagagaagaggguagaaguagguauaaaauagaauuugauuacaguaagguuuaggugcaccuuauugaguuauuaaucacuaacucuuuuacuauuaaaacagguccaaaaagaaacacauuaccuagugguguuugccacauuugucugguuuggggcaagaauaugagacugguuuucuuuaucugccuuuauaauguaugacucauuugcguguuagccuuuaaacauuagaaaaagaaaggaaugaaacagacuggugaaauauaacuggcagugaauucuugauuaaaaaugugaugcuuucuuugaaagagaaagaagccaaaagagguauaauucauugcacugugucucaaaaauauuucugcuuucaaacaggaauuuuuuccccgaugucuacaucuaggaucaaugagaaagggacaaaaacaguccauucuucuuuuuuucaguugagugucagugcuaucuacuaguuuuguguggugucugaauucauaaucaaaauuugaguuuuuuauuuuaaacuaugcacauuuuauaugaauacuaaaaaugcauguucauaaaugaaauauaaagauagaaauuaauaucuucuauauauuuuuccuaugauuaaauuuacuuuuguaccuaccucuaagauuaauacuguuauuuucuggcauauaggguguauuuauguacauuucuaauagacaugaauuuggaaggcuauuauccacugcuaauuacaauacuucccauuauaacaaugaccucuggcagauuuuugaaaauccugugguauguauuucauacucaacuuuauuauuuuucuauaacuguaagugguuauaaaucaguugguuaauaauaugaaaugugguuagaggcuuuuuaaaaugacauaaggugaaaugcacaucaaaaccacaaugagauacugucucacaccagucagaauggcuauuauuaaaaagucaaaaacaacagauaugggugaggcuacggagaaaagggaaugcuuguacguuguuggucggaaugaauuuggaaagcaguuugaagauuucucaaagaucuuaaaacagagcuaccauuugacccagcaauuccauuacuggguauauagccaaaagaaaguaagucauuugaccaaaaacacacaugaaccuguaucuguucguugcagcacuauucacaguagcaaagacauggacuuaaacuagguguucauuaaugguggauuggauaaagaaaauguguuacauacacaccauagaauacuauacagccauaaaaaagaacaauauuaugucauuuucagcaacauggagagaacuggaggccauuacccuaagugaauuaauggcacagaaaaccaaauacugcauguucucacuuaugagugggagcuaaacauuggguacuugugaacauaaauauaggaacaguagacccuggggaucacuagaggagugagggaguagggagggggacaaggguugaaaaaccaacuaauggguacugugcucacuaccuuggugaugggaucagucauacccuaaaccuuagcaucaugcauuauacacuuguaacaaaccugcacauauacucccugaauccaaaagcugaaauuguuuuuaaaaaguaaauaaaaagaaaaaaauuaaaacgacauaauuaauuguauuucaugaucuauagaguagaucuaaacuugaccaauaacuuguuuuuauuaagacacuuauuagcuuuggggaagggaauuaucaauuuguucucuuucaauauucuauuauuuuuguuuuguguauucaaaagcaccauccaguuuuaaucacaauuuuagaaacauguuuacaaauaguucacauauuauaauaguuugauuuuuuagaagaaaauucaaaaaguuuuguuuaggaaaauacauuuuuuaaaauuauuuuuugacaauuuugugaauguacaucaaagauagccagagagaauugcagagaaagcugauugauucagcauauggagucuuaacuugaagaaacaauuuccuuuuaaaaucuguuuucuucuucuuuuuuuuuuuuuuuuuuuuacagauuugagugguacaguaauuagcuccuuuuguguuuuacagggacaucuuuuuguuaggcaaguggcacacuuauucaagggaaaaugcugucuucaacaaucaaaccuguaacacugcuguaaugauuuuccccuugccaauaguaaaaguuuuaaauugcagacucaauccaccugaugagaauuguccuuuauuuuguaggaauaguugagauauggggauaguaaauguaguagucucugaauauucugaauaggaaaauauuaucuuuugacauuuuguuauuuuaaaaguacuuuuguuccauuuuaaccacauaccuuccucuuucacagaaauaaagcugaaaagagguguuuucuagucgugaggguagaauuccauauuucacuucaccauugaaucucuuggugucuugagggauagaauuauuugauuucuugggugacauuagguuccuggucagauauccugaauuauauccugaauuguagauauuuguguaagaauucaagucuuuggaaaguaagcaaugaaaauaucagaacugaguaggaacaaguuuucuuuccauggcuuucuuuguuaaagcagccugauuaauaugccuagugagggauaccccauagcaaaaugcuuauugauuaucccauuaucagaauuucuaagaaauuaauaaagucacaguuugcucaaugauuugaaaggugaucuaaaaugaaaugugaauacuaaugcccuaaaauaaaaucuuaggggauuuuuuuuuuuacuuuaacuugaagaaaaaucaguauugaugcacaggaaaaaugcuauagguaaaaguucuuaaaucuuauggaugauuauucaauuucuugccacauuuuagaaucagaaagcuaauuaauauuagagggaauaaugagauaauauagaaaucugauccauauauacuauauaaacaugaaauuuauuaaaauuuugaagauaccuuuguuuccuccacauaaaaaauguuugaguuacauauaaacagauaugcaaaaccagugacauaaauuaugguauaaauauucagccccuaaaaucuagccucaaaagauguauuuaaggcaaauaucuuuuaaaacaucuuuugauuggaauuauuuugagucugugucucacuuccucccugcuggcucucuguauuugcacuuuguaaagagaaaauuaauaauuucuagaaauauucuaaauuucagaagauaucuuuuuggauauuuauauuacuccauguauuaauaauauuuuaguaaauauccauauuugaauaaagaacuugucccaauaaaauaauucuuuagcuuuuguugaaaaaaguugagauaucuuuguguguggauuuuaugccagagauuggucaaaaagaaucaaauucauggauuagaauaaagagaaaccauuuuuuaauauagagcccuaacccuuaauuuuaguaacugaaagaagugcaagugcuaguaaacucaugauuauuccuugauaaauauuaauaacugaagugaaggcagaaauuuuaaaaacucauuuaaaaaaucaaauuuagaguaauuuacuauagacauauaagacagacccuaguuaauuaguucacuaauucauuuuuacaaauacuuguugguagaauuuugcuccuugucuuuuaccuuuaagcacaccuuuauuuaccuacucuguguauauauuaaaauacugaugguccccaacuuacgguggcuuuacuuaggaauuuucagcuuuauguuggauuuaucgggguacuguguguuuuuaaccucccacggguuuauugggacauaaccccaucgugagucaaggagcaucuguaaaauguguaaaucuauucacuguaagauuacuuaaguuuuaaaauccugagguacaauauuucauaaauaaaaauuuuguauuucauagaaugacauaagcauauucagaaccaggcaaagauuaggcuauauacugugauuucugaaaauuacuauuuuguccacuauacauaaucauuuauaaguugaauaauuucuaaaaugcauaugcuuuauacuuuucagugaaguauuuauaaagauauuuguuuuaauauguacuucuuuuuauaggacuggaaggaaaaguauauaaaccgugauuauucaaagauuuucacugaaaauauaguugaacagguuuguauuaaugauuacaaaguauagaaaauuuugcuguuauuuuccagaagaaauauuauuaauacuacuuucacagaagaugugaaaguggagaaacuaccuuuuagguaaaauuuauuugauucaauuacugauuaaauagcauuaaggaacauacaguuguaaaauguagaacauagaaauuaacauuuuaaaagcaugccuuuuuaaaaagcaugcuccuaugugucauagcuuucugaaaccacuaaaaauagaaacuguugacagaucucugauguagaacucuugcagugaaagcuuaucuuuggaagaaacugggcugucuuucuggaagagucuuuucucagagacaucuuugaaacaugaauucucuuuuagcuuaguguucaaaacuauuguuaauaccuaauuuuugagaauguaagaugucaucaauucugaggugcaccauuauuuauguaccaugagaaaaaaaauacugucaauaaaccaugacagaaaacuauguuuccuagucauacaggauuuuuuauuuuacacauauuaaaauaacuauuuuagacuauuaagacacagaaguuauuaugucuucuaacgaugaugcauauuuuauagcccuguccagaugucuuuugguuccccauauuuucugaaaaagccugugaugaauugguagaagaaauggaacauuacggcaaauggucugggggaaaacaucauguaaguuguaauuucacacuaagaacuaaaauguauguggggguuaaguagauacucagagaauucggagggguuauauacuuuuucucauaugucucugaguucuagacuuagauaaauuggcuagccaaggcucugauuucagucuacuucucccaccaaccaauuuuuuuaacacuuaaguaauuucauuaguuugggcggguuucucauuuaugcauguaauuacacuggauguucccuaagggucgauguccucaggccagaguuuguuagguaacacaugucuuuacagagugaugucacucuuuuccaaggccacuuuuuauuccuugcguuuucacagugagcuguggugaaaauucuaaggcaaauguuaucuggcucugaaaacuguuuuuguguguaaagauaggaaggagggaucugagugccuuagguguaauucaguuuugcauuugcauucagugucaaagacuuggcaggaaauacuacugccagugguuagauguguuucuuucccucugagaacagacaugccauuuuagcagaauacucuggaauauuacugccucugcacgguuaugucccccagguaaugagcugauaagggagagggaagcuuaaaguauaaggaagaacuuaaguuagugggugaugaaauaaugaaaagcaaucauucaaaaacuuuugaguguuacaaauagaagugaggaagggcggggaaagcuuguuuuuaguguuugguaauacagacagcagauaugcuaaguguaugcucaucaagcagcugagacugccuaaagggucacuguaaaaaaagacucauuuuuaagaaaggaugugagggcuuaggaagucaauuuuauuuacuuuauagcuaaacuucacauauacauuuaagaaguaggaaaggagucuacugaccuuacauuacuuuguuucgucauuguaucauugacaaagcuguuaccuaaguuauuuugauaauuuuacaguuaaagcagaugauauaccacauuggaacaacuguuauuuuuauugucuauuaugaucugugguugaaaaaaaauacuauaauauaaaugggaauugcacguggaguacagcuuauuaugucauuaauguuguuucuaggauagccguauaucuggugguuaugaaaaugucccaacugaugauauccacaugaagcaaguugaucuggagaauguauggcuucauuuuauccgggaguucauugcaccaguuacacugaaggucuuugcaggcuauuauacgaagguaguuauccucucaccccuccagccuauuucuuacccauuuuuacacagguguucuuuuuaauguuuuuauuaauaagcaaauccacuggcuuacuuugcuuuuucagggauuugcacuacugaauuuuguaguaaaauacuccccugaacgacagcguucucuucguccucaucaugaugcuucuacauuuaccauaaacauugcacuuaauaacgugggagaagacuuucagguaauuaugacucuuguguuuuuagauuuuucaaaagaaauauaucauuaugaaaaggacuuugccuuaggccuuaguuucuuuuuuaaauuuugcucaaaugacauaauuugaauuuugccacugguuaaauauaaucugauguauuucuucauuuuaacuuuuuuagggaggugguugcaaauuucuaagguacaauugcucuauugagucaccacgaaaaggcuggagcuucaugcauccugggagacucacacauuugcaugaaggacuuccuguuaaaaauggaacaagauacauugcagugucauuuauagaucccuaaguuauuuacuuuucauugaauugaaauuuauuuuggaugaaugacuggcaugaacacgucuuugaaguuguggcugagaagaugagaggaauauuuaaauaacaucaacagaacaacuucacuuugggccaaacauuugaaaaacuuuuuauaaaaaauuguuugauauuucuuaaugucugcucugagccuuaaaacacagauugaagaagaaaagaaagaaaaaacuuaaauauuuauuucuaugcuuuguugccucugagaauaaugacaauuuaugaauuuguguuucaaauugauaaaauauuuagguacaaauaacaagacuaauaauauuuucuuauuuaaaaaaagcaugggaagauuuuuauuuaucaaaauauagaggaaauguagacaaaauggauauaaaugaaaauuaccauguuguaaaaccuugaaaaucagauucuaacuggauuuguaugcaacuaaguauuuuucugaacaccuaugcaggucuuauuuacaguaguuacuaagggaacacacaaagaauuacacaacguuuuccucaagaaaaugguacaaaacacaaccgaggagcguauacaguugaaaacauuuuuguuuugauuggaaggcagauuauuuuauauuaguauuaaaaaucaaacccuauguuucuuucagaugaaucuuccaaaguggauuauauuaagcagguauuagauuuaggaaaaccuuuccauuucuuaaaguauuaucaagugucaagaucagcaaguguccuuaagucaaacagguuuuuuuuguuguuguuuuugcuuuguuuccuuuuuuagaaaguucuagaaaauaggaaaacgaaaaauuucauugagaugaguagugcauuuaauuauuuuuuaaaaaacuuuuuaaguacuugaauuuuauaucaggaaaacaaaguuguugagccuugcuucuuccguuuugcccuuugucucgcuccuuauucuuuuuuuggggggaggguuauuugcuuuuuuaucuuccuggcauaauuuccauuuuauucuucugagugucuauguuaacuucccucuaucccgcuuauaaaaaaauucuccaacaaaaauacuuguugacuugauguuuuaucacuucucuaaguaagguugaaauauccuuauuguagcuacuguuuuuaauguaaagguuaaacuugaaaagaaauucuuaaucacggugccaaaauucauuuucuaacaccauguguuagaaaauuauaaaaaauaaaauaauuuuagaaaguuuuguuguuc

SEQ ID NO: 16084 - RNA, 7279 nt, Homo sapiens
agcggaaagacggucccgcccgcacaccccuccggaaaacugaagcgucuccucugacccccaaggucagaaagauuuauuacuuccuucgagagggcgcagccacagacccacuagagagggcgggcagggugucggaagccagagaacggcgcuccgcguccucccaccgcuccagggcgcagagguguccucagugcccggagagguuggcagugucggccccgagggaagcguggagcggacggccgacaggggauuucugcccaaacuucaucaccaacucuuucugagagcaaaaacauggggccgaguccggcagcugcacgcagaauccaacucucuggcagcucucggcaccgacgagcuccagaucccgcguucgcaucccggcgcuuugcgcgcagagcuaagccuucggacccguggacugcagcccccgcgcgucgcgguaaagcgggucgcgucuccagcccccgaggcgcagcgacggugggagccggcucggcguugggggcgggggcggggccggcgaagggggagggcugcgcggcggaggggaggagccgcggcgacagacggcggcgcgcaccaaccgggcgccggcuggcaggagccgcgcagaggcugguccgagcgcguugcgggcgcccggcguaaggggagucggguagcagcauccuccugggcgccgcuuucgcgcggcggcggcggcugcggcggggucuuucuuugcuuaaauaccucguuggccagaagcgcugguaccgggggcggguugggucgggucgggcagugcugcacaccuggguuuccuugccuagagcuguguguucgggguccuuugguccagucggaggcugcggagcggcggggguugccugcgcuguccgcccgggcauccucccggugauggaagcagccgccgccgccgcugcggggucgcgcugugccccauccaccgcugccagagaggugggaaaauucgccgcacggaggccgaaagcgagaggggcugcgccgcuaugccgggagcugagucccauauaagccgcccccagccaucgcccccagccggcuucguuccccugagcgagacaggaagcugcggucccgagaaagcggaggagacgucgcuggagccgggaggcgccggguucggcggagcgcggagcggggcucugggccgcgugaaaguuuuucuucccgagccgcagggcgcccgcugcccggaaacugcccagggauaagucggccgacuccccagaccccucgaaggugcggggacccccagcggaagcgagagggagcgaaaucgaggaacgagugacagccggacaguccgccgggcggugauccggggccgcucccgggcgcgcccucggcuccaggugagcggaggaaccgggcagaaccgagggugggcguuacuuaggaggaggaggcugggagggagauuggggcgcauccgcucacuccgcuuccccucgcagguccuacccggagccgcugccaugggagagccagccuugggcgcuggggaccagccgccgcgcccgccucggagucgcggcccgagucccggcgccagcagccagcccgcugcguccccuucccgggcugcagggcugccuccgccgcgccgccggcccggauugugccugugaugagccgcagcccgcagcgagcucugcccccgggcgcgcucccucggcugcuccaggcugcgccugcagccgcgccgcgugcccugcucccgcaguggccccggcgcccaggacgccgcuggcccgcguccccucucggaaugaagguguuccguaggaaggcgcugguguugugcgcgggcuaugcacugcugcuggugcucacuaugcucaaccuccuggacuacaaguggcacaaggagccgcugcagcagugcaaccccgaugggccgcugggugccgcagcgggggcagccggaggcagcugggggcgcccagggccgccuccggccgggccgccccgugcucaugcccguuuggaccuccgcacuccuuaccgcccucccgcugccgccgucggggcggcuccugcagccgcggcagggauggcggggguugcggccccuccaggcaauggcacucggggcaccgggggcgucggggacaagcggcagcugguguacguguucaccacguggcgcucuggcucgucguucuucggcgagcuauucaaccagaaucccgagguguucuuucucuacgagccaguguggcauguauggcaaaaacuguauccgggggacgccguuucccugcagggggcagcgcgggacaugcugagcgcucuuuaccgcugcgaccucucugucuuccaguuguauagccccgcgggcagcggggggcgcaaccucaccacgcugggcaucuucggcgcagccaccaacaagguggugugcucgucaccacucugccccgccuaccgcaaggaggucgugggguugguggacgaccgcgugugcaagaagugcccgccacagcgccuggcgcguuucgaggaggagugccgcaaguaccgcacacuagucauaaagggugugcgcgucuucgacguggcggucuuggcgccacugcugcgagacccggcccuggaccucaaggucauccacuuggugcgugauccccgcgcgguggcgaguucacggauccgcucgcgccacggccucauccgugagagccuacagguggugcgcagccgagacccgcgagcucaccgcaugcccuucuuggaggccgcgggccacaagcuuggcgccaagaaggagggcgugggcggccccgcagacuaccacgcucugggcgcuauggaggucaucugcaauaguauggcuaagacgcugcagacagcccugcagcccccugacuggcugcagggccacuaccugguggugcgguacgaggaccuggugggagaccccgucaagacacuacggagaguguacgauuuugugggacuguuggugagccccgaaauggagcaguuugcccugaacaugaccaguggcucgggcuccuccuccaagccuuucgugguaucugcacgcaaugccacgcaggccgccaaugccuggcggaccgcccucaccuuccagcagaucaaacagguggaggaguuuugcuaccagcccauggccguccugggcuaugagcgggucaacagcccugaggaggucaaagaccucagcaagacccugcuucggaagccccgucucuaaaagggguucccaggagaccugauucccuguggugauaccuauaaagaggaucguaguguguuuaaauaaacacaguccagacucaaacggaggaagcccacauauucuauuauagauauauaaauaaucacacacacacuugcugucaauguuuugagucagugcauuucaaggaacagccacaaaauacacaccccuaagaaaaggcaagacuugaacguucugaccaggugccccucuucuucuuugccuucucuuguccucuuucuccuauuucuuacccuguccuccaccugccuuccauuuugaagugggauguuaaugaaaucaaguuccaguaacccaaaucuuguuuacaaaauauucgugguaucugugaacauguuaagaguaauuuggauguggggguggggguggagaaaggggaagugguccagaaacaaaaagccccauugggcaugauaagccgaggaggcauucuucuaaagcagacuuuuguguaaaaagcaaagguuacaugugaguauuaauaaagaagauaauaaauaauauucuuuuuaauauuugccuccauuacuuuggauucaccuguguuacuuguccucagcuucagauagaaucuccuuccccucccucguuuccauuuuuccagucucuuuccugaaaggcagcuaaacugggugggagcaauuuuugccuccuugguaauaaccugggggauguuuucucacauguaaaucucagccuguuagguguccaggagugaaacacaucuuuguauucuaaaggcagaaaccaaacagggcaguggaagaaaaagcacacuacucucuucaacuuugaacacaggaagaagcaacuccuucaggacuugaaggcauuugguuuuucauuccucuucaguuaaaauggggaaccuugaagcagagaccaauguuuuggugcugaggcugguucagaaaaaggauuuuuaaaaaaaguauguaauuuuuaaaaguucugaugauuagaacacagaccucaggaaaguagcgugaacauacugcuggcgaugguagcagcuucguugguuuagcaaagugacagaaguaucuauuuggaguguuuuucugacccugacacgguauguggagguggaugaaagcagcgaaguuucaucugagaaccguaaggguuuucccuuuucuuacuugcuucccauuuaaaucagugcaagagagaauaugaauuuauaaugcuuuacuugggaugccuguggaauauguugcuuuucuuuaucauguuuccuaaaaguaaauuugcaaagaaaguaacaugcugcagacaguauaaggcuucagccaagagcuucuuuuagauaugauaaugaauugugguaaagaggaaaugaaaaugaacuaguguguaggauuuugaaauuugguauuuuccagggagaaaaccguuacauuuuccuguagugguuaugauguuguguccugaacccauuugguacugaaacauucugcagaauguuauacuaugagaagaaauugugaagcccaaaugggaacaagagacaguguaguuguauaugacaguaaauacaguacaaguucacuaucaucaugguuuuauuucacugugauuuuuuaugagaucucugaaagccaacaugcauagguuaaaugcugagaauuuuauuuuagggaaaagaugauaaaaauaaucuguacguggggaauauuuuaacacacaaugauucuuaaguauaauuaccauugcaauacaaaaucuagcuacgcugguaagaauuccaagguaaagaagcauaaagguuuaaaaagggguauauuuagaaauggauuuuauaacacaaucuagaaugcuuauuucuuaauuuacuaaaauaguuuuuaguauuguguuucugaagccagauuacaucuauaauacauugaucauguuuuccauauuuuugugguagugccuaugcugaauuagcuucaccagcaguagaauauuuguaauagauuuaauuuaagaauacuuuaaaguuaaaugaacaaaauaaauacuaauauuggauggcuauagaugaaacagauuuaacaggaaauuaagagagcagcauuaaaaagcaaccacucugaauaaaauaaccauuuauaaacaaauuuuguguggcauuagaaucagcucuuaacaauugcggugaaauucaugccuaguuguugagugaaggauuuucaagcagugaauucauucuucuuucagcuuaucuaaggacuuggacuguguuaaaguagaauuaugauguuuuggaucuuguauuuaaaacaauauuagaugcuagauagagccuuugcagcuggcagagcauuuguggccucugcucagaugaaauuuuaagcuaaacaccaacagauccucugcuugcucuguuugaacaggguuuccguucguaaucuuguuuuguagcagcugcauucucuccacucugccacuccugugcucuguaauuugaaaaggugaauuguugcuccuggagauuuguaccuagcugccuucuaggaaagugagacaggugguguucccacuaagggcugagcuagucauaucagugacauucagcuuccgaagguuugagaaggagagagaagaauuuuuggcguuaacaagcuucugucaaccccuagugcaagcagaccugugcuaugacaaauugcaacagagccugugaccauucuugaggcagcaaauaugaacgagauccuuucacauuucccaagcuggcaauauguccgucagcaagagaaaauauucuuuagagcagguugucagagugauuuucauuuucaaauucugcucaaugauagcacuccuuacuuaccgcuuggcuuuggaaugccuuuguuaaugaguaagcuguauuuauaaaacaaaguuuacccagugcguuuagucaacaaauuugaguuuggaacaaggcagaggcacaggcugggggcuuaaauuucaaggagcucagagccacucaaagaccucauucagacugacaguggauaccuugcaggcaggggccagagcaaaucuauacccuucaguguccaccacauagugcaugauaaauauuuauuaaauaagugaaugaaauaugcaacuaucaaauuuugaaaauacuuggaagggagagaguggaagaguguauuaccuguguggggaaaaugccagccuguucaguaaaguuugcugaaggaaauaagccauaggcucuauuuagauguggggagugagcaauaggaauaucuucaagauuuccagggcaacuguuuauagacuauuucccagcgaugaauuagagaaaaaaugcacaauuucuaaauguggagagguaaauguuucaaaguaaggaauuugauuguuacuguuuucccacuugcaugaacaccauaagggcggggaucagaacaaaccugcagagcagauguuguccaggggucucagggagggcuaaaaagcuauuuauuuuugcagaagucauguggcacuuauuguuuugagugcugcaaauguguaguuugauggacugugauggagcaaauguuguccaggggucuaagggagggcuaaaaagcugcuuuuuuuuuuuuuuuuuuuuuuuugcagaagucauguggcacuuauuguuuugagugcugugaauguguaguuugauggacugugauguguuagguuggugcaagcgugauugugguuuuugucauugaaaguaaugguaaaaaacugcaauuacauuugcacccaccuaauagauuuucugcagguguagggaugguuacuuucaggaaguuuguccuauuguggaugcugagcgagacaauggcugccuguucccauacauucccugcuuggccacagccaguuuuguccaggauuucuguuguacacaguacaguugcagcuggauuaugugauugguuugaaauuaaugugaauuugggggaggcuauuaaauauucccuaggucuugaaacgcag

SEQ ID NO: 16085 - RNA, 3997 nt, Homo sapiens
ugccgcgcugccgccgcagucagccgcgccgccgccgcugccgcagcgcgggcggccgcgcgccgguagcaggggcuuggcgaggaagccgcugagccucgcgcgcuccgcgcuccuggcggucgcagcgcugccuauuaauugauucucuuauugauuuauuuaauuuuuaggagcggcugcucggaggcacgggucuucuccuaaaccugcagcgacgcccccggcgugggcacaaaggcuccgacggcggccggcgggggcugcccagcgcccgggagccggcgccagaggucgccugcgcgcgcccuagccgagccccgggcaccaugccgcggcgccugcagccccggggcgcgggcacaaaaggcccuccggccccggccccggcagcuucgggggccgcccggaacucccacucugccgccucccgggaccccccagcgucugccaagccgcugcugcgcugggacgaggugcccgacgacuucguggagugcuucauccugucgggcuaccggcgucugccgugcacggcccaggagugccuagccucggugcugaagccuaccaacgagacgcucaacuucuggacgcacuucaucccgcugcugcuguuccugagcaaguucugccgucuguucuuccugagcggcggcgacgugcccuuccaccacccguggcugcuaccguuguggugcuacgcgucgggagugcugcugaccuucgccaugagcugcacggcgcacguguucagcugccugucgcugcgucugcgcgccgccuucuucuaccuggacuacgcguccaucagcuacuacggcuucggcagcacgguggccuacuacuacuaccuguugccaggccucagcuugcuggaugccagagucaugacuccauacuugcagcagcgccugggcuggcacguggacugcacgcgccuuaucgccgccuaccgcgcccuggugcugccuguggccuucgugcuggcgguggcuugcacuguggccugcugcaagagccguaccgacugguguaccuacccguucgcgcugcgcaccuucgucuucgucaugccgcucagcauggccugccccauuaugcucgagagcuggcucuucgaccugcguggggagaaccccacacucuucgugcacuucuaccgccgcuacuucuggcuggugguggccgccuucuucaacgugagcaagauccccgagcgcauccagccgggucuuuucgacauuaucggccacagccaccagcucuuccacaucuucaccuuccucagcaucuacgaccagguguacuacguagaagagggccugcgccaguuccuccaggcgccgccugccgcacccacuuucucggguacugugggcuacaugcugcugcugguggucugccuggggcugguaaucaggaaguuccuaaacagcuccgaauucugcaguaaaaagugagccuccgccuuggaggagacuacugguucgcccaucuguuuggaguuucuguuguugcuauuguugguuuguuuucaaauuucauuguguuuucuucuuugcucaaggaaggugcugcaaaaccauagggaaaaaguucacugcuacaaagggaucccaacccacuggaggcuuugaaguagggagguuggcagggguggucaagcgggagggagauagucacuuguucuugccccuggaaaaaauucaggugaugucuuugacauccagggauuucucaaaggcagugaguaaaaucccaaauaaagccccaaagaguuugcuuuuccaaucaucugugccauugguaauaaggaguagccccugugaggucagguacacaguaaagaggguaaauagaauccuugggaacuucuguuucagucugaggaaugcuuggauuugucaaaagaauggagcuuuguaggaaacaggcacaaagacgcaaacccagggcuuaaccugcuagaaaaugcauggaaugugaacacaaguuaauuauuucaaaauguuuuucagauguuauuuaaauaguaauauauacauugauuuuucauaauuuaucaaagccugugguacgcacugaauuuucuuugucacauaguuuugaauuucacagccuucugcauugcauacacuugaacuggacaucaggggaagcugcuugagaguucucaauuacuuucuuaaacaguguuuucugaaggcgugugucaugauacaacugugaauucuaccuuagggacucugguuaaacuauuggugaggagcucgagugguuuguauagaccccagauuuuuguuuacuuuaauguauuccacaaaacccauccugguuuuuguuaguuuguuuuguuuuuaaucuuuuuuuuuccuucucuacuuauuuaaauugccacuggaauaaaugugccuuuugaagcaaaguccaaaugacugguccucaaacacaguuucuuacauggggagaguaguaagaauaagcuuuucuuaccugacugaaaaucaagguuucaugguccauccaggagggcagaagaugguguugguuucaaguuuuuggugggauuggagauagcuuacaggagcgugcagagcauuuggguucccaacaaggacaaagagccaacccucuaauguagauguguuucuaaugcagccaugggagaaguucuagacugaugccauccauccuugcuuaaaauuaaaaacauaauauccaagaauaaacaaggcaguuuuauuaugaaaggcaggagcacauuauugaguugucacugaaaauuuugaguuaaauaagauuacacuugccuaguuaaacgcugaaguuugauuugguuccagacuauggaaaugaugggcagucacccuaaauccuugaaacauucaugagcaugucccugagauccuuucuaacaaacagauuagccaauguuauuuagacauuucuuacaaaugcuaaccuguaauugagauggccacucuagauuaacacaaaccacugagaugacuuguuuaaauacuuaccacacuuccugguaggucauuuuguuagaagccaaauaagucauugauugggaguuuuuuuuguuuuguuuuguuuggagacaugugugccuuuacuggcucagcaggaggaguggguggcccucauacccagccagcuguacuucacuggcuuguaggugauggagagcuugcccagguagugguggcuuaucuugggcuugaucuccacugccuaguugaaggucuugggcaggaugaucaugucccacaggugcaucuugauuuuaugauauaacuuagaucaugcauaugagguagaugaacacuuaccucagcacugguaggcuggcacuucuaaaacaauugcugguuuuguuuaugcuuuuaaucacuucucuguaaacagagaagcucagcacaauucccuggaggaaccgguauccuuguguguguuacuuugcacauagaaguuaaauuuauauaugucuauauuuaauuuagaaucucuuacugagauuguaaauacacuuugcacaguuguugacgagugucagugucucauccuuugugaagugcaaggagauuccuguuagguuacagaggcuaauuuguacuuacaacagauguuauuccucagcuguaacuuaauucaauagaugcauucaaggacaacuguggaaaucaggauauuuccacaugcaaauuuauuugcaugucauuguuguuuuuucuagagccccaaagaacauugguuuggaagcuagagaaacagggugaagcguauuauguaguuucuuuguaaaaugggaccucaauuucagaaggaacuuucaggaggaagacuucuagcaaggauuaaugaguuugagaacaauaacuaaaacaccaaauuugucauuuuaauuuuuuguuguucuuccagguccacagacagaauucucuucuuguccuuugucuuugaccuuaaggagaggccacuuaaggau

SEQ ID NO: 16086 - RNA, 34452 nt, Homo sapiens
agaugcaacagaugccucuacuaauuccauccucagcuggaacugggguggccuuuucagaguccuccaaaauugggacguauccuuuaucuccagcauagaccagucauuggguguuguccuugggaaaggguuguaaacauguucugugggaaauuccuggacagaugccagcuaagagccuuuagcagcugagggaaugagugccuugguccugaaugcaagaucagggaggcccaccacaggacccacucaaccuuccaucaauucaauaaacauuuacugaauaacugcuauaaguuaggcacugaggucaggugcagugguucaugccuguaaucccagcacuccgggaggcugagauggaaggauggguugaggccaggaguucaagaccacccugggcaacagagugagauccugucucuguaaaauaaaguagaauaacauauagaaagucaggcacugagaguuccaguguugagcacuggaaauauaucagugauugacauagacaaauaucugacaagguagggugacauucacuaaaccuuucuuugccucaaugaucucaucucuaaacuauggcuaauaauagcuccuaacucacaauaaagagagaaugagacaauacauauauaguccuuaaaauucugccugccacauagcaagaucucaguugguauuagaugauguuagcauuuauaauguccauucuucaguguuuaaacacugccuggaggaccagcaggguggucagcuucacugcuaccauccuucccaggcauguguuuccaugaagaagaaaugagccccagggaaauacccaccuaggggagaaagaguugggacacugggccugguccaacgacaauaaaagcuagcacugaaggagaggcaugguucucaguagucuaucacguugacucauggccagcccagccucuggaacucacagugcaagagggcagcaagaaaaaguagguaacaacucacaagccuguuuuuaacuaaaauaucuguggccaagucaauaagcauagccccucucggaauucuagccuacccaccagcagcucugggagagaagcuaugugauacuaaucaggcaauuaacucaagcucaaguccaucucuccaccuuggugcuccucaaccaucuacuccccucauucacuuccuguacuugggcucugagcugggguuugagcagggcacuacauccaggaauugcccuuggcuguacggcuccauacccuugauuuuacaaucacaaauaauggucuccuagccccaucucuuggcuuacccauuggcugggcacacaacuccuggccuccaucuaucaaguaagagggaguggguggcagaaaugagagugaggguaccguccucaaggcacuuggagaagugggaagagacaccauuuuuugaaggguuuauuccuuucaacaauauacacagugucucugcugcuucuggaacauuugagacaguagcagcagcacugguacugugagcaucuuggucuuggcagccacagaaaauucgcaggagaccauagcaaaggaagagagggguuacaggugcugaguguuaucccaaagaacuauuuuauaagugcacaugaaacuccucauuaggagagccucuaggaacacccaggacaauuugggaggaagcugaggggcugggguuuccacacagcagguggggauaaagccagaagaauucuaguuuguaugcuuuuguaaaccuguuugucccucccaucugccuccugccacuaccacccgccuuguggccugagguauuaagagcugcaucuggguaaugggcaucuguugucacucagccuccauucgucuaccugguaacuauggcaugauuuuccucaggaggaucagaagcucuaccugucucaguucauaaaauuacggugcaguugacuccacccuugacuugauguauggcauguuauacaagccuagccaauuagaaagaauaucuuuucauuuggucacaaugauuuguucagggaugaguacaugauucaaacaaagccaauaaaacucaaugugguuuugcugggaauucuaggaaaaggauaauuacuucuuugauaauagauucaaaugaggucugcugcugcugcaggcaucuuguaaccuugugggacaguaauguuugcaaauugagcuagcauggagaacagaggugagagagagagugguuggauuccagugauaccaucugagucuagaucugccuuuagauuuuucaguuaugagagccaaugcaucuugguuuugcuuaaggguguuuguguuauuuuucucugucacucucaacgaagaguauccugacagaugcaaucuaugaaacaagcagaaaaagacugggaaugugaaggcaugcaagcuaauuuucauuucccuuuucucuuuucauuuacucccauuauaacuaugagauguaaguagggacgaugguuuuauugucucacugaagaggugcuaaaauuauaaccuuguuauguugaaugacuuugcccagucuucuagcuaauagauaauagaguuuggaguuggccaccuucuaauuugggaaacagggaaagccaacaagaucagcgaggcaggagaauagggucuggaggcagguaacuaaggcugauucacccugacuuccuagaacuaaaucgaaaggaaagccccaacuuuccacaucuaaguaccaaaaggaccagaggcuacucccuuugcaaaaccccaccuuuccuggcagcggauggaaaauugaaaacguuugcauaggaguguaacuuuuuuuuuuuuugagacagagucucgcucugucacccaggcuggagugcaauggcgccauagcucacugcaaccuccaccucccggguucaagugauucuccugccucagccuccccaguagcugggauuacaggcaugcgccaccacgccuggccaauuuuuuuuuuguauuuuuaguagaggugggguuucuccaugucggucaggcuggucucgaacucccaaccucagaugaucugcccuccuuggccucccaaaguacugggauuacaggcgugagccaccgcgccuggccaggaguguaacuuuagaacuucacuucagcuucugauugguuacuguccaaucagacugauugcgggucaagccuugguuugcacagaaguguaacuuuguaacuucacuuuaaccucugauugguugcuuuccagacugauugcaggccaccacuucauuuacauggggugaacaccaaguggccaguggaaaaccucuaggggguauuuggaccccagaagauucuguaucuggggcccuugagcugcugcucaggcccacucccacacuguggaguguacuuucauuugcaauaacucucugcuuucauugccucauuguuuccuugcuuugccgugcauuuuguccaauucuuucuucaaaaugccaagaaccuggacaacuuucagucaagaccucuuccaguaacaucaguaaacgaaaacaugacaguuaagaaggccuauuuacugcaauugucuuaaagacaauuuuagaaaauuauguggugcuucaaacauuuucuguuuacauguauuaaucuaauuuuguucuggcagcguaucccuaucuguacaggucugcagcaaccucaauucuccucagaagaaagaauucgacugaggggcauaugguggaaggagagacagagucaaguuuuagagcaggagugaaaguuuauuaaaaagcuuuagagcaggaaugaaaggaagaagaguacacucggaagagggccaagcaggcaacuugagagaucaagugcaccguuugacuucuugauuugggguuuuauaugucggcauacuuccggggucuugcguuacuuauccccugagucuucccuuggggugggcagccugcaugcugcccgcacgugacacgcuugggaggggccacacccaguauguuuacuggaguuguaugcaugcucacuugaggagcucuccccuuaccagucuagcauuccuagaagaaggucauaugccaguuagacuuugccauuuugucuccuaaugagcaugccugagcccccucacucaacuccugagaucucaucgggaagcugcugauaaccaguuucagguguuuucuuuuaggagacugccuucuccuggcacuggcugugaccaauuauuauuuuagagagacaguuaacaaaacugccugacuaucaccugguggucaccugacauuccuaguguguguguggggaacccucucgugcccugcucacgccugaccaugcugucuacugaaacacuauuggucauauuuacaacccuacacaguuucucauauuaauggagagaaaaaaaugccuauaagaaacaaauucaaaugaucaaaaagaauguauuaaaugcuuagaaacugcuucaucagcucccauuucauuuccucaguuuuaugccucugguuguccagagccagccacugagcucccuaccugggagcaguucggcaauaguugcuacaaaaaucagugcuggguacagguagcauuuaaacagcucugaacuuucugcuccuaagcaugaaucauucuccuggccugggagucccaguguugagugaugcccaaggacauugagacagaccaacugacaaguagauugguuccuuccauuauccauuccaaguucuucaaggccucacuguguuuaccugcugagaugugaauaucuuuuauuaacaaaacuuaggggcaggcucuugccucauccauucauucauucaugcaacaaauacuagucauaaaccuaccaugugucagacacugggcuagacucugaagacacaaagcccacaaauagccccuaccuucaacagauugaugaucuuauagacagaaacccauacccauagaaacaagggguuucaaauaauuuaggugcuaugauaaaaguguguacagaguacaaugggggaaaauaaaggaggaaucagugccaugagaggcagcggguaggaaaggcauacagguggucggugcuuaaagugagucuugaaagagaugaaggucuuugccaguagauggggaugugaccacauaggggaauuccagauagaggcaguaacaggaacuugccaacuucagccucauguaacagaaaauccgaccccaguggguuuaagcaagaaguaaacuuguuggggaacugagugagaaaacaacaacaacaacaaaacgcccaagaguagaccuguuaggcauggcugguuucucucugucucuuauccauuuccucugcgguggccccagugcucucaagauggcgacagcagauuugacccuguaucgucucaagucucggcuuuagaggaaagaauacuaccacaugccacuguuucagaaaaugucucacagcaucccaguggcucuggggagguggcagucauaugccccugaagaaaucccuguggcuaggcagggugaagcucugauuaacuguggccugagucaucgcucccacuuagagauggguggagcuguccucaccaggacaacuugcucuaagaguccaaaaggacaaucugggcacuguucuuacaagaagggagcguugacaacaaaccuucgucucagcaccagucuugcugucaccaggaaucuggagcagcucaacaccauagggcuccaagugaccagcaccaagucagauucuccagaaggaccgauuucugucaucucacuuguaagcagccaucuucucuggaguccacacuuugggaaaauuuucacuuccuuuccacuggagagccucagccucugaaggaagccagcaagugcugcagucuugagaggcuccccaacucucagggagcccuggcuuacccacagacccagacauagucccugccuccuucucuccucuccugcucuaccaccaacucaccccucugucccaguguuuaccaaggccaggccacagguagggccaccucaguuauauauguauauauauguuuguuuguuguugguuuuuuuuuuaaguuggggaucuugcucuguugcccaggcuugagugcaguggcacaaucucagcucacugcaacauccgccuccuggguucaagcaauucuccugccucagcuucccaaguagcuaggaugggauuacaggugcagccaccaugccuggcuaauuuuuguauuuucucuagagaugggguuucaccauguuggcgagguuggucucaaacucccagccucaagugauccaccagccucggccucccaaagugcugggauuacaggcauaaaccaccuagcccagccaguauaauguuuuccauuguauacauauaccacagcuuguuuaucuauucuauugauaaacacgagggcuauuucagcuuuuagcuguuaugaauaaagcuacaaucagcauuuguguacaagucuuuguguggacauauguuuuuauuucucuugggcaaauuaccuaggagugggaucuccaagucaaaaguauauguuuaacuuuguaagaaaguaggcagaugcauauuuacuagaauaacagaauauucauguaugucaauacucugggccauggcuuccucauuauuaaaauaggaauauagccauaucuacccugucuaauucuugccaccuuugugaugaucagaauggauaauguacauuaacacaucauaaggugcuaaauugugcagugugaagaaagagcuauagagauucugagggaagagagauaaaugagggcugaagaaaucacagaagacugacuggaagaggagcucaccuuugaacguucaauuaaaucugcccaacgguggaugaacggacagauggacaaauggaauggauagaugacacauccucaaggaauaaaaacuuuuuaaagaauauaaagaauacauuaguucauuuauuugugacacguuuuuaaaaaucacauuaacauaaaggaggucccaaacaacucugugauauguguugucuuuuugggugcucaauugaaagacaauguucccaucaagaaaaaggguccucuugugucuuccuucaaauuacgcuauuaucaagcucgauuuagacuuuccuacuacccuuuuuauuuucuacuaaaccccaaaaauaagaaaggcaaggaauggaaaauaaaagauaagaaaugcacaagcuuaucaaagauuuuuuauuuuuguauaacucuaagauaauguugaauuuuuuuuccuagaauuuucuaguuucccaggucccucucuuauugaggcagccuugugcuuugcucagggucagggaggagaggcagugucccuuuugcugguggcuggagaccuugcaagccuucagaaacuuuuuacaauccaagcucuuucucacggucgacuugagucuuuuugcuugcuguucccuucaccugaagggcucuuuucccuuucuuauucuuuuauuguucagcucucagucuaaauacuaccacaguaaggacucccugcucacccaggcuucuuuaucacaccacauuguuuuaauucucuacagaguguuuaucacugaagauauuuuucauguauuuguuugcuuccuuauuguucaucuucccauuggaacauauacuccucaagagcaagaauuuuucuucuuuacugcuauacccccacuacuauaguuccuggugcauaagcggagcucaauaaauauuugaugaaugaauaaaugagaucgccccuuggagaaagagaagagaagggaaguguaccaacccaggauaugacugaauugccugaguuauuauccaaaauaaacugagaagaaucuggaaauuauucaguuuagagucauuuggcaagaauagauuuucugcuaucuggggcuugagagaugguuuaguuucaguuauagaggaauaaagaaagucccauuucugagacaucuugaucuauaacuguaagauucacauaugcugcacaaucgauaaagugaaugaauuuuuuuuuuuagacggagucucucucugucgcccaggcuggagugcaguggcgcgaucucugcucacugcaaccuccgccuuccggguugacgccauucuucugccucagccucccuaguagcugggacuacaggcgcccgccaccacgcccggcuaguuuuuuguauuuuuaguagagaugggguuucaccauguuagccaguauggucucgaucuccugaccucgugauccgccugccuuggccucccaaagugcugggauuacaggcgugagccaccgcacccggcugugaaugaauguuucuacucacguaaagauuacuugauuaaaauuaguaucuggugugauggguaagauucuauuacuaugcaucagugucacuaguagacaugacauuugaucauacuaaauauaaaauuauuucugaaucuuuaaaaugaucauauuuuuuacauauuguaaaauuuuaggaauaugucuuuaggaaaacguaauugauuuuuaaaaucuccucugaaaauauaauuaaagcuauuuuucuuaacuuucaaauauauuuuucauguuuuguagcucuaaggucuuuuuuuuuuacuuggauaaguaaaacauagaauuaagaugauaugaucuuguuuaauucuaaaacauuggauuuaaccuaggugaaagcucauuuccaagaggaaggguauggaucccuagcugauuacuauuucuuuuuucuuuuucuuucuauucuuuucuuuuuuuuugagacaaauucucgcuccguugcccaggcuggagugcaguggcacauucuuagcucacuacaaccuccgccucccggguucaagugauucuugugucucagccucccgaguagcugggauuacaggugccugccaccaugcccggcuaauuuguguauuuuuauuagagaccagguuucgccguguuggccaggcuggucucgaacuccuggccucaagcaauccaccugccucagccucccaaagugcugggacuacagacaugagccagcaugcccggccacugucuugaaacucuaacugaucugucuuuuccuuugggcuuuaaaccccaaaugugagaggggaaggcuaauccuguugugaauguuuaggaguuuuuuuguuuucucaccagaaaacaaaagaauaaaccaagaaagggaaggaaggaccaagggaaaaaggaaagggggaaaggaguucucauagcaaagagagaaguuaaaagcauuugcuaaggucaaacuuauuguuuaaccauuuauaagugagaagcuguuugacucuccaguauaccagcuaauuuagcuuagaaguccaauccuuccucuggaucagcauuguccaguaccuguggcucuugggacauuugaaaugugacuagcacaacugaggaacuaauuuuuuuaaaaccuuauuuuaauuaauguaaguuuaaauugaauagccacuuguagcuaagaaacaguaaauuccaacacuuaguauaacacagcuaauuaucuagaugcuauagcuacuguauuggacagcaucuagauaauuagcuguguuauacuuaaguguuggaauuuacuguuucuuagaacaauauuaagguaaucauuauuauguuucaaaaugaacguaauggagcuaguauuuuggauaaguggagauucaacuucaagaaaaaaacaauuuaggaagaucugaucacuuucuuggcuacuuauugugucuaauguucucauaguuccucuuuuggaagccaagaaaaaguuuauuuuguuacuguagugcuuuuuugcagagauuaaaaaaaaaaaguccaacuaccagaucuucaucugaaauaacuacccacuugaacauuuaaugauuccuuuauuuuccuuaugcccugaaaaguucaguuaauuguugguuuugcuauuacaaaauuuguuugguaguaauaauuuggaagauagagaguuauuuaccugguauguuucugguuaagauacuuugaacuacuuaaguuuucagaucugcaagaacuaucuuugaugagaugacaacuuggaggaaggguucagucaagugcaguuggguaauuacucuggagauaaucacaugguuuuguaguuucucuuuuuaaauucauuuuuuccugcuuggugcugcagucugaauguuuauguccccccaaaauucacaugugaaaauccuaauccucaggguaucaggagguggguccuuucggugauuagggaaugaggguggagcccucaugaauagaauucauguccuuauaaaagaagccccaggccaggcacaguggcucaugccuguaauuucagcaguuugggaggccaaggcagggggaucacuuuagcucaggaguuugagaccacccugggcaacauggcaaaacccugucucuacaaaaaauacaaaaaaaaaaaaauugccaggaguaguggugugugccuguauuccuagcuaacuacuuguggggcuguggugggaggauugcaugggccugggagguugaggcugcagugagcaauguucacaacacugugcuccuggcugggugacaaagugagacccugucucaaaaacauaauaauaaauaggggccccagagagcugccuugccuguuccaccaugugaggacucggugagaaggggcugucugugaggaacaggcccucaccaggcacagaaucugccagcaccuugaucuggaacuucccagccucuagaacugugagggagauguguauugucccuaagacacucaauauaugguauuuuuguuauagcagcccaaacagacuaagacacuugaucuuuauuuuccucugcuacaagucuuuuguuguuaauaauaguguaagggguuuuguuuuguuuuguuuuaagaaaaggagaaaugcaguccaaagauaucccuauauuugugauaccaggaaggaccauaacaucccacauacacuuucaauauaguauugaaauaacacaauguagugaccucccucauaaaaccaguaagcacucaagcauaaucuugugugagugucacaaaguucaauucuugauagcuguagucuuuacaugcgggcagcccucccacucuacuuccaccuauaccgagaacuugaaaauaaaguugccucugagaauaaaacccuaaaauccaaccauaugacagccaagggaguguaccacauagaucuccuccaagacagaaucugccaaaggacugucauuaguuggcagccuccaucugccacacucuugggaucugcugcaucacacaugccaagccauacucuagccaggcugcccagccaaugacugaacaaggcagggguaccagagccagguggcuccuccacaacacaggucuccucuagcaggccaucuuugcuagagcuccucauugcccuggccaauauuuuacucagggcugcacuaugaucugaagcacuuccagcccaaacccccuucuuucccuaacuccucucacaggugucagaccugcauugcaguuccaggcuccaccuacucacgguucuucuucccuuuguccuccauagaccuuuccccugauacgucucuugcacauugaucucuugcagaaucaaauucuguacuggugucugcuuuucagaagacccaaaucaacacaauacaaaaugaaugagacuaauugaagaaauaaccuuaaagagcauucucaacaguaagggcaagaaccaggucucuucuaaccaacacuguuaucuacagugccuagugcagcacuuggcauagaguaggcucuugauaacuuguggaagaaagggagggagggaggagcagagagagggagggaaaaggaaugauuuuuggauuagcugggacuuaaaaaucuaaagaagucucagugaauguuaaaaaaaaaaaaagccauagcauuagaaggaaauauguagggagaaaaggguggucagucuggaauuuagagaaaggaguuucaaagagugaaaauuugcgugugucuccagcauugucugggagaggcacagaugcacacacagaugcauacacacauuuauacauguauccauaucuaauaugcauaaaagcuaauacgugggaaguaauguguauguguacauuauacauauauuuauaugccuguuauuuugcucagaauacccaguacauauaaacaacaccuaaauauaccuccaagguaaaaggaaaaugaaacaaacaaaaaauucucuagauacugccaauggaaacauuaccaauugagaaaacagagacaacugccagcuccaggcagagacagugcuucuguugcuccaacuuccuauuuguacaauuaguccuacacagcgggccaggauacuccugucauuagcaucuggcaaauaugucccuguuaagaagcaucaauuccagugucucugagaaaaagcucuagucucgaugaugagcuauaauccuaucaaauucaaucaaauggguaagucucuugcuguuuuuaaaaauuaauaaccauuuaauacccaaaauaaauauacuuugauauucaagcauuuuggcuucacuuagaauuuacuuagaaugaugcuuucccauauagaucuuuugcaacuaucuuagcaggaaaaaaaauacauauucaggguucuacuuauuucuuaggaaaauaaagcuuauguuggguuuauuuuaaaagcguuuauaggacuuaaaauguuuucagaauuugaggacaagacucaaggcacauacauuaaacuaguuuuauuaauauaaugguuuuaggacuguguucauagccaugaucauguguauacauguguauauauacaaacauguaaauauacacagguguauguguauauauguaaauuuugcaguuaguucucuguuacacucagaacuuuaaagaaucuauaaauuacacagucucauaguucuaaagacuuuguuugcauguaacauuuauuuggauaaugccuguuagguaguuagcuuacuuuuucagaaguacaacccuuaagcaaucuuguaacacacaacaaaccaguucaguuguuuagugaguaaugaauguaaaccuuuuccuugaggaacaaauaaacagcaauuugaauugagguagauuguuaucucugccuaugauuagaaugguauucuccaaauggcacuuuagaagaccaaugaguaaacaggaaguuauuugugaauggagcuaagauagaaaaagauccacuaucauuccucucauucuaagccagugucuuauuacgguaauguugacacuaaaaucauuauuauugauuguuuuaauugguggcuuuuccaaaagcaaagacccagaagaacuuagaacuaaaauaaacucuucaaaucccuggauaauacuuuuaucauagaagagacauuggaaagaaaggggacuaaaguggcacuaguacugucuuuggguggcaaaguuaagggucauuuucuuuuuucucuuuuuuaaauaguuuccagauuuuauauaaggagcagguauuuccuuuauacuuaaggaaauuuuuacuugaaaacaaaaagaagagaugguuuaaugaugacggaagaccauagagcaaaacuggagagagcgucaguuucauuucuuggcguggguuaggguucaggcgcugaugccaagcucuugccccaagcuuugagaaucagugagugaggagagcacagggaccccaaggcagucugggauaaaagggaucugggcugauauccucugguguuuuugauauuucuugcuccagacuccuggccccuuguuaggcagccacucuugguggcauucuccucauuuuuaacaucccagcacuuccccgauggcccuauuucauugccugccuugcagacaacuaccaucuuagcaugacucaugguuaugaguaacauugaguccuggugagaaagccagaugaauuagcuacaaaagcauccaacuggcuaaaggagucaaucuguuggaugagguucuuuaaauaugaugagcugggcaugguggcucacgccuguaaucccagcgcuuugggaggccgaggcgaguggaucacaaggucaggagaucaagaccauccuggcuaacacggugaaaccccgucucuacuaaaaauucaaaaaauuagcugggcgugguggcaggcaccuguagucccagcuacucaggaggcugaggcaggagaauagugugaacccgggagguggaacuugcagcgagccgagaucgcgccacugcacuccagccugggcgacagagagacacucggucucaaaaaaaaaaaaaaaaaaaaaaaaaaaaaaaagaugauuacaccuaacaaacaaaaagauaucuauuaccugcaguugauacaaaucacuuuuauaggcaaagguucauccccaaaagucaacauaauaaaacaauuccaagaaguuuugguuugauuugguaucuuuguuaguaguacuucuucuuuuuuuuuuuuuuuuuugauacggagucucaagcuggaguggcccaagcuggagugcaguggcgcgaucucggcucacugcaacuccgccucccugguucacgccauucucuugccucagccucccgaguagcugggacuacaggcgcccgccaucaugcccggcuaguuuuuuguaucuuuuaguagagaugggguuucaucguguuagccaggauggucucgauuuccugaccucgugauccacccgccucggccucccaaagugcugagauuacaggcuugagccaccgcgcccggccuguuguuaguagugcuuuuacuccaugguccucauuaccaucaauggcccacacguuguuuuuuuuuuuguuguuuuuuuuuuuacugucaaggagauagauagauagauagauagauauggucuuuccuuccuuccuuccuuucucuuucuuucuuucccuuucuuuccuuucuuuccuuucuuucuuuccuuucuucuuuccuuucuuucuuuccuuucuuucuuucagacggaguuucacucuuguugcccaggcuggagugcaauggcacgaucuugucucaccgcaaccucugccucccagguucaagugauucuccugccucagccucccgaguagcugggauuacaggcacgcaccgccaugcccggcuaauuuuguauuuuaguagacacggaguuucuccguguucggucaggcuggucucgaacuccugaccugcuggccucggccucccaaagugcuggauuacaggcgugagccaccgugcccggccaagguaauauuuuguagcacuuguccuuacagcucuucucacacccaaguugucucuguuugacaugguagaacccuggguucucucaacagucuuuuccaaauucuuaaaggcuuauugccauguggaaguggggugaccuguuguucugaagcauucaccucaggcuugguccucuuucccaggaauauauuugcuuacaugcuacuuccagaagaaagaaaagcaaagaaccucuuaggcaacaucuccagaguaguagggagagcucgcugauuggacagccccuggucacaugucccacugggggcuggagaagcagugaauggaaucagugcucacagaagcacacggcauagggaaggguggcuccccaaggaagggaugcugaguagauaaacagcauaugucuguucaugccgucuccauguguacugagcauuccugaauucccagaaaggcucuaauggauuuucaugcaguacugaugaaaacccugaguuuuccaguuagccuggguucagaucccagcuuuuuuuucuuuuuucuuuuuuugagacaggaucucgcucugucacucaggcugaagugcaguggcaggauuguaacucacugcagccucaaccuccugggcucagguguucuucccaucucagccucccaaguagcugggacugcaggugcacaccaccaugcccugcuaauuacaauuuuuuuuuuuuaguagagacagggugucacuguguugcccaggcuggaauccaacuccuaggcucaagugauccuuccaccucugccucccaaagugaugggauaacaggcauaagccacugugcccaacccccggcuuuuuuuuuuccccagcuuuuuauuuauauauuguaggucuuagggccaggcauguugacucacacuuguaaucccagcacucugagaagccgagucaggaggaucaauugagcccaggaguucaagaccagccugggcaagauagugagacucuugucucuacaaaaaaaaaaaaauaauaauaauaauaauaauaauaaaauuggcccgggcugggcaccguggcucacgcccgugaucccagcaguuugggaggccaaggcagguggaucacuugaggucacgaguuugggaccagccuggccaacauggugaaaccccaucucuacugaaaauucaaaaauuagcugggcgugguggcaggugccuguaaucccagcuacucgggaggcugaggcaggagaaucauuugaaccugggaggcggagguugcagugagcugagauugugccauugcacuccagccugggugacagagugagacuuccucucaagaaaaaaaaaauuagucugguaugguggcacaugccuguagucccagcuacucaggaggcugaggugggaggauugcuugagcccaggaggucccagcugcagcgagccaugaucacaccagugcacuccagccugggcgauagagcaagauccugucuuaaaagaaaaaaaaauuuuggauuauaaaucucagaaucuucaccuguaaaaugaugauacuuguucuuaccccguaaguuuguuuagagaauuauacaaaauauuguuuguaaagcacuuagcacaguuccagguguauaauaaaugcucaguaaaagucugagaugaugaugauaaugacgauucauuauggagagacuccacuaaacaaaguuucauuccacaccaagaagcagcagcugauuuccuuguguucagcuuggcccgcuuucaugugcuugccuuugacucaaacaaaaugccugacccaguccaagguggacaggugaguggaacugguuucauucaacacauccuauuaacucugcaacuucauauaucaagaccuccuuggggcugcuuuccucagcaaagggaugcaaggagacaggcuaauugaacuuuguagauccuuaucauggacauuaaucacacuugugccugcccauuuuguuuuaguagccuuuuaauauuuggagauauuucuauauuauguaaccucaucuucuaauagugcugaauucccagccucccuuguggcugagacacugcaagucaugugacauggacacuaccaaucauauaggcuugcaugagaguuugaucaagagaucaccgugagcaaagagguucugugauucucuuauucuguaggaggcaauaggcugucuggccuuuggggcaggagugugguaagguugaauuucccagggcagaaauguaucugaagugcucacaacagcggugacugcauuaaguucaaguaccugcauuuagugcuuagucuugguggcaauaauagcaguagauuucucacuggccauuucugaggcgagguuuuggcucuuauuccaggaaaaugagcuuugagacuguuucuaugauucuuuugaugauaaugugaacuuucugcucugcuugaaauucugaguggacucaguuguuuguagcuaagaaaccugaccaguacaauuccuaauaucuuauucuuggcagagagguguguugagguggggcaggggaaagaggaaggucuacguuuguuccuaauguguguuuacagacaucaaaaaacacugaauuuuuuuuuuuuuuagauggaaucccacucugucgcccaggguggagugcagugccgugaucucggcucgcugcaaccucugccuccuggguucaagcgauucuugugucucagccucccgaguagcugggauuacaggcgcccaucaccacgcccaauuaacguuuguauuuuugguagagacaagguuucaccauguuggccagguugaucuugaacuccugggcucaagugaccugcccaccucugccucccaaagugcugggauuacaggccugagccaccgugcccagugugaacuaacuuaugaacauuccggauuuuuuacaagaugaguaccgcacuauggaauaaaugugcaauggauuuacacgacauuuucagacguuuacaagguugaugagugaaucagagauuagcugacaauguugacauauugggcccagcuagauacuagcauuguguagcaaggaauguuugaguggggccuaauuuuauaaguggucaguucauuggugaauauuuucauauucccaugaugcugauucucugugcaaccugguaacagcagaggcuggauaauaaggaucaguucacccaccacuccacuuuuuguuuuaaagaaucuacccacagggcuuuuguucuuuuucucucuccacuuuucuacugccuguggggguagcuccuuguccauuauacuaauucuguuaucacacaaguccagaaacuggucucacagagauggaccuuacauauaccuucaaagugcacuugagucuugauaugguuuggcugugucuccacccaaaucucaccuugaauuguaauaauccccaggugucaagggugggaccagguggagguaauugaaucgugggaaugguuucccccaugcuguucuccugguggugagugaaugcucaugagagcugaugguuuuguaaggggcuuuuccccuucuccuaucacccugugaggaggugccuucugccaugauuauaaguuuccugaggacuccccagccaugugaaacugugagucaauuaaacuucuuuucuuuauaaauuacccagucucggguauuucuucauagcggcgugagaacaaacuaauaaaagucucucaauuuuaacacaucaacuucucaggacauuuaagguuuauaauuuuggucagaacuguaguuccaagucaaauauguguuuuuaagagccaauaauauggguuuuaguaaauucuaaaaucacaugguaaaaucaaugucuuaugagugucaacaacagaaugauugguguuaaaauccuaacucuuuagugagcauaugaacacagucaucaaucuauaaauuaagaaauggcuguguauuuuaguucaaauaguuuccuauuuaggcacauuuaauacuuuguuauuuauuuuaaauuuugaaaacuuagcuuaguccugaaugaaguauuuucugguuuacgaggacugcaaaucauuaccagaaagugaauugagcaauauuucccuuuauaauuuaaaacuaugacuuucaaauaaacaauuaucuaaaaacacuuaugcuauuagauagcauauucuugaaaugcgugcaaaaucaacaaccauuuauucuccucuucccuguuuuaaagacauuuuuauuggguugagaguguuucaggauauaaagcaguuugccaaauucugucacccuuuuuuuuaaugucauaaaggguguggugccuguagagaaguuuugaaaguuguacuuuaugauguuuuugccuucacuuuuuaaaaaaaugguaagauaaucuaaguccuguccguauauucugguuccuaguauaggcuucagggugcacucacuaugaaaagucagaauauuuccuguagccaguuuuacuuacuuccuugccaggaguguuuagguucuuuuuuuuuuuuuuuucuuuuuugagauggagucucacucugucgcccggggcuggagugcaauggcgugaucucggcucacugcaaccuccgccucccggguucacgcgauacuucugccucagcuucccgaguacccgggauuacagacgcacaccgcaacaccuggcuaauuuuuuguauuuuuagucgaggcgggguuucaccaucuuggccagacugguuucgaacuccugaccucgugauccgcccgccucggccuccaaaagugcugggauuacaggcgugggccaucgcgcccacccguguuuagauucuuaacagcucauuauuagaaauaaagucucgauaagaacuacuuuaauacuuaauuuucuugcuuagaaaggugaaaacaauuuagaaggaacaacgugaggcaucaaaguuaagcuguaucucccauagcuggugauuauuaaaaaucucuaugaaucuagucuguuccugucauucuuuuauuaaucccugguuauugggaagcucuuaacaaaauaaauguuuaaaauuauauuucuguaauuaaguaaaagagaguauugauuccacaaggcuagaauuguucgucuaagaaaaacgaauucuccguaaauuuuaacccguuaauaccacagaaagaugcuguuggaaaggucuaagaacagagagaugcaagcagagaaacaccauuuucagaacaugacaugggauggugagauuugcugauuugguuccgucuucauuaucugacauuuaaugacaguucacacagaaaucgcucgccugaaaacccguguuuaaaucccggcacagagacugucuuccuugucauugucauaccaguaaaaaaaagaaaaguaucuagagagagagagaggagaauaagcacagaaguuaaaauacaauaaaaucccuuuucccuuucuuuccuuggaucuggguuuugaaggagacaaagaaggacccccaggcuuuccagcagccagcaagcgcuauuacuuuuuauuuaaaagcaacugggaaaaacauuccccaaagcaaaaccagaagcccucccugagaaucgucucugggcgucggggcccgggccgcuggggugccacuccgcaagggguuccucuucuccccggggucccugagggcuggacgagagaggacccgucggucccggggugccgggaggagacguucgcccgccccacgagagggggcggcucuggccucggagccgccccuccugccgccggagaacaaacgggauauucagcaguggccuguggcugccagagcagcuccucaggggaaacuaagcgucgagucagacggcaccauaaucgccuuuaaaagugccuccgcccugccggccgcguaucccccggcuaccugggccgccccgcggcggugcgcgcgugagagggagcgcgcgggcagccgagcgccggugugagccagcgcugcugccagugugagcggcggugugagcgcggugggugcggaggggcgugugugccggcgcgcgcgccguggggugcaaaccccgagcgucuacgcugccaugaggggcgcgaacgccugggcgccacucugccugcugcuggcugccgccacccagcucucgcggcagcaguccccagagagguaacgcgaccccugcccgggcucccuuucucuccuuucccuuccuccaccccugcagccucgccugcugcuuuacucaacccgcuucggcgcgccugggugacccagcgcucgacccugcgcucccgcgcggugcaggcguccgccacccucggguaggcuaagcccgggacuucgggacccauccuugcucgcggggcucccuccuggguccccagcccggccugccggauggcccugcagcuggcuuggccaccacguggcggggcuuaaucugacuugugucuccccucuccucgugucuauggggccagagggaagcacuggggcccaaauauguggauuuugguuuaccgcuguuuuuuuuccuuccccgagaggcuuugcccagagacguaaacuagggaacaacccuagcggcgcggcgccuagggagccgcuccggaaaguuaacucuucgccaaccucuggaaggccccaggagcugggcugugggaccugcccgguggccaacuuuggcaucaccucuucagccuccaucaacaucagccucccuuucgaugggaagcucugccaauggcgagugauuuucagaaagggggaggagaacugggcaucucuccaaauaugggaacgacaaacuuuuuuuauauuaaccaauugcuugccugucuuucuuuaaaaccaugcuucucauucagccuggcucuuaccuucucucccacucccccaguuaaauugauguauuuaccauuuuccuacaagacuuugccacaaugccgaggacuugauuauacauauauauaaucuuguguuauuaugauggagacagauggcgcuggacugaaugcuuugucaggcuauaauuuaaauauucuaggagcuagcaaauuuucagaucccuuauauggugcaagcauugauuaaucaacauuaacuuuuauuuauauuaauaggcuacaccuuucugaagguaacaucagauuguuagaccauguuucaaauuacauuaucuuuucuucuuuuauguucccagaccuguuuucacaugugguggcauucuuacuggagagucuggauuuauuggcagugaagguuuuccuggaguguacccuccaaauagcaaauguacuuggaaaaucacaguaagcauuuuuuaaaaagguauucuccuggaaguggguguuggcaacagugugaggcugcugccuuuuuccucugguguuaggauuugaguaagaggcaaaugccugaaauagugaaauguuggauuuaccccaacuauugggaagauuuuuauuaauauaauagaucuagucguguccugcauuagugauuacaaagggcacaagauaaugcuugaaggaauaaauucucagagcagauguguuucugaaagcccagugugacucaguugaguuuuauagauucauaauuaaagcuguuuucagucaaaggccuguuguaaugaccuucauaaguuuuuuguugcucgugccuucauaaauucccagugggaaauggaagaucaaagauagugcuuugacuacucuaugcucauuaggaaaggaaaaagaaaaaaaauaaaaaaagcccacuuaauguuccuggguugaaaccaccucuaaaggcagucuaagaauagagaaugggggggugggaaucuaaauagcagccaagggccaauaaaaaguccaugcugauuaguaauaacauagauuaugcugagucaagauaagcuggauuuagagacagccauauauuuuuuaacugauuuagagucaacuagagugagucaucuuuccagucagcauagcauugacuguuaccuucuucacuuuuucguuguugggaaguuguuuaguaauugaauacguugguucacugagagcuucuuucagucagauugugccacuggaggacuuagauuuuuuaaaaaguagcccccacugaauguguaaacuagcaguuacugugugccaggcauuuaccaugccaaguaguuagcaaguauaaucacccagaauccucaaaacaacuguaugagaaaguaucuauuaucaucccuauuuuauagauggggaagcugaggccugaaacaauuauagaaauugacuugaucagacagucgggaagcccaacuuuauguaaaaguaaaaccuacuuugcaauaagguauucccacugaggucauuuugcaggcagauaugagagguccccuuccauaauauaaaacucagcucuuacaugccuugacggccucuuguaaaaugccaaccaugucacaaacugguacagauuucauuauguuauuauagcacauguggccaggaaagaagucauagaaaauaaguuugaaauacuauuaacauaaaugucaaauaagucucugaaacaaaaauaaaagcagcuugauuuucaugucgugauuguguuuuaaauguaauuaaauggccauaaguuuuaaacgacccuagaaaaucaauggcucagaggcgucaugugcccaaguagaaauucaugguuggccauguguucugaguauugcggacagguugaugugacuuuacacuuugacugggguuggggggcacguccagugaaagcuuuccuugauaaaggaacgguuugccucaggagaggcaugauuuccugugugggaguggggaaguuaaauggaugcuccaucuggauguccugugaagggaaagccugugagcucagcagucacuucccuggauucaaauuccaguuucaccgccauaaacuguguguccaggaucuaccuccuuuaaaccuuaggauuacugugaagacaaaaugagauaguguaaaaugcuucaacucagugccugagugggaagaagcuugauuugucugaagaacaaauuaaggagguuggaguggcuggaauggaaugagcaaggggacagugggaagagaagcgaagaagguaaacaggacucuguaggccacgguggagaguuugaauuuuguuuugaguaggagucacuggaagaucuuaagcagaggaaugagcuuaucuggugucugcguggaagaugaacuguagggaguuaagaguagaggcagagagaccaauuaggaagcuguugugguauccaggagagggaagaugguggaguagacaaggugguagcagagaagaugaagaaaugcggagucuucugcccacaguguuuucucagcagcucugccugcgguuaggauauaguggcaccagcuagaaggauacaugcaccaggcucugucucccugcuuagccauuccagacaggacugugcucuacuauggccuuguccaaggccaucuauuaaagguuuuucccacgcugguugguccagcccauuuuucuguuccugcagucaguaaaccaagaauaguguucccauugagugauucaguaucacuuuuauuaaaauaucacagaggccgcuggagaugggaaagccucagagugguccuuaaacuguaguuccuguagcuggggggaaauaucuugcuuucacucacuggccucccauucuguucguccaaacuggagaugugucccagcaugguagcuuucaccgcuaaaugguuuucauuaaacucuaucauaucaaugcaagaaugggaaaugucugauuuuaacuuuugcuuuaagaaaggugaauccuaguuguuaccaccaaacuuccaguccuucguguuggacuuucugaugcgaaaguacagccugcagauuggaaauuuagauguguccuuacauuauaguacuuuaaaauuuuuauagcaauuucuuagacagcugcauuguuccaacacacuguauuggcuauuuaaauguaaauuaaguuaaacauuuaguuucuuagucauacuagccacauucaagugcucaauagccacauguggauaguggcugccuuacuggacaauauguaauauaguauuucugucaucacaauuuuucuuguggacagugcugugcuauuaauagaaaaauuuuaugcuuaauuuuacucacguaaaauguugaggacagaggugcucugugcugcuuaguuguacuucugcuuugcaaauagggaagcugcuacugguucuuuguaguuguuggagcuguaacuggaacucaagacucuugacucagcuuuaucaccaagaguugauggccuuaacaggucuuagguuuuuuacuuuuacuguauguguucucaaaaauguaugcuuagagacuaaauuagagaauuuggguguuaagaaauaguugaauauuuuguaauccaugaugggguugagaguuucuuaguuuacuguaggaguugauucuggggacuauaaccuaaaaggcaucugcauaaaauccccuaauucucaaauacggggacguggguaugaguuaaaugugauuugacagcuaagguauauauaauccuuuggaaaguagugacuggucuucuaagcaggcuuggaagaacaauaggguuggggugaggcauaagucacccuaauuuauuuaagaaccagaaccaauaacucccaccuguauuaagcccugcagcaagaaaugaaacuccaaaaguugacaucccaccaccuggaccccucuauuacagugguucuucugcaguuugagauuguaugcaggagacaacaguaaaaaaucucugagauccauaaaagaaguaggggagaguggaccacugugaacaaaaacacagcuggugugauguauuucacugcaacauaggcaggacacauuuagaagagcccaugaagcauggugcugggugcaggagacacauaggcgaauuuagaggugauaaacacauggggagcuaccugcuaggauguguucccaaggcccugagugggaagugagacaaagcccaccaggcaucuuacguucugugcuccacaggcaccccuggcauaaagaucaccauuccguuaauagcuucauuauaaauucauugcaaacucggcaaaucaucaauaccucuguuccuugauauuuucauucauaacuuguucauuuuauaauucccauaauggaauuagagauacauauugaugauucgacacaaauauguguuuuuuuuuuuuuuaaagaaaaguagacauacguugggaggcugaggcagguggaucaccugagguaaggaguucaagaccagccuggccaacguggugaaacccugucucuacuaaaaacacaaaaauuagcugggugugguggugggcgccuguaaucccagcuacucggaggcugaggcagaggaaucacuugagccugggaggcagagguugcagugagccgagaucaugccauugcacuccagccugggcaacaagagcgagacuccauuucaaaaaaaaagaaaaagacauuaauagcaaaaauaagaccuugugaaagcaacucuauuuagaguuugacuuuggcugcauaugguauggguggcugagugaaaccagcugaagcuuuguuuauaguaacugcaaaccagaggaaacuuaaagccuagaaucuucugggaacucuccuugaacagguauauaggaauuuuuguuuaaaauugguuuccuuuuuuuuuuuuuuuuuuuuugagacggagucucgcucuguugccuaggcuggagugcaguggcgcaaucucgcucacugcaagcuccgccucccagguucaugccauucuccugccucagccucccaaguagcugggacuacaggcgcccaccacuaugcccagcuaauuuuuuguauuuuuaguagagaugggguuucaccaucuuagccaggauggucucgaucuccugaccucgugauccacccgccucggccucccaaagugcugggauuacaggcgugagcuacugcgcccugccuaaaauugguuuccaaacuuaaaaccaaauaucacaucugaaugucuaaugcaacugcuguuauguuaucuaacugaaacagcaauuguuaugcagagaucgcuggaauugauucuguucuuagauuuaaaacugggcauaauuuacaaaucuguuuuuaaaaggcgaugaucuggccaggugcaguggcucaugccuguaaucccagcacuuuggaaggcagaggcagaaggaucgcuugagccuaggaguucaaggcuccuggagugagcugugauuacaccguugcacuccaggcugggcgacagagugagaccucuucucuaaaguauaauaauaaugauaaacaaacauaaaaugaggcaauccauguaugugguccuauuguuaaaaaucauuagguuuuuauuauuuauaauuuaaaaguacugaaauuagccaauuauuuaagguuucaguuauucucagcauaaaucuagccugagaaaaaucagcaaacauagagcaaaaauuuagucuugggguccaccuagaauacaacuuuuuaucccuuuaugaagaaaauaugggagaggccaggccugguggcucacaccuguaaucccaauacuuugggaggccgaggaggaagaucgcuugcagcaagguguucaagaucagaguucaagaucagccugaacaacguaaagagacccugucucugcaauuuuuuuuuuuuuaaauuagccaggagugguuguaugcaucuguaguccucgcuacuuggguggcugagaugagaggaucucuugagcccaggagucagagggugcagugagcuaugauugugccacugcacuccagccugggugacagagcaagacccugucugaugaugaugaugaugacgacgaugaugaugaugugggagggccagagagucacagaccuuugacagaaaugggaggagaauguggcaauggguagaggcagucccauuaaagugaaaaguauguggcaaaauuuuucuuauuuagcuacuccaugaagaaaaaagcguaaguugucuuacauagaaagaucuucagauucuccagguaacucaaguauuaccaucuuuauaauuacaucuguuuuucuguucagcuagagugaaauacagucacauaucccguaacaauauuucagucaaugacuaccacauauaugacaguggugccauaagauuauauuaccauauuuuuauuguaccuuuucuguguuuagauacacaaauauuuaccauuguuuuacauuugccuacaguguucaguacaggaacaugcuguacagugucguagccuaggagcaauaggcuauacuauauagccuaggugugugguggauuauacaaucuagguuuguauaaaugcacucugugauauuugcacaacagucaccuaaugaugcauuuuucagaauauaucuccaucauuaaacaaugcaugacuguauacuugugauagaaaucauggaacuaaaaauaauaauaguauauauaguuuuugguauaccuucaaauauauugaauuauuuuauuugcaucugauucucugggguuggggugacagaccuuaguaugaccauuucauaaauggggaaauugaagucuaaagaacuugugucuuaacuaaugucauacuuguaaaugguauacaaaggguagcacacaacuuucugacucagggauaccauuauacucucaugcacuuauuuaucaaauauucaccaagaguuuuugagcacuuccuguguaguaggcauugcacuggacuguggggguagaaagacaaggcauaauuucuguccucagggaguuuauaaucuuguggggagcaguuagacaagagaauugguaacaguuauguguguaaauuauuauaaugcccacuguaagcaguuuuaaguguugauaauuuggaguaaagcuuauuuucacuuuuaaaaauuauugaagaucuuaagauuaguuaagauaaaaauaauuauugcuucgugcaaagaguaugacccguuuuacuugugugcuacucuaagacuggauaaguuguuacuguauccuuuguaaggauuuguuugacuucccaggguuauuuuacaugugccuugauauuuccaaagaugccuaauaaacaauuacgugaagccauuccuguaacauugccuugagggcaauuuuauaacuuacauauguuaaagucaucauacuuaauccauccuccagaugccugaucaauuuuaaauggcauuccuauuuaguugaaggaacuaguagauuaaaaaugugauugggauuuaugucuucccgauaacuuuuauauggcuucaugagaagaaagucagcaguggugagcaaaggguuugugaaaauugagacauagugauagucuaguaagaucagugcuggguguauaauuugagaaaacaaauagugaauuuaggcaggaacucaacuuugaagucacuuaauuauaccuaaggguauggcaagggguucuaaaauuacuguaacuauuauuugccugguauaaccacagcaggacagauaggggaauggaauuuugacuuuaaacacauauuucuuggcuuuaaacugcacguaggauuuagaauuauauagagacuuaaauuucaaucuuaacugugggcuuuuuuuuuuuuuaauguauauguauacauugguugcacuaggcucauuauuucaguugccugaauaguaauuuaacccaaugcuugaguuaguauuauuuuuauguaagaauaguaaaaaugaguauaacuaacagaaaauguuugcauauccaaggcuauaugaaugggauaagagcaccauagcuugguuuuuuuugggggggugggguuguuuauuuuuuaauccagaaaguauaauuuggaaacuuuacaauuccuuuuuuuuuuuuuuuuuuuuugagauggagucucgcucugucgcccaggcuggagugcaguggcaugaucucggcucacugcaagcucugccuccuggguucacacuauucucuugccucagccuccccaguagcugggacuacaggcgcccccccaccacgccugccuaauuuuuuguauuuuuuaguagaggcgggguuucaccguguuagccaggauggucucgaucuccugaccucgugauccgcccuccucggccucccaaagugccgggauuauaggcgugagccaccgugcccggccaaaacuuuacaauucuuauggcacauaagcuguucaauuagaugucaguuauuaagauagcagaaaaauuaaaaaguuuucauuauugccuuaaauuuuucugggaagcagggcaaauauaaauccuaaauaaauaagcaagcacuguaggugacauuuucccacuggggccucaguccaguuuuucuaaauuuguuuagcuuucugccugcuuuugaaggcuucuguugcuuguuuuuguuuucuuuuucuuugcucuuucacacggaaaucaaguguuuuuauugauugaaaacuuuauguuuuauaaauauacuuauuuguacugcuuguauuuuuagugcuguguucaagcagaugucuuagaagagguuuaaugaguagaaaagaaaaugagcaaacaugaaaaugaagucuucauguauuuuuuuuuucugaaagggauucucuuuaauaacauauucauaccaaacaaaaaucauucuuuccugaaacaucacuauaaaaauagaacauaaagauaacacuuuuuuuaaaguaguguaaaucaagaaggcauuuaguauaauuaaaacacucagaaaggauuuuuaagauuauuuaaaagacagauuaaauuacuuuuauaucccuugaccaccuccagaguuaaauuuaugaugugaaauuauggcaaauaagaauuguaccauaaauuugaaaaugccuuaaaaucucucagguuuugacaguaaaaaagggaacagucucauuuauugguugcuuaaugcugaagaccagagaaacauuuaaagggcuccuaauucuaagaaguucuuucggguuuuuuuuuuuugagacaaagucucacuuuucacccagucuggagugcaguggcgugaucucagcucacugcagccuccgcuuccuggauucaagagauucuccugccucagccacccaguagcugggacuagaggcacccaccaucacgccuggauaauuuuuguauuuuuaguagagauaggguuuugucauguugacugaucucaaacuccugaccucaagucagucggcccgccuuggucucccaaagugggauuucuuuucccacauugcucugcuuagagucaggagagugcuuuugugugcugucgcuuucccauguuucuuguacguagaaauguuaguguauggauuguucuucaaucuuacgaaaacuguaauccccacucucaacuuagacaguugcaccuuaugaguuaacagcuuuaucaacgguggcaauagcacuuugagggacucuugaguuucuuagucuaggaacuuuggagaaaauaaguguuuuucucagauacauuauuuggucgaucacgagagucaguauggcaagucuuuaagaaacaaauauaaacaucccgaaauaaauggaacacccacagagaaguggggaguuggaauuauaacugcccaaagcacaagcccugccacuaaauaucaccucucuuuuaccaccucacccccaagcugcuccugaguacugcauauaauaaaauaguguuuucaaaaaugugaagggagggagagaccauuuaaucaaagaugggcuguuacauggaccagacugucaagaagaaaagcacagggaacccaggggcaauuuuacuccugcuaaaugcuccuggaaaugaaugauaaggguuugauugcuagacacagaccuucugaaaucccugggcuacaguugagcuccuccaaauaaauugucauucauucauucauuaaaacuguaaaguaccuaccagagaucaggugcuggauugggcacagaaacagcaauaauugaaaaaucacauuccugaauggggcugggcgagguaaggaggcucuuacucauuggggagaugucccagaaacaaugaacaguggcacagggugacagggaccaugguucaggguaguacgugugauacugcucaguuacuagaagaaugggcauuggagagucagacugacauaguucaaaucccuguucagccauuuaauuuacuagguaugugauuaaguuucugggacuuucuaaaguuaguauccuggauauaauggucaaacaugccuuguaagguuaaucugaagacugaaggaggcaguagaugaaagucccuuagcacagugcuuggcacaagcaggcacucaauaaaugguaguguugcuuuauuuauuuauuuuuuaaccucccuuccaggucuguaauaaggaauagaagugugguguuugugcagaacuugucuacaagccaacuuguuucaagcugguugguaauccauuuggagcauggggaguucccauuggaaauacccauuccuacucacuauguccuuucuucauuuaaaauaugaucuuucauaagaucauggacuuuguccacagaauugcuuccaaacccucccuacuucaaccagccacugccuaccccaucaucaaccaagggcauuccauaaccguuaagacuuuucaaaguagagaaaagauugucaguuaaaaauugcaaauaauuuucucuguuuauagauggagacuuuaauuuaccuuuggagucccaaaucaucagaauaggccccacuaauuacauaaauuaaguaaagacuguauucauuuauuccuaauagagacacaacaugauauggugguuaagaguguauuuucuaagaguguaauuucuggagccagacagccugguucaaaugcuaguuccacuguugugcuggugagucuccaaagaugaccuccccaaucaccacaccuccugguauucaugccuuuuucuggcaucccccagcauugaaucugggcuugcuuuuggaacaaauuggauggagcagaggugacauugcaugacuucuggggcaagaacauaagaagcugccauauaaggcccaccaugcugugaggaugcccaacauagccauguagagaggcuuuguggagagagagaggcccagaaagcuccuaguaguuccagucuucucagcugaggugccaaccaugugagugaagucauguugaagggcuagcccagugagccuucagaugacucaagcccaagcuccuaacugguaguaaaugcaugagagaauucaagcuagaaccauccagcugagaccagugacccacagaaccauaacaaauaagaguacauuauuauuuuaagccacuaaauuugggggugguuuguugugcagcaggagauuacuguaacaauuacgagcuguaugacuuugggcuugcuacuuaaccucccugugccucaguuuccucaucuauaaaauguggauaaugauacucccuaccucauaggauugcuuugggacugaaauuacuguguguacagcauuaagaacagugccuagcaaaugguaaauacucaaaaaauauuauuucuucaugaaauauuauacuuauugaacacuuaugugccauggccuguuucacauccugggcacacagugagaaggucccugcacuaauggugcuuacauucuagaagcaggagagaaaccacaaaauaggauggugauguaagaaugacacugaugaggugacauuugaguggaaaccuagaugaugcaaagagucuacccacugaugguucuuggagaaacugaggucaccacuccuuugggugcaaugauuuauuauguggcagcagacaguaucucugaggcuucuugcccaucauaaguaaagcacaaaaugucuccu

SEQ ID NO: 16087 - RNA, 83884 nt, Homo sapiens
caggcuccucccuagugucgucgcuacagaggagcagaggaugacgugaggacagagucgcgaacaucuccucggagcgcagcugggccagcgguucccacagcccuggagcccaacgugcgcagaagcgccucuuggagcuccucucccacagaucucucguccucuuccugggcuaggccgccccaggcgcggccccugcgacuccuggcacggccccgugcucggcugccgcccuggcgcgcgccacacugucguccccggacgggcgcggaccggcucggccggggcgccggcggcuggggaggggucgcuggccccggggccgcgcaugcgccgccaccaacuuggggcugucaguggagggcgagugcugguucucaggggaggcgacgcccuucggggccaacgggccucgagccgaggcagcagugggaacgacucauccuuuuuccagcccuggggcguggcuggggucggggucggggucggggccggugggggccccgcccccgucuccuggccugcccccuucaugggccgcgaugauggcggcccuguacccgagcacggaccucucgggcgccuccuccuccucccugccuuccucuccauccucuuccucgccgaacgaggugauggcgcugaaggaugugcgggaggugaaggaggagaauacgcugaaugagaagcuuuucuugcuggcgugcgacaagggugagaguuaggccccuuucuccucuggacgccccuguccuccagaccuuuaguccucucccccgccucaacuuauaucggggcauucccucugucucaggcgccgagugucuucccgccucgccugcugccucaggcggucuucuccucaccgccucugcccugugaguguggagcuggcgggagaguggagcuggggcugcgcccucggagcgcugcaccgucggggguggcucuggccuugggguccgggguuuagguagcgccuugggagccccgaccccagcguuuuagcgccgcccuugcuacugaccgcaugaaugaccuggucuucucucuggcucgcaguucauuccuuccgggagucgagaggcuaguuuccgacacuccagucggaaaauuccgucaccuuaccuuaggaugccucguauggaggguucucaucaccugguuuuuguuuuucuuaaaaacaaaaccagacccucuauuauuuagcuucaccugaccagugcuuuagccagugacuguugacuggcauuaauaacggaauauccuagguggagauacaugaaguaaggacgggacggaagaaauucugccuuaguugccaaaacuuucucuggauuuacggaacgccuuugauuguuagugcuuuuuauuggagagaaagauuuauugcucccagaucuuucuuugggagauaaagauagugaaaaauaauuacaggaauuacaaggcaaaaauauguggaauauauuuagcgcguuauccuuuuuuuagucuagaaguuaaucauuuuuauggccauauuaaggccaugucacgcaaucauccuuuguagugauguauauaacaaaagggauaggaaauugauugcccuaagacugcuuuuguuuccuacauggaaacacuaaaauuuuucuuuuuccaaauuuauauggcuguacacuuaggaaaacucuguuagaaacaugcaaacuucuggaacaaacccaaagggcaguuuacacuaugaaaagacuaacuacacaggauuuuuguuuguuuguuuguaugugugaauguguaauuaauaaaugacagccuuccuaaccucuccuccugcuuuugaaauaggauuuuauuuacaugauuuuuugaaaacaauugacauauaaacaaaguccaccuaugucugugguugagccauuuuuauguucuuauguaauaguauuaaauaauauuaugaaagcaauauuaauaauauuguuaaaguacaccauggacacaacuuugagcagucuuugagauguaaagaaacagaauauacaucuacaacgucacaaaaauagggucuguggauuauguaaaauuauuuaguauugcuggaguggguugccugaguucucuucccucaaaaguucugagagaggaaggggagaagauuguguuguacuaaaaugaguaagugcuggcuccauguauuccagcucacugugcaaugguuauuuuaaagcaaacagaaaguaugucaagaaaggaaauuugauauuccugucaaacugaggacagaaaaauaucaguggaauaugguugagcaaguauuugugcauuguguauauuuaggauuauugcaugacauaucucaaacaaaagagaguuuuaauuuaugauaguuguauagccuauuuaguaguaccaggugaaauaccuugauauucuuugucaguuuuuuauuuuauaacauaauugagaugagagacuuggcuuuggggggguaggguggaaauuaaauaugcauauuuuccccauauauaaauuagaaauuuuuaaaacaagugagcuaaaaugggaauuuucuguuucagguaugucuaaacaacuucuugaguuagauuuggaaaaauagcauaauucuuacgcauacuuaugggguacauuuacauuuaaaaaguaacuuugaguuauaggaauauucuuuugauuacguguuuguauucgcuaauauuguuagacuuuuuaaaauguuaccuaaaccagucuaaaagugaacaauuuccugaaguagcuaugacuuccaccauuacacuggagccuuccucagaccaaauguuaaacauucacuaaagcagcuauuggggucgaguguucaugcuuuucauagaggauuucauuuaaaccccacaaccccaugagccagaucuguuguuguccucaauuuguagaugaggaaaaugaggcuuagcaaaauuuuaaaauuacuuugcccaagguuacauugguuagauaauaguagaacuggcauuuaucuugagccugcacuccuaaccacuacguuauauagaucugguuguaggugaaugagugaacaucauuugugucagaaaagacacauccauauuuggacuuacuaguugaaauuacauuuucuuuguauggaugcuuuauaaaccuugauuucuguguauuacauuuguucaaugaaggguaaaaagcaagcaugguacuucaguagcaccagaguaaaucaacucuagaguaucuaugguguucuagagugucucauucuuuucauguagcauucuuguuguacauaugcaaaauguucauaacauauucuucuuaggaaaaauugaggaauuccuaaagcaaaaauuguggagaugagauggauauguguauguuaguggauggguggcccuuugaaagauguguacagauuaaagaguacaauaaauguaggaaagagaaaagaaaaagauuuauaguuugugauagcuggcuuuuauguaaguaaguucgguagauuuaggcaacugcugaucuagguaguggccacuuaguaauggcuguuagugaucuucauagugggugaggaucaucucagagguaacauugaauccuuucuuuguaaaggaaaaccuuaauugaaaguuacugugccagcaauauauaaagugaagucuaggacccccagauaaaauucucagaaaguauacucauguucuuucuagagauagaaagcuauauaaauucagagguaaaacuuaauugaaacaagagcugacuauaaauauguuguuuuaugaaaaauuaaguagugauucuuacagccauggcuuuguccucucucauugagaauuagugucauaaugagccucuuuuauuuguaggcaccuauggugucccucaggucuguuaacaggagaaaggguaaauaaguuuauuuagaaaacaccuaaacuaaguguaguucauguuaauuuuccucuaaaaaaaaaaaacuuguugaguagaugguagcuuuuaguauauauuuguaaauauaaaccugcauaaacuguuugauuugcugaugaucauuaaucaguucauguggaggaaagaaaguaugaaaugauucagucccugccaacucuccauggagaguauuuucaggaaaucugaugugcgguaaaugaguuagaagccccuucuugaaauuucagcaugggguuagggggagggauggagagagcagguuuucaccuuuaucagugggcucagccuagucucaguguccugugucaccuuugugguaagauuugcuguguuguaaggaaaaauguuuugaugacuguauuucuuuuuuuuuuuuuuugagauggaguuucucuuguugcacaggcuggagugcagugcaaccuccgccucccggguuccagcgauucuccggccucagccucagccuccugaguggcugggauuacaggugcccaccaccacgcccggcuaauuuuuuuguauuuuuaguagagacaggguuucaccauguuggccaggcuggucucaaacucccgaccucgagugauccacccgccucggcuucccaaagugcugggauuauaggcgugggccaccgugccuggccugaugacugacuuucuccauaagcuuuguguaccuuugggcuaaggaugcuuuaaaaaugugcaacaacuccagagagaagccagagucagaagaaaaaagugcagcauuucugagagaaguaauauuaagcugcuguuuuuuaaacaccuuauuuauauauaaugggccuuuaaaauuuuuuuacuuauuugagaagagauuuugaagucugguauuagagaggaugguggugggaagaaacaaaaaaugcagaguacugaguauuggugugaaguguuauguugacaauggggcaccuaauguaaggagguaugugcugugaggaaaaaacuuugcagaaaugagagguaaagaggguauuguaggcagcauucuauaaacacuucacaaaucaucauagacauagcauuuauguacuuuauauaggaaagcuuuucaaauaaccaaaguuuuacaauguaauaguugaaaaacauugccauggcgaacgguucagggauacuuuaacaacagcaacgaaagacucaaauugcgaaaaucuuaguggauaauuuaucucuaacagacuaguaauucagcagcuagcugccugguaguucuaugauacugguaauucuuuauagugaucacgcaacuuugcugcucuuuuucuguaagucacaaucaaacuauacuuaucaagcuguuaauuguguuaaggcacugugaaagugcuuuaucaagaaaguacugaguacaucccuauccuuuaggagaauauucuuuaauggagaugcucucuugugcucuagcgaggagaaguaaggaaacaaaaguauguuuguauuaaauauaucugucugaagggaagaagcaagugcucaauuuaacuuaaauggccuauaugugauuuggagaaugggauauuacguguacagggucagucuuuuaucugggcaguuaaaaaaaauguaacccaagccagacuccuagcuauaccuuguauauagacuuggaggaagagugugaaaagauuaaauuuuauuauauagguauuaucguaaccuaauaauuccucuucuaccuugcugccagugcucuaaauaucuucuucauugcuaacucuuccaaauuuaaugauacugagaaauuuaagauuuaagaucaauaguugaauagguaaugaggauuucaaaaguuaucacuaagaugugauuaacuaaugacuuuuaggagccuagaugaaugauaaggacuaaaagaauuccagcacuguaucaauauagucaugagacucaguagauuucuuuggaugccaaagcuuuguuauguauaaagugggggugacuggcacuguuauuaauagcuucuguuaauuuuuaaacauauguuuuucuagauuaacauauuggccaguaauauauuuuucuaguuuuauaaauauguauaauucaaauguauaugagauuaaauuuaagcaacacaauaaauccuuucugagacuguguugcaacaaccugauauaaacuaaguuuuaaacaacuuacagcagcauugugaaugggaucucaugucauuuaucagacucuaacuacaaaauaaacauugcuuuugacuauuuuucuaauagaguuaagaauaugcuguuuauaauuuuuaucaacugauuuacuaugaaaaaaucagcauuaccuucugugcuauaguguaauuuuuucaggcagcagugugaaucuuugcucuuuugccaaaugauauucauuauuauuaaugguccucauuaagauucauaagcaacuaagaaauuaugguaauaauugucuuuuuacaaaaauguucaaaguguuauaaacaguuuagccuaccauguuuuuuaguaucuuuaauuuugaagguuucauuuacaauaauaugguuauaaauacauuggggucuguaauacgaguuuugcacauuugauaaagcuacauuuuaaaucauuuucacuguaaaaagucugcauggguuuuuuuuuuuuuuccuuuuuaaaauuugguucaagcuaauuugaaguuugaugucaguuaacauuuuuaucaguauugucauuuauauuuccagauccagcaacugaacuugaucaugucuuuuuauuuuuucacaucaucauucuuuuuccucuuaauaaaacuuucuguuuuaagcaucauugguaauauuucaguuagaauguugcaauugccacacucagguuuguuacagaaacuugguuugaaaagcuuuacaaauuuuuugacauuaaauucucucacacuucacaacuaacuucaaauuugguuaauauaaaauuaaacugaacaacauugauacucucuuugccauaaaaucaaacgagaugcuaaugaggaagagguggaaucaccuguucuuaaucaguauuguaacauuucuccauuguauuucucaaggguuuauuacaguuggccagaguaaauuuguugcuaaggaucuaugggaucacucugguauuuuguauacuaguucauuuuuuuuaaauugcugguuaggacucacuaaauugauuuuaugacuguuaauggguugcaaccugcaguuuggaaaacauugguuuggaaugaucauuggcugagccgcagagaggcacaagaugaauucagaauguuaacaaggucuaacuaaguccuauagggcuuuguaggccacaguagaaauuuggccuuuauuuuaagugugauagaaaaaucacaaaguuuguaagcuugauauguuuugauuuuuuuuuuuuuuuuuuuuuuuuuuuugagaccgagucucgcucugucgcccaggcuagagugcaguggcgugaucucgguucacugcaagcuccgccucccacguucacgccauucuccugccucagccucccaaguagcugggacuacaggugccccccaccaugcccggcuaauuuuuuguauuuuuaguagaggcgggguuucacuguguuagccaagauggucuccaucuccugaccucaugauccgccugccucagccucccaaagugcugggauuacaggcaugagccaccgcgcccggcuuguguuuugaauuuuuaaccgauaacucuagcuguggagugcagaguggauugaagggguggggcuagagcaggagugagcaaacuaugggccacagaccauaucugccuguucugugaggucuuggagcuaaaacugguuuuuuacauuuuauauuucaaaugguuaaaaaaaauuucguaacacaugaaaagucuauaaaauucaaauuucaguguccauaaacaaaauuuucuuagaacacauccacuaucauuuguuuacauauggucuguggcugcuuuuguguugaaagggcagaguugaguagcugugacugagagugcauggcccacaaagcuuaaaauauuuacucucuaacccuuuuucagaaaacuuuguugaccccugugcuacaguauaaaguauuaguaaguaauauaaguugcaauagggaaaagaguaaacaaggaagggggugagugugggcucaguggagucagggaagugaaaaauuacaaaauacggggcuuggggaguugguccaugugaaucccaccugaguuugcuaaaggcacuuaaggaguuaggcuccuacccucccuggaggcugagagauaggggcccugucuucagguguuggcuggaacaaaaguaaauuuuuaugucagcuuugaguuuucucgggcaggcauuuuaagaggggcuagggucauccuagggauccggccuucagcuguuagaaacacuuaaguguuuuguucaaguuuauaugggccaagguggaggccuuguggagaagggcucagaaaagccugacuagaguuugguuaaggagagaaucuuggucagcagcuguguuaguuaagaggcuauugcagaguccaggaggaagaucauggggguuuggacuguggguagcaguauacauggagacaaguagaugauuaugggagauauuuuagagagggggcuaagaagacgugcuguugaauugguauacucccuguggaauugauugaaaaugguuucuuuuuccuugacugaaaaagacuaccaucuagccaaaaaaguaaacagauuauguugcacuuccuucuauguguuauauuuuaaaagacaaaagauguaacucuugaaagcaacuucguuauaaaaugaauggcauuuauauauuugucugucauacacaggcauuuugaauuguaauccuuguucuauaacuagcuacuugcugucuauuuuaaguuuucugaccucuuuuuacauauauacucauccuaaaaauuaagaguguucuggucuuuuuuuuuuuuugacauagugcauuguuuuaaaugaauugcaaauauaaacuucucugaaaugcuuagcaaccacucuagguuuccuguagguucugugacuauaaugugauuuuucauuugcaugacuguguuagcuguagcaggguggaaccuuuuauuuuuagggaugaaaauuauuuauuugguuuugauuuuuagggauuuucuuucuuucuuguauagcuccuugacuacaauagaaauaaucuuuaaaaccuuagggcugggcacgguggcuuaugacuguaaucucagcacuuugggaggccaaggcgggcagaucacuugaggucaggaguucgagaccaggcuagccaacauggugaaaccacaucucuacuaaaaauacaaaaauuagccgggcgugguggcagcugccuguaaucccagcuacucaggaggcugaggcaggagaaucgcuugaacccaggaggcagagguugcagugagccaaauggugccauuguacuccuccagccugggugacagagugagucucugucuuaaaaacaaaacaaaaacuuuaaagcuggaauauaugauauuuguaauguacuuuccuuuuuaacagcaaucuaaacuuuuaaacauguagcaguuauuuuugucuauuugcuauaccugaaauuuauaaaaugucauaaggauuuauuuguguagcucuuccuacguuucugucucuagcaauaugguugauuagauaaucugaaaaccuuucuucuucaaaucaccuagaaauuauagcuaaaauauaaugaacauccaguuaaaugaacagcugagcuuucaagaaaguaggggaaacaaccaagauacaaaagugaagaaaaaacugaaaaacaggaguuugugagcugacacuauggcugcuccauggguggggauaagaguuacuguucugggcauugcagggauuugagucuuaaugcccauaugagaacagguuacaaggccuggagacuguacaaagugaggaguuggauucaacaucuaagcauaaaaccaggauucuuaaaggacuguaccuucagcaaagagguagaugaggagaaaaaccaaucuaccagcacauggagacuucaaagaagcuuguuuguguuauugugggcucugaauaaggcuaaaaauaagacuccuuuaagaauacauaaccaugguccugccucuuguugucuugggguucaaauuaauacuacuuucagauaauuaaacugucauacagcgacuacaaaauaauuauguuuaaaaugaugagaaaguuaaaauaaggaaaugaaaacauaagaaaauaagagaguuggaaagaaaucugguaaaacuuaugcaaauaaaaaauacagucauuaaauuuuuaagaaaucagugaauggguuaaaggaggaaugugaauggaagcuaaaggagaaauaagugaguggaagaaauaugugaagaaauuacccagaaugcaggaaagagagaggaaaaaaagaaaaaacaggaaaucuugagagacacagauguugaaaugggaaggucuaacuuaaugucuaauggaaguugacaagagaaaaagcaauauggagaugaagcaauauuugaagagagaauggcugaaaauacugaagaauuaaugaaggguagaaguccuuagauuuagaaagccuaggccagaugugguggcucaugccuauaaucccagcacuuuuggaggccgaggcgagaggauugcuugaggccaggaauuugagacaagccugggcaacauagcgagaccucaucucuauaaaaaauaaaaauaaaaaaaaaaauugaaagccuaaugaguccuaagcagaauaaauaaaaaauuacuuuucaccuggacacaucacgauaacaaaguauagcagaauuuuuauguguagcauucuacuacuaagauguugaaauagagucaccugaaauaagauuuuaaaugucacuuuccaguaauagcgauaaauuuucacuggucuaucuuuggucacuauugguucaacuugugacuuagaguaucacuuugugaagugucugucugauaagguuuucccagggagcauuugugucuaacuauuaacuacuaguacuauggggaaaauauuucuuuuugugacuaguuuucuucuugagggaccuaaggaaauacauugucaagaaaacuaucacccagcuuccuucaaaagaaguuguaugugugaggcagggaguuuaaggccauagauuaaaaauaguagcaaauuuacuugaaauuuuaauaaauaaaauauguuaccugucuuucuuacucacuuauuuagcccaguuucaguauuuucuuuuucuguaucaugaaaucauuucuuuuucuauuuucuaugcugauuguucuuucccuguuuauuuauagacuucuaaugagcaacuguauuugcacaucacguaaaaugacuuauuuaucuauuguuuaacaagucaaaugaaacaaaacaagcaaaacccaccuuggcuuuuuuucucuauuuaauuagcauuucucuugauuuauuccccauauuccuguaccaucuggucagcagacaaauacaguggggccuugcugaaaauaauuacugcuguaauuguugucauuuccucacaugggacaacuguuuuguugugggcuacagucacacagaaggcaauuugccugcuccuaacaggucaggcacuaauccuaguccugccuuaagaguuuugugaacugaauguucccuggccauuuaaucuaaucagcuucauuaaugagaugguguguguguguguguguugggagggugggaaguagggaagaggauuuucagacaucuuucccuuuacuauacauauccuugaauauauauguauuuauacugcuuuuccaaaguguuuucuccuguaaaaccucuuuauaauauccucugcuuauuacuagaucucauuuuuaacucuauguuauguaaguaaauaucuauguauauuugagguauaaaacuuaauucuuuaagcuuuuuccaucuaauuuuucuaguguccagucugugccuuugggcauccuuuauuaaauugcuuuaaauaucuuccaaaaguuucuccucuuaugaucauucaguuauuaauuuuaaacuaauaauuuuuauuuuauucuguacauuuaaaaauuuucuacuuuuuaugucugcugcugauguacguauuauuuuauuaagguauaaauuuucaucaaggaaauguucacauucucuguguacauuuucuuauacaaaaaugaguuuaggcuuuuaaucuuuuaauucaacaagcuaaguuuuucuuuacagucauccuuacuugauaugucacggauauuaaauuauguuuguauauuguuauuuaggugacuauuauaugguuaaaaagauuuuggaggaaaacaguucaggugacuugaacauaaauugcguagaugugcuugggagaaaugcuguuaccauaacuauugaaaacgaaaacuuggauauacugcagcuucuuuuggacuacgguugucagguacaaggcuagauaauuuaauccaguuaacuucuaagugcuguuagauaugccaugcuuucuucccuucuuguuuucuuucuucuuuuuccuccucuucuuccuuucuuuuucuuucuuugucucucuuacucuccuucugucuuucaucuuuuauuugguuuugaggcacuaaaaguuuuaaaaacaaaccaaaaaaaacuuuuugaaaaguauaauauuuugaauugauuuaucuuuuuccucccaaaugucauuuuccccacaugacuuauuaaagaugacuuuguuuucauuaccuauguuaacacuauuuauauuauauaucuaaaauaguacaaauacucuggaagugucagaggaauaguuuuuuuucuggcccauauuaguuacagacacaucaacaaaauguuccugccucaaaacaguuuucaguuugacuuugguuuuauuaaauuuuauuuuuuuguuugaaacuuaauguuuguuuuuaucuaaagaugaaugauuuuuauccaucuauaaaagguagaccuuccuacuucauaucaguuuggguagaaaaacaggcauguguguaagucuugaaugaauucagucuagagauucugaagggaauuugauaauauuuuccuuuccuuuuugguuugcuuaugaugggacuuggcacauuaauucuaccucuuuuuuuuuuuuucuuaaugaggcacauuuuuuuugagugacaucaggagacauucacagcagauuuucugaauauaaguaggguaauucuauguacauugcuauuuuauauauauauauguauguauguauguauguauguauaaaacaacaugugguacuaucuccauguacauguuuggaguaaaaaaaaaagaauugcuuacccagcaacuucagcuauccagaccacaauugagaagcagaaaguaaguaaaaaauaccucugagcagccagugguuugcugccaugaaguuuacagauuaaauuuaugaacuuuaguuauaggaguccuccaucagggucuauuuuuucucauuuuaguuuccauuuuaacauaauuaauuucuaauccauagagaaucugagggacaauggaaggggcaugagagcugcaguggaauaaaaugaggagugguaccuccgacacuguuuaacagaggucaacagcauuacacaugugaucucugagggagcuguauguuaggaugauaauuaaggcuuauaacaauggugcagagucaguaaggaagaguuaaauuauauucaguaccuauuguuuuagaagaaagacuguauauauguguguuuguguaugugcguuuguguguuuauaagacacaaaagcagaagacuuccaucaaaauaguuuaaauuuuaaaauuaaacacuuaaaggcauaagcuucaguuaccuagaaaauaaggguagaaaaaaauucauacgcugauucuggauaaaagaauuacuaugguauuauaauuuugucuuuuuacacaugguuauauacauguaaugguuuugcaguauacauggugcuuucauauacuugaucacauucagacaucacagucaaccuauauagauguuacauuuuauagauuagaaaacugaggcucauagacuuuaaugaauuucucaaaguucuaaaauuaguaaggacaagacaaagauuuaaauauaaucuucugauugcaaaucucaugcucuuucuaguucacuguguucuguccagguuaccugugucuuauuuuaucaguccacaaauguccagggccuuugguuggguaugauuguggaaaugaauaaguaaaacauggguucugugugauaggaucuuuaagacaaauuggacaauuaaaguauguaugaauuacaaguaaauuaaguaauacaaagguauauuugguaaguguugagugguaauaauauuugaccauuuuauauugcuuugcauuuauaagagcuuucauguaucuugugcuauaucagugguucucaaccaaaugauuuugucaccauaaggggacauuuggcaaugucugaagauacuuugguuucacaauuggagggcaguuuacuacuguuaucuaguggguagaggcuccuacaauacccaagacaguccccacaacaaaaaauuauuuggcccaaaauuucaguagugcugcuauugagaaacccuguuuuauguuuaaacuuuugugguuugauauacauuauuuagaaauauagaauagguuggggcuaucaagaaagauuucauuggaaaaguaucaguugacucagccuugaaauauuaauaauugcuaacauuuauauaauaacuacucucugccaggaaccuuaaauauguucacuuacuuaauccucacaauauagggauuugaauuuaaucuucaaauuaaauucagggaugaguuagauauuauuuuauuauuauuauuuuuugagauggaguuucgcucuuguugcccaggcuggagugcaauggcgugaucucggcucacugcaaccucugccuccuggguucaagcgauucuccugccucagccucccaaguagcugggauuauuauaggcaugcaccaucacgcccggcuaauuuuguauuuuuaguagagaugggguuucuccauguuggucaggcuggucucgaacuccugaccucaggugauccaccugccuuggccucccaaagugcugagauuacaggugugagccacugugcccagccuagauauuauuauuguccccauuuuauagaggaggaaacagguaaaaaagguuaaguaacuugcccaaagucauucugugaauggcagaccuggaauuugaacuuagguucuggcuccagaaucuauggucuuaccuauuaugcuaaucuacucucaaacauguaaagacagguagggaacaggagauguggagaaggauauaaacagagccaugugcaauguauauuuuugagacacugaauugauuuagcauuuuugaacaaaacaguuggguuggggaguaguaggaauuaggaaaaauaauuaaaacaaaauggauacaaagggccuugaaugccagaauaaggaauuuggguuuuauauaauaguuaggggauaucauuacaugauuuucgagaaaggaugugauguguccagugguauuuuagaaagauguaucuaguggcugaauuuaguauagacugggaaauggaaagugggaaaggcuauagccuaugucaauaguuuuuguaguaaucuacauaugaagagguugaggcuugaacuggaacagugcuguaagaaaaacaguggcuaugagaagaagggggaaaaggcagauaugaguccauggccuauaugguuccguggucuguuaggaacugggcugcacagcaggagguaagcagcaggugagcgaucauuacugccugagcucugccuccugucaggucagcgaugguauuagauccucauaggaguacgaacccuauugugaacugcacaugcaagggaucuagguugcaugcuccuuaugagaaucuaaccaaugccugaugaucugagguggaacaguuucauccgaaacuaucucccuaccugcucuaugaaaccagucccuggugccaaaaagguuggagaccgcugugaggaauugacaaaucuuagugaauauuuugauuuggagugggaaauugaaaaggaguccaggaugauuuggaaaucuuaaacgugggugacuaagagaaggaagaaaggaaaacauuaaguucagaagcuaaguaaagcuuggggcaagggaaugugaauucugguuuuauccuuguugauuuggcagcuaucaggcaguccucaucagacaaacacagaugaacauuauauuucuagggagagaucaggcuaaagagauacaguaagcugucagggccaugggaaugcccaucaccauugugagaguaggugaaaucauggagaagagcaaagggcuggugcagauucauucuuaaggaaacaucuacauuuaauaaagagcauuacauggaaagaguuucauuaaagaccaaaugaauuguugaagauaucagaggcaguuaggauaaugcaacauugugaaagccaaaagaauaguuuuuaacauauuggcuuagaaauuaagaaaaauuagaagguagaaaaaguaauuggacuuggaaacuggcaucaguagaauuggagaaaugauacacuuugauuugcaaaguuugacacaaugaaaggaagaagaaaacgagugguaagagaaagauggaauuaagucaaguuagcaaagagcuaguaagcaaguuagcaaagagugaugaaggauuuaaaguucugggaggugggagauuagacugguauuucugcaaaugaaggaccaggguucuaaagauuggagagcaucaaauagaauacuaagguggaaaauguagcuuuggaaaggaaauacguaacuuuuuuacucugagcuuaaaggaaagaguaugggaauuguugaaaagauaaauucuaagguaggaaggaagauaaugaucucauaaauauguaauaaguauauauugaagagcuuuuaauaaagaaucgucaaauaucugagaaauuggaaagcaaaacuagugaggauuuuuuguauaacuauguauuuuuaaaauaauuuaaaacauuuauuucucucauaacugccauugauuuaucaaauaacauaccauuugugcagaauaaguaaaugguaacuccuuauuuacaagaaauuuuaauguaaaugaauauuuuuauagcugaagcuuauccuuuuaagcauugaaagauuuaauguaaaucuuuauuccuuacuaaguaauguaucugaauauaauuuaacuuuaccauccuuaguuggaauaauugagaauguaauuauuuuacuuugcuucauauggucugaaacuauuaacauguuuguccuuacauuaaguggcuuuagacuguugugcauugauagugauuuugcuguacugguauuuaaucuuuucaguagucaacuuuuaguaauucuuucuuccuuucccucuacgcuguugguuuuaaucuugcuauucuuuuauucaguaaagaucugaaggauacuugggaaagccagauauucaucauuuauggacaauucuaaaucagaaugcuugggucuguuucuuuugggaaauaauacccauggaguuucuuugugacagcucaauauguugcuguuuuuaaauccauggcuauuuuucagauuguugaaguucccugguguuugacuuugaaaguaaugacauuacuauaguuagcuuuauugguuaaaauuaaaaaucauaggcugggcgcaguggcucacgccuguaaucccagcacuuugagaggccgagguggguggaucucuugagguugggaguuagagaccagcccagccaacagggugaaacccugucuuuacuaaaaauacaaaaauuagccggguaugguggcaugcaccuguagucccagcuacucgggaggcugaggcaggagaaucccuugaaccugggaggcggagguugcagugagccaagauugugccacugcacuccagccugggugacagagcaagacucugucucaaaaaaaaaaaaaauuaaaaaucauaaaugaaauauuuaauaguaauggauauagcauucuuuuuguucauuuccuucaacugauuaaauaugcuaaaaucugaagagaaauguuugcaaagcagaguaauaaugcuaggacuuuaaagcauaggccacagcucaaugaacccugaaaguuuuaagagauagugcaauggguuaaauuucccaucugggugggaaguuuuucugugggaaaacauaggugauuccuaaggguugagugaggacuccaacccuuuuuuuugaggugcauaguccuauuuuuagauauucagguaaagucugccacuuuuaguucuauuuuuuacauccagauaaagugaauauaaacuuuacucuuuucagcuacaaagaauauuaaagaucgauauaguuuuguuuccaagagcaagaacauugauuuaaauaguuauuaaugauuauagcaguuaaaauguacagauugaaaauaauuagggcauuuucuuagauuaaaucauuauuuauccccauguuuuccuucuuccuuuauauuuuucccuaaaaauccaaaaaccugauguuauaguugccaguaggacuauaggcuuuguuacagaguugaaaaguccccauuuccucagagucuccuuacuuuuuccucuuucggaucuucacagugagcuauagacugggagcagaaugauaaagucacuucucccuccagucuccaugaacuuugguagccuaacuauuuguggcuuauacuugauaaaauugcucauaaaugucaaauuuguagcauuuuagucagccauguguuuuaaaaaugagaacagaaggcucucaccuuuagauauucucccuauauuccuguuugcauugaugauaaucauuuucauuagacugaaaaaaauccuuuaccuguaguaauaguucuugacaguuucuuuuauagauuuggauuguuaagauucuuuugguccacaguucaagaguaaggaucuugaaaaaaaauuuucaacuuuaaauccugcauggaucagcacuguuacucuaauaaucccuucaaugagacauucauuauuuuaccaacucaugcauugaaaccaggacagaaacguguguauugugguacacagaaguacuccuaaggcaagcaaauguacuauuuguacagucaaaauuuuugaaaaauuuuguauuacuguauauaauacaguuuaaauuuuuaaaaaguuuuauuuaugaauuaguaaaaagaaguaguuuaccuuuuuaucuuccauuuucauuuuuaacuuuuuuuuuuuuugaagucugcagaugcacuuuugguggcaaucgacucugaaguagugggagcuguugauauacuacuuaaucaucgaccaaaacgaucaucaagaccaacuauaguaguuaguacucuuaaauauuuauuaauuuggauuuuuaaaccaaaauagaucucuugccccauugccauuuuuuccuucccucaaauuuauuuuguuuuuucaaaaaauagauauuuuuucucacucuguaaaauauuaaaaguggacacuugcaggaauaauuaguauuucuuucaggaaaacuuuuuaaauuuaguugauauuuccauaauuuugucacuguggaccaguauuuaccauuugaaauauucugcagguaauguugaaaauauagauuaguuugcagauagauaagaauuaaauguaaacaaugaaaccaacaaacuggaagaaaauguaggugaauguuuaacugaucgugaguagaaagacuuuaugugcauaaaagcaauggacagaaaucacaguggcacaguuuuugcuguuaaaaaaguuaaauuuuuggaauccagacaucagacaaaauuuagaaagcagaugaauaacuggcaaaagauauuugcagcauauaucauaaauuaauaaucuuaauauuggacaaauuggugaaaaacauauuagaaaaggacauagaaauagcagaaaauacaaaauguuaaaucuuaaugauaaucaaauacaguaagauacuaauuuuaaacuuaccaaauuuacuuauuaaaguugaaaauuuaaaaaaaaucauugauagcaagggaguauuacagucucaugcuacuagugaggcagguauuuuggaaaguguuuuggcaggaucugucauaagaaagguguucauaugcuuuaacuuagugcuuucuccucugggaacuuaucaaggaaauggucagaaauguggacaaaaauguugguugugaucuuauuuguaguaauuuuuaaaagcccaugugacauaaucuaaacauuccaaaauagaagauaggaaauauaaaugauuacauauauguacaauggaauauuaugcagucauuaaaacaguacuuuuaaaagaauaguuaggaacauggaaaaauauaacguaguaaguggaauacuuacuaugguuaaaauacuuaccacgguuaaaaauaugcguagaaaagggacuguguggaaaugcaacaaaauguuaccuaacaaucaucaucucucauugacuaaccaaauuauggauuuuuuuguacucuuuuuauuuuucuuuauugcuuuuguaauuaggaggauagucacuacuaaauaaaugcuaauuuuauuguuuuuuaaucaaauuuuaaacaugauaacauucauuauuggugacgauaccgugaaacaagcaguuuaaauaacugcuggcaauauaggcuggcuauaagcagaagaaaaauacuguuuuaagagagaauuauaaauugguuguugacucucugccauguuugagaaaugugagaggcucugcuaaauugcauacuuuguuauauaguaacugaaaaaucuuacucauucagacuauuacaaaagugugacuuucuccagaggauaguaccaucuaguuuaaguggugguaagaaaucaacaggaauaaggaacaaaaggcuaagaauauagucccuauccaaagcaucagaaauaucuaaaauaccauucaauuuucugccacuuaucuugcaguuauuauuauauuuuggcacaccugucccaucuucuagccuuuuaguccauuuccuuuccugggggaagggugggguguagugugcuugaguacuggaaccauugacugguuuuauucaucaccauuaucacuaacgauuaaaucuuaguguuggcagcccucaccuacuuaguaaaauaaccuuugggaggccgaggcggguggaacaucugagguugggaguucaagacuagccugaccaauauggagaaaccccaucucuacuaaaaauagaaaaauuagccgggcguggugccgugcaccugucaucccaguuacuugggaggcugaggcaggagaauugcuugagccuuggagguggagguugcagugagcugagaucgagccgcugcacuccagccugggcgacagagcaaaacucuucuaaaacaaaaaagaaaaagaaaagaacacuuucuacucugucucuaacaaauaaagauuauucagccuuuauuuaaauacacucaaugacagcaagaucauaccuucuuuuauuuuauuuuauuuuuuugagacuuaguuucgcucuuguuuuguuguccaggcugcagugcaauggcgugaucucaggucacugcaaccuccacuucccggguucaagugauucuccugcuucagccuccggaguaacugggauuacaggcacgucccaccaugcccagcuaauuuuguauuuuuaauagagaugggguuucaccauguuggccagucuggucuggaacucuugaccuaaggugaucuacccuucucggccucccaaagugcugggauuacaggcccagccaagaucauaucuugauagcccuuuuacuucuagagaggcaauauuaaauauuuuuauauauuuuaaauaacugagggaauauaaacuggcuauaagcagaagaaaaauauuguuucuuuuagcguuucaguaaugguaauauucuuuuagcauuucaaugaauucauucuguauucuuggcuugccagauugucuuuuuggcaauugacuuucaaauuuagguuuuuuauuuaauaguauacagauuauauuaugaacaauggaauuaugaacuuuaaucuuaugcauaucuagugauguuuuucauacaguuaaguauguuucauaagaaacaugaggaccacuuuucucuuaagggauuaaauauauuuuauucuucuuuauaaccaguaaugcaaugauaagauggaaaagggcuaguuuuagguuucucuguaauuuuaaauaaagucauuaauuugaaguccucaauaaauaaauaaguauauaaacaaauuagucauaaaagaggaggaaaaucagauaaguauaucagaaaauauuaaaacuuaccagugaucaaaggaaauuaaauuacaauuucaugauaguauuuuucacuauaaauugggagugaucaugccuaagacgggugaguaaaacuuuagugugaaauggguaccuccuuauauuauugguaauauaaacuauuaaaaggacuuuaacaauauguuucaagagcuucaaaacuguucauggccgggaggcggagcuuucagugagccgagauagugccacugcacuccagccugggcgaaagagcgagacuccaccaaaaaaaaaaaaacuggucauggccuuuagacccauaauucugcugcugggcuuuuauguuaaugagauaauccuaaauuugcaaaacacucuuuucauaaagacguuuaugguaaauuagcaaaauaaaauacuugaacacagaaucuaugaacuuccuuaaauugcauauaaaauuaugugcaugaauuauuuuuuucugaagauucugggcuauguaaagauccugcuuuauggauuauuaaaagggucccugaucuuggagauauuaaugaccacuguuuaaucauugguccuuagaauaccuacuguuuaugccaaagauguccuuaaaagggggguguaguagaaaaaggauuaaaaugaaauacuguacuggaaaauguuccuuggguaguaggaauauggguauuuuuaaaauucuuucugauuuucuacauuuucagauauuuuauaauaaguauauacacuacuuuuauaauauugcaaaaaaaaaguaaguauuagaaaauacgauaguuauaaaauagucaaccuuuuuauuuaagccugguucuuuaauuacuaaugguauuuuccucauuucaugcucuuaccacacccauggacuccuguaguggaaggagcuccagcucuagaguaauacaaaccuggauucugaucagcacccagccacccuguuuguggcucaggcacauuaacuucucugagccucaguuucuucguggggauuauaaugcuugguuuugcaggcuacuguggcaauuaaaugagaugauaaauguaaagugccuaacaguuccagaacucauuaaauacuagcauuauuguuaauuuuuuggcguuuauaguaggaaguaguauauguaaugauugaaaauguguagaaaauuauacaaaaugaagagugcuuccuauugcccuuuucaaguagcugcauugcugucaaugugauaagguuugccauagaggugaaauucuuaguuuuucucacauguuaauauucucccuauuuuuuagcauuuuuauuuuucuaauauauuuuucuaacauucuucuuuauuuuugucaggcaugauucuauaaucuugugaaaauuaaacacuuuucccuaagauauuucucuagauauucucacuucuuuguuggaaaaaacagaccucuaguuaaaugaauguuaccuauugaagauuuugucuguuaugauuacauugcauuuauuaauuagaguuaaguuuugagguuucaaagaaaaauuuaguccaagcaaaauguuuaacauauuccuuaaauaauucuuaaguucuuugugccuuccuauuuuuucauuucauucuucagauaaauauauuuuuugaagucacaaauaauaacuuuggacauuuauauaaauauuuuucagaaacuaauggaacgaauucagaauccugaguauucaacaacuauggauguugcaccugucauuuuagcugcucaucguaacaacuaugaaauucuuacaaugcucuuaaaacaggauguaucucuacccaagccccaugcaguuggcugugaaugcacauuguguucugcaaaaaacaaaaaggauagccuccggcauuccagguuagaacauuaaacuuuugauaaauagaugugugauauauaucaacaauguugauuuuuaaaauugguauucuuucuaugcagcuuuuaagaaaugugaugcuggggugacuuaugaaagccaaacuuguagcuccuuuguuuuauauaaugcauucugcauuuuuaagaaguguucaccaaaugcugaauaauugcaaaaauccuucaaauuaugaaugaaguuaucucauacuccugcuggcaggggcacuauuugcuuuuuagaggcagaguuuauuaauccaagagaaguuccaagucguggaaggaguggagauaccaccuccuaucucauuuauaaagaaaucaaaacuauuuucugucuaacuaaguauugaccuuuuaugccucuaucuuccccucucacacaauguucaagucuuuuucucuuucuuauugaucaucucuuccuguuucuucaauuaaaaauguuaagaacaacugaggauugauugaccaagaaaauacccugucacagguugagcaagaucacacgugggcaugcuguauaagauacauggugcuggacuagauuugagaaucugauuuucagcagaaacauuuauacauacagucaugugcuacaugacauuuugguucaaaaacaguucacauauaugacaucgguccuguaagauuaaaauggagcugaaaaauucuuaucgccuacugaugucauugcuguggucacaucauagugcaacgcauuacucacguuuguggugaugcugguguaaacaaacccuacugugcugccagucauuuaaaaaaaguagagcacauauaauuuuauacaguacauaauacuugauaauaaugacuguuacugguuuauauauuuacuauacuuuuaucauuauguuaguguguauuccuucuacuuauaaaaaaauaguuaacuaaaacagccucaggcaguuccuucaggaaauauuccaaaagaaggcauuguauucauagaugacagcuccaugcauguuauuaccccugaagaccuuccauugggacaggauauggagguggaagacagugauauugaucauccuaggcuuaaacuaauguguauguuugugucuuaauuuuuaauaaaauagucuaaaaagaaaaaaguuaauaaaaaauuuuacaaagaacaaagcuggaggcaucacgcuaccugacuucaaacuauacuacaaggcuacaauaaccaaaauggcaugguaauguuaccaaaacagauauauagaccaauggaacagaacagaggccucagaaauaaugccacacaucuacaaccaucugaucuuugacaaaccugacaaaagcaagcaacggggaaaggauucccuauuuaauaaauauguugggaaaacuggcuagccauaugcagaaaacugaaacuggaccccuuccuuacaccuuauacaaaaauuaacucaagauggauuaaagacuuaaacguaagacuuaaaaccgugaaaacccuagaagaaaaccuaggcaauaccauucaggacauaggcaugggcaaagacuucaugacuaaaacaccaaaagcaauggcagcgaaagccaaaauugacaaaugggaucuaauuaaacuaaagagcuucugcacagcaaaagaaacuaucaucagagugaacaggcaaacuacagaaugggagaaaauuuuugcuaucuauccaucugacaaagggcuaauauccagaaucuacaaggaacuuaaauuuaugagaaaaaaacaaccccaucaaaaagugggugaagcauaugaacagacacuugucaaaagaagacauuuauucggccaacaaacauaugaaaaaaagcucauaaucacuggucauuagagaaauccaaaucaaaaccacagugagauaccaucucaugccaguuagaauggugaucauuaaaaagucaggaaacagcagauucuggagaggauguggagaaauagaaaugcuuuuacacuguuggugggagugcaaauuaguucaaccauuguggaagacaguguggugauuccucaagaaucuagaaccagaaauaccauuugacccaacaaucccauuacuggauauauacccaaaggauuauaaaucauuuuacuauaaagacacaugcacacguauguuuauugcagcgcuauucacaauagcacagaguaggaaccaacccaaaugcccaccaaugauagacuggauaaagaaaauguggcaagaauacaccauggaauacuaugcagccauaaaaaaggaugaguucauguccuuugcagggacauggaugaaacuggaaaccgucauucucagcaaacuaacacaggaaugaaaaaccaaacacugcaugucucacucauaagugggaguugaacaaugagaacaaaccaccauggcacguguauaccuauguaacaaaccugccauucugcacauguaucccagaacuuaaaaguaaaauuuuuaaaaauuaacaauaguaaaaagcuuauagaauaaagauaugaagaaauaauauuuuguacagcuguauguguuuguguuuuaagcuguuacuccaaaaugguaaaaaaguuaaaauuuaaaguuuacaaaauaaaaaaauuacugugagcuagguuuaauuuaguauuaaagaaacuuuaaaaauauacauuuaggguagccuaaguguauaguuauuauaaagccuguaguaguacaguaauguucuaggccuucacauucacuuaccacccacucacuaccucacccagggcaacuuccaauucugcaagccacugaugguaaaugcccuguacagguauaccauuuuuuaauauuuuaugcuguauuuuuacuguaccuuuucuauguuuagauaugcaaauauuuacuauuguguuacaguuaccuacgguauuuagcauaguaacaugcuauacaguuuuguagccuaggagcaguaggcuauaccauauagccuagguauuuaaugggcuaugucaacuagguuuguguaaauucaguuaaugauguucgcaaaacgaugaaguugucuaacaacacauuucucagaauauauuccuguuacacaaugcaugacuguguguguguauguaaaugguaauuaaauauaguugaaauaguaucaaauauaauaccuacuguggagaauaucaucuggaagucccaggcagccuggugacaaacuauuuuuagguuaaggauuguuaaacaguauaugaaauagacuuuaaggcuguaaaccauccacccucacucuuuccucaccuuaagaacaaaccuuugauggauuugagauagugacagaucucuaauuugggaaagucuccugggaaucaaucugauguuuauuugcagagguuuaccuggaaauuuuuucuauuuucaagucuauuuuacaaagagaucuguguuucucuuugauaagaucugguugauagcgauggcuacaucacuuaacuuuuuaguuuuaaaaugacuaguuuauaaaaugacaagcagaaauuaucuuuaaggcuuuuuccaguuuuaaaauccuuuauuaguauuaagugaagggguggccugccccuccacaccuguggguauuucuaguugggugggaugagagacggagaaaagaaauaagacacagagacaaaguauaaagaaacaacaauggguccaggggacuggcacucagcacaccaaggaccugcaccggcaccggccucugaguucccucaguuuuuauugauuauuauuuucauuauuucagcaaaaaggaauguaguaggagagcagggugauaauaaggagaaggucaacaaaauacaugugagcaaaagaaucuauaucaugauuaaguucaagggaaaguacuaugccuggacgugcacguaggccagauuuauguuucucuccacccaaacaucucaguggaguaaagaauaacaaggcaauauuacugcaaacaugucuccccucccgccacagggcagcuuuucuccuaucucagaguugaacaaauguacaaucggguuuuacaccgagacauucaguucccaggggcaagcaggagacaguggccuuccuccaucucaacugcaagaggcuuuccucuuuuacuaauccaccucagcacagacccuuuacggguguagggcugggggacagucaggucuuucucaucccacgaggccauauuucagacuaucacauggggagaaaccuuggacaauacccugcuuucaagggcagaggucccugcagcuuuccacagugcauugugccccugguuuauugagacuagagaauggcaaugaccuuuaccaaguacacugcuuguaaauauuuuguuaacaaggcacguacugcacagcccuaggucccuuaaacguugauuuuauacaacacauguuuuugugagcuccaaguugagucaaaguggcugggucagaguggcuggggcaaagcuacaaauuaacaacaucucagcaaagcaauuguuuaaaguacaggucuuuuucaaaauggagucucuuacgucuuuccuuucugcauagacacagugacagucugaucucucuuucuuuucccuacaauuaagugugaauauuuuucaaauuauaugcuuguuaaauaaguguguaguugaagcagcggggucuuacagguugaagcuagagaaaacacuuuaccuggcuugguuugagguugggggacaaacuuguuugaaggcuuuuaggggagcuaugacuugacauagaucuuuuaguaugaguaagaguuaaaaauugaaagguauuuuaggcagaaaguacagcaugugauuuguuuauuuggaaacugcaaaugguuuggaacauuaacaguagaguuugagagaguuuguuaaugaucuuugagaaaacauuuguacgaaauggcaaggaccccugacuuaagucauuucugggaauugcuaaguagaacugcagaagaaaaggagguuaacaaaauuaguaaaaagagaccgggcgcgguggcucacgccuguaauccuagcacuuuggaggccgaggcaggccgaucaccugaggucaagaguucgagaccagccuggccaacuuggugaaaccucgucucuacuaacaguacaaaaauuagcugggcgugguggcaugcaccuguagucccagcuacucaggaggcugaggcaggagaaucgcuugaaccugggagguggaggucacagugagcugagacucugccucaaaaaaaaaaaaaaaaaaaacuuagagaaauagcaagguuucucagaauuugaagagccaauauacuggcaguaagaaagugagauggcuggacaugguggcucacgccuauaauccuagcauuuugggaggccaaggcgggugaaucacuugaguccaggaauuccagaccauccugggccauauggcuagaccuugucuuuacaaaaauagccagaugaggugacuuguaccuguggucccagcuaugcaggaggcugaggugggaggauuaccugugcccaggagguugaggcuacaguaagcugugauugcaccaccacacucuacccuagccuaagugacagagcgagacuccgucucaaaaaaaaaaaaaaaaaaaaaaaagagagagacaauuguuuuuuaaauuuuagagaugguguaguuucaggguaauauuuccuaaugggccagggaaggguaguaaaccauuguaguuuagaaaaacauuuucaguaauauaauagcugugauuugguuuuagucucaauauuugauguauuuugaaacuucaaauaacuuuaaagaaggagucuuuauuuauuaucuauuaguggaagacaaaaauuuaaaaaaacuugagaaacaccggaauugggaaagauagcaaagaaauggauugccaguuaaauuuaauuugcauaaaguauaauaaaaaaaaugacgaguuaauguaauggaugcagcacaccaacauggcacauguauacauauguaacaaaccugcacauugugcacauguacccuaaaacuuaaaaguauaauaaaaaaauaaaaauaaaaaacaaaaauuuaauuugcagaagagcuuuguuuaacuugcauaguguuuuuuauaauuuugaauuugaaugccaguaagcccuauguacacucagcuuuauucauauuauuaccaacaucaccccugaaggcaaaugaauuuguaaaacuuggcucaguaucuaccaagagaguaggauguuggcuggggucauguuaggaauauggaauucuucuggcauaguggcaggaaaauggcuugggagagagacugcuuagugccacaguccucaaugaauauacaagagugacacggaaguaggaaaugacagugaugaugaugagggaguauuggaauaacugaaugguaugaaucuccaaaaagggugauuuugauaugagaaugaaugaauaauauagccuguaagauucagguauugugacauuaugcuuccauauugccagaaucuuuaaagggaaguauuguucaaucccaauuuucaaucccaauuuuucuuuucauuucuagagcuaaccacuguuacuaguuugguauucuacacguguuccuuaaugguuaacauuaccauugguuagaaauguugagucuugcugggcgcaguggcucaugccuguaaugccagcacuuugggaggcugaggcagguggaucaccugaggucaggaguucgagaccagccuggccaacauggugaaaacccaucucuacuacaaauacaaaaauauuagccgggugugguggcaggcaccuguaaucccagcuacuugggaggcugaggcaggagaaucacuuaaaccugggaggcagagguugcggugagucaagauugcaccauugcacuccagccugggugacaagagcaaaacuccaucuaaaaaagaaagaaagaaauguggcucuucgcuacaguguuagauuggaaacuagucucaucaauggcuuaguuacauguuagaaaucccuucucccaauuucugccuauacagaauuccauucauguuuccuuuccuuuuuuuauuguuugccugccuuacuaaucuugccucauuuacuccaguucuuuuuauaguugcccacauauuuagguugaaccauaugaaauuaguguuuuaaaaguacuuuggacauagggaauuacauauuuccauauucuuauauuggugugggugaaaccaaaaccccagaaaguuacacagaucauaaucaccuuacuccauagggccucaaaaaaggcuuuuuuuacaguguggaaauggaugauuuacaguauguuuaaaguguguaacuauuaccauaaucuaauauucuaacauuucuaucauuggaaaaaguucucucuugccuguucauucauggucaauccuuguuuccauccccagcuccaugcaaccaccaguuuuucuauuuuuguagucuuuucuuuacuagaaauuucauauaaauggaaucauaaaauaucuugacuuaugucucuggcuuucuuuuacuuaccauaauauuuuugagguccauccauauuguuucauaugucaguaauucauuuuaaaaauuguugagcaguauuccauuguaugguuauaguaccaccuuuuauuuaucuguucacuagcugcucaacauuugaguuguuuccaguuuuuggcagugaacauucacuuacaagucuuugugcggacauguuuuuauuuuuguuggguagacaccuaggaauggaauuucuggguguguuaacuuuuuaaguaguugucaaacuguucuccaaagugguuggaaacaguuuaacauuuuuacugguaagguaugaugguucuuuuuuuuuuuuuuuugagacagagucucgcucuguugcccaugcuggagugcaguggcgcgauuucagcucacugcaagcuccgccucccggguucacgccauucugcuaccucagccucccgaguagcuggaacuacaggcgcccaccaccacgcccggcuaauuuuuuguauuuuuaguagagacgggguuucaccguguuagccaggauggucucgaucuccugaccucgugauccgccugccucggccucccaaagugcugggacuacaggcaugagccacugcaccaggcccugguaugaugguucuaauucugccacauacuuacugaaacuugauauugcuggucuuuuuucuuagucauuuuagcaggaguguagugguuucuuacugugguuuuaaaaauuuuuuuauuucuuguugagguaaaauauaugucuauaauuuaccaucuuugccauuuuuaaguguacaguucagugguaauaaauacaugaauauuauuuucuuuccccuucauacaucccauucuuuccuggccucugguagccaccagucuacucucuaucuucaugagaucuacuguuuuagcuaccaaauacaugugaaaguugucuuucugugcuuggcuuauaucacuuagcauaauggccucagguuccauccauguugcugcaaauuacaggauuucauucuuuucaauggcugaauaauauuccguuauguauauaaaccauguuuuuaaaauccauucauccauugauggguacuuagguugaguccauaucuugacuauuguguacaaugcugcaauaaacaugggaaugcagauguuucuuggcuauauugauuuccuuucuuuuggauauauauauauauguaucuaauaguggaauugcuggaucauaugguaguucuuuuuuuuaaaaaaaaauuauguuuaaaauaaucccaaaggauuauaaaucauucuauaaagacacaugcacacauguuuauugcggcacuauucacaauagcaaagacuaggacccaacccaaaugcccaccagugauagacuggauaaagaaaauguggcacauauauacccuggaauacuaggcauguagacaugaauucauguccuuuguggggacauggaugaagcuggaaaccaucauucucagcaaacuaacacaggaacagaaaaccaaacaccacauguucucacucauaagugggaguugaacaauaagaacacauggacacaggggaacaucacacaccggggccucuugggggauggggggcaaggggagggauagcauuagggcaaauaccuaaugcaugcggggcuuaaaaccuagaugacagguugauuggugcagcaaaccaccauggcacauguauaccuauguaacaaaucugcacguucugcacauguagcccagaacuuaaaguauaauaauuaaaaaaaaauuuuuuuguggguacauaguacauauauguauuuauuggguacaugggauauuuugauacuggcaugcaauaguguaauacucaggucauggaaaaugggguauccauccccucaagcauuuauccuuuguguugcaaacaauccaauuauacucuuuuauaauguacaauaauaaauguacaauuaaauuauggacuauagucaccuuauugugcuaucaaacacuaggucuuauucuuucuauuuuuuuuuguacucauuaaccauccccaccuucuccuaacacccccaccacccucauaugguaguucuauuuuuaguuuuuugaagaaccuccauacuguucucugguaguucuauuuuuaguuuuuugaagaaccuccauacuguucuccauaguggcuauaauuauuuacauuuccagcaacagugugugagaguuccccuuuguccacaucuuugcuugcauuuguuauugugugccauucugauacaaacuauuuuaacuggagugcgaugauacugcauugugauuuugauuugcauuucucuggugauuugugauguugaacauuuuuucauauacuuguuggucauuuguauguuuucuuuuaagaaauauccauucagaucuuuugcccauuguaaaaucagauuauuuauuuuugguuuuuugcuuuugaguuguuugagcuccuuacauauucugguuauuaaucucuugucagauggauaguuugcaaauauagucucccauucuaugaguuggcucuuuuguuuguuuuguggaaguguuuuagcuuacuguaaucucaauugucuauuuuugcuuugguugucuguacuuuuuuuuucuuuuuuuucaauuauacuuuaaguucuaggguacaugugcaugucgugcagguuuguuacauagguauacaugugccauguuggugugcugcaccgguuaacuugucauuuacauuagguauaucucuaaugcuaucccuccccccucccccaccccacaauaggcccuggugugugauguuccccaccuuguguccaaguguucucauuguucaauucccaccaaugagugagaacaugcaguguuugguuuucuguccuugcgauaguuugcucagaaugaugguuuccagcuucauccaugucccuacaaaggacaugaacucauccuuuuuuauggcugcauaguauuccaugguguauaugugccacauuuuuuuuauccagucuauuauugauggacaucuggguugguuccaagucuuugcuauugugaauaaugccacaauaaacauaagugugcaugugucuuuauagcagcauguuuuauaauccuuuggguauauacccaguaaugggauggcugggucaaaugguauuucuaguucuagauccuugagaaaucaccacacugucuuucacaaugguugaacuaguuuacagucccaccaacaguguaaaaguauuccuguuucucuacauccucuccagcaucuguuguuuccugacuuuuuaaugaucgccauucuaacuggugugagaugguaucuuacugugguuuugauuugcauuucucugaugaccagucaugaugagcauuuuuucaugugucuguugggugcauaaaugucuucuuuugagaagugucuguucauauccuuugcccacuuuuugaugggguugauuuuuucuuguaaauuuguuuaaguucuuuguagauucuggauauuagcccuuugucagauggguagauuguaaaaauuuucucccauucuguagguugccuuuucacuuuucccauucuguagguuguaguuucuuuugcugugcagaagcucuuuaguuuaauuagaucccauuugucaauuuuggcuuuuguugccguugcuuuugguguuuuagucaugaagucccugcccaugccuauguccugaaugguauugccuagguuuucuucuaggguuuuuaugguuuuaggucuaacauuuaagucuuuaaauccaucuugaauuaauuuuuguauaagguguaaggaagggagucuugcucuguugcccaggcuggagugcaguggcgcgaucucggcucacugcaagcuccgccuccuggguucaugccauucuccugccccagccuccacgcccggcuaauuuuuuuguauuuuuuuaguggagaugggguuucgcuguguuagccaggauggucucgaucuccugaccucaugauccacccaccucggccucccaaaguguugggauuacaggcgugagccacugugcccggccuugucugugcuuuugaggccuuacacacaaaaaaaaauuggcccagaccaguguccugaagaguuuccccaauguuuaauuugagguuguauauuuaaguuuuuaaucaguuuugauuuaauuuuuguguauugugagagauuggggucuaguuucauuucauucuuccacauaguuaauccagcuuucccagcagcauuuauuaaaaagacuauccuuuccccaaaauauguucucggcaccuuugucaaagaugaguuggucauaaaugcauggacuuauaugugggucuguauuauguuccauuggucuaugugucuauauuuaugccaguaccaugcuguuuggguuacuauagcuguguaguguauuuugaagucagguaaugugaugcuuccagcuuuguucuuuuugcuuaggauuacuuugcuauuuggagucuuuugugguuucauauaaaguuuaguauuauuuuuucuauuucucugaagaaugucguugguauuuugauaaggauugcauggaaucucaaaauugcuuuggguaguguugucauuuuaacaacauuaauucuuccaguacgugagcauggaauaccuuuccauuuuuuggugaccucuucuauuuuuuucaucagaguuuuauggucuuccuugccuagaucuuucacuucuuugguuagauugauuccuaguuuguuuuguuuuguuuuguuuuuuguaaccauuguaaaugggauugcuuuuuugauuucuuuuucagauuguucuuugacauauauaaauguuauugacauuuguauguugauuuuuguauccugcaacuuuacugaauuuuuuuuaccacuucuaauaguuuuuugguggaguauuuaggguuuuuuugauguaagaucaugucaucugagaacaaggcuaauaugacuucuuccuuuccaauuuggauacucuuuaucucuuugucuugcuuaauugcuguggccaggacuuccaauauuauguugaauaauagugggaaagugggcaucaucaucuuguuccagucuuuagaggaaaggccuucaauuuuucccuguuggcuuuuauuauuuugaaguaugucccuccuauaccuguuuugaugaggguuuuuuugguuguuguuguuguuauaaagggauguugaauuuuauugaaugcuuuucuggcauccauugaaauaaucauaugguuuuuguucuugauucuguuaaugucauguaucaugucuauugauacauauauguugaaucauucuugcaucucugggaugaaucccacuugaucaugacaagugaucuuuuuaauguguuguugaauucaguuugcuggauuuuugcaucuauguucauauuauaucaauauaucaaaguguauuggccuguaguuuucuuuuuuuguugguuccuuguaugguuuugguaucaggguaaugcuggccucuuuggaugaguuuggaagcauucccuccuuuucaguauuuuugaagaguuugaguaagguugguauuaguuuucuugaaauguuugguaguauacagcagugaauccaucaggucuugggcacuucuuugaugggaaacuuuuuauuauggcuuugaucuuguuacuuaugauugguuuguugagguuuucuauuucuucauggcucaaucaugguagguugucuguguccaggaaucuaaccauuuuuucuagguuuuucaauuaguuuugcauauaguaguuuauaauauuauuuaaugauucuuuguauuucuaagguuucaguuauaucuccuuuuucauuucuuauuuuuuuauuuggaucucucuuucuuagucuagcuaagguuuguugauuuuguuuaucuuuucaaaaaaucaguuuuucauuucauugaucuucugugguuuuuguuuuugguuuuuugagacagagucucacucugucacccagucuggaguacaguggcgugaucacagcucaccgcagccuugaccuccuaugcucaagugauccucccaccucagcccuucaaguagcugggacuauaggcacgugccaccacaucugacuaauuauugcauuuuuuguagagaugggguuucaccauguugcccaggcuggucuugaacuccuggacucaagugaucugccugccuuggccucccaaagugcuaggauuacagguaugagccaccgugccuggccucuucuguauuuuuuuaaauuccaauuucauuuauuucugcuucgaucuuuauuucucuucuucugcuaauuuucgguuugguuuauucuugauuuuuuuuuuuuuuuuuuuuugacggagucucgcuuugucacccaggcuggagugcaauggcgugaucucggccacugcaaccuccaccucccggguugaagcaauucucccaccucagccucccgaguagcugggacuacaggugucugccaccaugccuggcuaauuuuuguauuuuuaguagaaaugggguuucaccauguuggccagacugcucucaaacuccugaccucaagugauccuccuaucguggccucccaaagugcugggauuacaggcaugagccaccgugcccagccuauucuugauuuucuaguucuucaaggugcaucauuagauuauuugaacucuuucuacuuuucuaauaugggaauuuauugcuauaaccuucccucucaguacuacuuuugcucugucucauagauuuugguauguuauauucccauguucauuuguuucaauaaauuuuuaaauuuucuucuuaauuucuucauugacccauuggugauugaagaguauguuacuuaauuuccaugugucuguguauuuuccaaauuccuuuuauuauugauuucuaguuuuauuccauauggucagaaaagauacuugugauuuguauuuuucugaauuuguuuagacuuguuuuguagccuaagauauggucuguucuggaaaauguuucaugugcuggugaaaagaauguauauucuguagcaauagggugaaauguucuauaaaugucaguuaggccuauuagaucuagugcguaguuuaauuuuacucuuucuuuguugauuuucugucuagaugauuugucuauuacuagaguggcauguuaaaguccccuacuauuauuguauuguaguuuaucuaugaaccuaacacuggagccuucauguauauaaagcaagcauuaacuuuauauacuugggggcuccaguguuggguucauagauauucauaauuguuauaucuucuugcugaauugccaccuuuaucauuauauagugacccucuuugucuuuuuuuagucuuugauuuguagucuauuuuaucugauauaagaauagauacuccugaucuuuuuuaguuuucaguuacguggaauaucuuucagucucagucuauguguaucuuuauaagugaaauggauuccuugaaggcagcauauaguugggucuuauuucuuuauccauuaagccacacuaugcuucuuaauuggacaauugagaccauuuacauucagugugauuguaaauaaguauggacuuacugcaaccauuuuauugcuuguuuucuccuuguuuugagaauucucuuuuccuuuuuuuguuucuuauugucuuccuuuguaguuaagugauuaucucugguaguauauuuuaauuuauugauguuuauuuuuagugaauauauuauagguuucauacuaucauuaccaugauucuugcaaaaaacaucuuauaaauauaacaaauuauugcaguccagccugggcaauagagcgagacuccgucucaaaaaaaagaaauauauauauauauauauauauauacacauacauacauacauauauauauauauauaacaaauuauuuuaaagagaugacacuuauuuuagaucacagacaaaagaauggaaacaaaggcaaaaaaaaauucuacacuuuagcuucuucucccaacauuuucacuuuuaguugucaacugauauauuuuuauauuaccuauuucauuuucacuuuuaguugucaacugauauauuuuuauauuaccuauuucuuaacagguugcuauaguuauuauuguuuuugauaaacuugucuuggaggcuucacacuagagauaugaauggauuguacaccacagauacaguaauagauuauucuguguuugucuguauacuuaauuuuaccaaugguuuuuauaccuugaacauuuuuucuuugcacacugguauuuuguauuuucuuccagauugaagaacuccauuuagcauuuuuugcaagguggaucugguagugaugaauugucucagcuuucauuugucugggaaagacuuuaucucuacuucuuauuuaaauaacaauuuuuucuggauacaaaacacuuggauggcagggcuuuuuuuucccuuugggcacuuugaaaaugccauuccacucccuucugccugcaugguuucauugagaagucuguuuccagaugaauuggggcuucuuuauauguuauuugcuucuuuucuguagcugauuuuaggguauucucuuugucauugaccuuugugaguuugauuauuauaugucuuguauagauugaaucuguuugguggucuaagaccuuccuguacguggauauuuauaucuuucucaaguuuuggaaaguuuucuguuguuauuucuuugaauaaguuauuuaucccuuguucuugcucugcucccucuuaaacacaggaauucuuacauuuggucuuuugagguacucuuuuauaucuuauaggcagucuuuguuccuuuuuguucuuuugucuuuuuucuccgcugaauguguauuuucaaacagcugaucuucaagcagaauuucuauacaucaacauuguucaagcugagggccaaaucaagaaugcagucccauuuacaauagcugcaaaaagaauaaaauauguaagaauacagcuaacucaggagguaaaaaaaaaucucuacaaugagaacuacaaaacauuacugaagaaaaucagagacaauacaaacaaauggagaaacaguccaugcucauggauaggaagaauuaauaguguuaaaauggccauacuacccaaagcaauuuacagauucaaugcuauucucgucaaacuaccaacaucauuuuucacagacuuagaaaaaacuauuuuaaaauucauauggaaccaaaaaaggacugaaaaguuaaagcaaucuuaagcaaaaagaacaaagucagagucaucacauuaccugacuucaaacuauaccacaaggcuacuguaaccaaaacaacaugguacaacacaaaaacagacauauagaccgauggaacagaauagagaauccagaaauaaagcugcacccccaccaugugaucuuugacaaaguaaacaaaaauaagcaaugaggaaaaaggcuuccuguucaauaaauagucuuagaauaacuggcuauccagaugcagaagaaugaaacuggaccccuaccuaucaccauauaaaaaaauuaacucaagguggauuaaaguccucaaaaguaauuucaacaaaaacaaaaauugacaagugggaccuaauuaaacugaagagcuucuacacaacaaaagaaacuauaaagggaauaaacagaugaucuauagaaugagagaaaauaucugcaaaguaugcaucugacaaagaccuaauauccacaaccuauaaagaacuuaaauaaccccauuaaaaagugggcaaaggacaugaacacuuuucaaaagaagacauacauguggccaacaagcauaugaaaaaaaggcucaauaucacugaucauuagggaaaugcaaaucaaaucuacaaugagaugccaucucauaccagucagaaugucuauuaagaaguaaaaaaaaaaacagaugcuggcaagguuauggagaaaaaggaacgcuuaugugucuauauuuacaucaauauaacucuguacugauuacuaucgcuuuauaguaaguuuuaaaaucaauuacuaugugaugguuaauacugaaugucaacucgauuggauugaaggguacaaaguauugauccugggugugucugugaggguguugccaaaggagauuaacauuugagucaguggacugggaaaggcagacccacccuuaaucugggugggcacaaucuaauaagcugccaguguggcuagaauauaagcaggcagaaaaaugugaaaagagacuggccuagccucccagccuacaucuuuuuuuuuuuuuucuuuuuuuuugagauggagucucacugugucacccagacuggaguguaguguugcgaucucagcucacugcaacuuccacauccuggguucaagccaucuuccugccucauccuccuggguagauaggacuacaggcauguaccaccaugccuggcuaauuuuuguauuuuuaguauggccaggcuggucucaaacuccugaucucaggugauucacccaccucggccucccaaagugcugggauuacaggugugagcuaccaugccuggccccagccuacauuuucccccaugcuggaugcccucaaacacuggacuccaaguucuucaguuucggaacucagacuagcucuccuugcuccucagccugcagacggccuauugagggaccuugugaucaugugagguaauacuuaauaaacucuccuuuauauauaucuauuccauuaguucugucccucuagagaacucuaauacacacaguaaguccuccauuuuaaaaucuuuuucuugaaaauuucauauauuguauguccuuuaaauuuccaaauaaaguuugaaaucaguugucaauuuuuacaaaaacaucugcuuagauuuuugagagagauuguguugaaucauuuaggcagaaaugccaucuuaaaaauauugaauuauccaaccauugaacaugguauaucucuccauuuaauagguuucauuuaauuucucucagcaauauuuuguaauccccaguguacaggucuugugcuucuuuauuuuuacuguuuauuccuaaguauuuuauacuuuuugauacuauuguacaugaauuauuuucuuaaauuuuauuuucacuguucauagcuaacuuuaaaaguucaaagcuaacuuaaaaagauguuuagaucuuucccauuuuuaaauuaguugcuuucuuaugguugaguuuuuaaaauauuuaaauaguccuuuguccaguaugucuuuugcaaauauuuucucccagucugugguuugccuucucauucuuaugauccacagaguauuuuaaaacuugcuguuuuacuuucacauaucagggaguuuccuagauuuccuuuuuuuggugauuucuacuuuaauucuguugugguuagagauuauacuuuauuuuuaaugauaucuuuguuaagauaucuuuauauauaaauauauuauauauaaauaaauuauauaucuuuauauaucauaucauuuauauaucauaaguguacauuucagcucuuaggauauucacaaaguugugcaucacuucaaaaagaaacccuauauucauuagcagucacucucccagcugguggcaacuacuaaaucuacuuucugucccuacggauguaccuguucuggauauuucauaugaaugacaucuuuugcuuaauggauaucugcauaucuuuauuagauauaugucuguucaaauuguuuucuuaguuuuuaauugguuaucugauuuuuuuauugaugaauuguguguguauguuuuuuuuuuaacuuuucugaugguauccuuugaagaauaaaaguuuaaaauuuugauggaguccauuugaucuucuuuuuucuucuuuuggucauuugcauauuggugucauagcuaagaagccauugcuuaauuuggagaaugugcuuuguaugauuuuaugccuuuuuaauguauuaagaggguccauggcucagcauagggucuaaaauggaaauguucuauguacucuugaaauaauauacauucugcuguuuuagggaaauguucuauaaauuucaguuuggucauauuguuucauaguguuguuuaaauauuacauaucgcuacugguuuucuaucaauuucuggcaagagaguauuaagauuucuaacaauugcuccauuaucuuuuucugugucaguuuuugcuuuguauauuuucaggcucuguuguuaggugcauauacauuuauaauugcuauguauuccuucugcuauuaguuuauccauucuaccucucucaugguuacugauuacauggcacuuuuuccaacccuuuauuuucaauaugcuuguuuuucuuaauuuaaauagucuuuuuuggacaguguacuauuggaucuugcuuuuuaucuacuuugacaguuuuugccuuuugauugaaguguuuaguucacucacauguaauguaauuuuugguaugacagauuuauguuuuuuauuuugccauuugcuuucuguauuucucaugucucuuuguuguuguuccucuguuccuccuuugcuguuuucuuuguguuaaaaaaguauaccuuucuauuuccucuguguuuuuuaacuauuuaagaauuuuuucuuuuagagauaauaguauuuaucuuuaguguauuacaaucuauuucaaguugauaucgacuuaaaacguaacaacuuugcuuucccauuuucuuugugcuauuauuuucacauauauuacaucuaaauauguuauaaacacaauaaugcaguauuauaauuauuccuuuaaauaaucuuacauucuuagaaaugcaagaaaaaauauucauauauagucuuuuauauuuauccacauaauuacuauuucugugccucuucauuuuuucuuguggauuccaguuaccguuuccuuucagcuuuagcauucucaguauggcaagucuacuaucugaaaauucuguuaguauuuaucugggaaaauuuuuauuucaccuucacuuuuugaacuuuaaugagauagaauucacauaccauauaauucacccauuuaaaauauauaauuuguugguuuuucauauaucuauagguauguaaaugaucaccacagucaauuuuaaaacauuuuuaucaccuuauaaagaacccucauacccuuugcucuuuuuugucacuguuuuaagguagaaagucauguuacugauuugagaucuuucuucuuucuauuuuuaaaacauuuuuauuuuugaaauggggucuuucaguguugcgcaggcuggucuugaacuacuggccucaagcagucuucccaccucagccuccaaaagcauugggauuauagccaugagccacugugccuggccucuucuuucuuaauauagguauuuauaucuauaaauuuuccucuaagcacugcuuuagcugaaccccauaauuuguuauauguugcgucuucauuuucuuucaucucaguuuuuuauuuuccuucugauuuauuaaacccaucaauuauuuaagaguguguuguuaauuuccacauauuuguggguuuuuuaaauaacuuucuuguuauugauuucuaauuuauuccauugugguuggagaacauacuucguguuauuucuguccuuuuaaauuuauugacuuuuuuucccuuauggcauagcauauggucuaaucuggagaauguuuuauguagacuugagaagaguauauaaucugccuuuguuugauagaguguucuguagaugucuguuacgucuaguucauuuauaauguuguuuaagucuucuauuuccuuguugaucuuuugccucauuguucucuccauuauugaagguaggauauuaaagucuucaacuguuguuguucauuaucuguuucuccauuucugucuguuuuuucuucauguauuuuggugcucuguuguuaguuguauauauauuuauagauguuguauguuccuuuuuuuuuuuuuuuuuuuuuugagacagagucucacucugucacccaggcuggaaugcaguggugcaaucuuggcuacuguaaccucugccuccuggguucaagugauucuuuugccucagccuccugaguuacugggacuacaggcaugcaccaccacgucuggcuaauuuuugucuuuuuaguagagaugggguuucacuauguuggccaggcuggucuugaacuccugaccucaaguaauccgcccgccucagccucccaaauugcuaggaauacaggcgugagccgcugugcccagccauauacauguuauaucuuccugauggauugacccuguuauucuuagaagguauuccucuuuaguaacuuuuuaaagucugauauuaccauagccacuaaaauuuuccuguuguugcuguuugcaguauacaucuuuuuccagcuuuuaauuuuaaucuauuuguguccuucaaucuaaagucugucuucuguagacaacauauaauugaauuuuuaaaaaaucuagucugacagcugcugccuuuugauuggauuaagcuguucacauuuaauguuauugauaguuggauuuaugccuuccauuuuacuuguuguuuucugugucugcuuuuuguuucuuauguguuucaugucuuuuuuguuucucuguuucuucauuagugcugucuuuugcauugaguauauuuucuaauaugauuuauaagacuguuugcauuguuagaauaccugaggcuacauaguuuauaaagaaaagagguuuauuuggcuuauuguucugcagguuguacaagaaacauagugccagcaucugcuucuguuaaggaccuuaggaagccuccaaucauggcagaaggcuaagggagagcaaagaugucacauaguaagggaaaaagagcaagagagagagaagguggugccagguucuuuuuaaaaaucagauauugugggaaugaauacagcaagaacucacuuauuacugcaaggauggcaccaagcugaucaugagggauccaccuccaugacccaaacaucuccaacaaggccccaccuccaacauugaggaucaaauuucaacaugagguuuggagggaacaaauuccaaacuauaucauguagcauuuuuauuaauuauuuuuucacugaauuuuuugaguucuuuuuuugacugguuucucuaggacuugucauauauauuguaacuugucaaagucagugucagauuuuuuguuuguuuguuugguagagaugggguuuugccacguugcccaggcuggucucgaacuccuggacucaagcaguccccccgccagccuuccaaagugcuaggauuacaggcgugagccacugugcccagcagcuugagauuuauaccagcuuaaugccaauaacauaugaaaauguuacuccuauacaucuguauuuccuuucucguaaugauauuuuuguuauacauauucuaucuauuaauauuacuaacccaagaaaauauuguuauaauuauuacuuuaccaucucuaggcauuuccuuaacucauuacaacuuuggccccaccuaccuacuauaugcuguuauuggaaaauauuuacaccaaauguaaauagaaauauauuacauuucuauguuauaggccaaacauuacuuucuauucuauaaauauuauucuauauaauugcuuuuuaaaucacuugcuuucagccugaugaacuugcuuuuauauuuauuguaaggcaguucugguagcaauauauuuugugaguuuuuguuuaucuagugaaguuuuuauuuuuccuuuauuuuugaacauucacuuugcuggauuuaggauuuaugauuaacaauuuuuaaauuucuuugaguacuuugaguauguucucucacugccuucuggcaucuguuucuacugagaagucagcuguuaauauuauuuggguucccuuguaagugaccugauauuuuucucuuguugcuuccgagauuuugucuuugacuuucagcauuuuuacuaugauguuucuguuugugggucucuuugcauuuauccuacuuggaguuuuuuuagcuuccuggauguguugguuguuuuucaagaaauuugggaaguuguuagcuauuauuucuuugaauauuuuucuuuuccuuuuucuuuucuucuuacaguacuuccauuaugaguauguugguaugcuuaaugguguuccgcaucucucuuaggcucuguucauuuuucuuaauuauuucuucucuuuguucuucagcuugcauaaucuguauugauauaucuucaaguuugcuaauucuuucuucugccauuucacagcuacuguugagcccuguauuaguuuucuggggcucccauaaugagguaccacaaaguagcuuaaaaaacaaauuuuguggcugggcgccguggcucacucuuguaaucccagcacuucaagaggcuaaggcgggugaaucaccugagaucaggaguucaagaccagccuggcuaauauggugaaacuaaaaauacaaaaaaauuagccaggcaugguggcgcacaccuguagucccagcuacucaagaggcugaggcaggagaaucgcuugaacccaggaggcggaggcugcagugagcugagaucgugccacuguacuccagccugggugacagagugagacuccaucucaaaaaaaaacccaaauuuuguuuuguuuuguuuuacaguuugggaaccuagaagucagaaaugaagauauuggcaagguugacuucuuaugagggucgugaaggaaggaucuguucuaggccucucuccuuuguuguaguuggccaucuucauguucacaugacauucucccuguuugcgugccugucuccacauuucccucuuuuauaaagacacuagucauauuagauuuagaccuaccuugagguuuucauuguaccuuaauuuccuuuuuaaagacuccaucuccaaauaaaguuauauuuugauguacugguagacagaacuucagcauaugaaauuuggagggauacaauucaacccauagcaagccucucuagugaauuucuaauuucagucauuguacuuuuuaauuccauaauuuccauuauagucuuuuuuuuugagauggagucucgcuguguugcccaugcuggagugcaguagcgcaaucucagcucacugcaaccuucaccuccuggguucaagcaauucuccugccccaggaaaaaaaaucugugugcagaauaaccagaugucagauuuaagagaaaaagauuucaaacuagccauuauaaauaugcucacaguacuaaaaggacagcaugauugcggaaguaaagcaggguaagaggacaaugucaugucaaauagagaauauccauaaagggagaaauaaugaaaaggaauacaggccggaugcaguggcuuaugccuguaucccagcauccugacaucuggucacucugcaggcaguuuuuuuuuuuuuuuccuuuaggggguaugggucauacuuuucccauuucuuugcaugucccuuaauuuuuugguuggaaacugggcauucuagauaauaugguagcaaacucugugugcuaguccccacccacccucuuuccuggggcuuguuauuguuauuuauuuguuuaguuuuuuaguaauggauuggauuauuuuaaugaagucuauccccgccccccucucccccauagugguaaaccucuaauguugcuccucagggaggcaccuuuuccuugaacaucuaguauuuguuuguuugaaaacuggacaguuuuguauguauuauagcaacucugcauacuuuuuuccuguuuuguuguuuuuuauauuuuuuacauuacuugccuagccuacagaauuugucuccuuguguuguacauuuauugaugucugugcuuuguuuguguuuuagucucauuuucauuguuuagguuugauuccuaaggacucuuuuuagugucuacauaugucagccaaagauuugggcugagguucugcuaaugcaccuucagcccauaaaguuuguacuaucugcuaaucaaucuguggguuaguuggggaaugcauuugaaguugugggcauuuauuaauuuuuccuuggucuuuucuuuuuaccaacucucugauguuccccacacauauguaauuuucuagucagccaggaauuuguggagaacuuaugugaauccauuuauggcuuucuuauuuccaagcucucccuguuaaguuucugguugguccacugcuugccucaacuugguuugcaaccucagucuugcaaaacugcaaguuuucucuauccauguccaccaaguccauuacuuucagccaguagagcuauaggcuuuugccucucauugaauugauuuuggcacccuggcaugaaacuacaaguauaccagcuacaggauggcaaaacuacaaaccucauugacugaacugggggcaggggugauggaggcaguucuaggcaaggcuauuccugccugaagcacuggcaguuuuucaacaaucaacaauucucaauaaacaguuuccaguggccugaaaugguuggucuuuuuggauaauuuuguucaguuuuauguauuuuuuuuuuguggaggggaauuacugaccucuucauacuguuauuauuuuaaugguguuuugaguaccaaaauugauagaucuuaugaaagaaguggcuucauuauucgucagauuauaucaaaugcuuuccacacaauggugcuucauuauaagucuaauacaaaugguuaccaaucuuuucauuccaccauuauuggaaguuacucuugcugugcauuuugugauuaauccuuacuauaucuugagacaugauaaaguagguuaauacaaaagccuauuuuugaaacagugugauaaaauuaauuaauguagacauuguuggaaauggauaaguugcacaauuacauauuauuuuuuucucaguuuuuugacaguguaguauagguaaauaugucuucagaaauccuuaauauacuuauuaauuaacuagaucauaacugaauuucauaaauauuguuuucuuaaaaaugcauuauaugggauuacuuuuguaucuaaguaagacauuaaaccuauaagcuaaauaaggacuauaucaauaaacuuguuuaaaugaagauuuggaauuuccguauagaaaaauucauuacaacaaaguagaaagauaaacaacaaacuggauuaaaaguauuuaagucgccuguaaucccagcacuuugggaggccgagguggguggaucacuugagccuaggaguucaagaccagccugggcaauauggcaaaaccccgucuuuacuaaaaauacaaaaauuagccaggugugguggcacgcaccuguaaucccagcuacuuaggaggcugaggcaggagcauugcuugaacccaggaggcggaggcugcagugagcaaaaguugcgcugcugcacuccagccugguuaacugaaugagagugucucaaaaaaaaaaaguauuugaaucacuuuugauuggacaguaggcuaauuucuuugauauguagaaaucuuacaaauugacuaaaagcaggauaaauaaucauuacaaaaaaugggccaaagaauaugaacaggcaaguuacagaggaagaaguauaaaugaauauuaaacaugaaaagaugcucaggcaucuaaagaaauucauuuuaaaccaccuauaaaauccuauuuucuguuagauugaaauaguaauacccaguauuaaugaagcugauggagaaaaugagcucuccuuguuauuauugcuuuggaaacaucuaucagaauuuaaaauacaaaugccauauucccuagaaauugaaaguacacaaaagauaugcaaacugaagaauauucauugcugcauuuuuuauagcagaaaaaaauuagaagccaccuaaauguucauuaauggagagcuuauagaccuccguccaguuguaugagaugaaucuguauaugguaacacagaaagagauucaugauauguuacacuuuuuaaaaagcaagcuguuccuuuauuaugucugauuauguucgugugugaguagaaaauaucagggaggacaugcacaauucucuguaaaaugacgaguuuugaggauugcaguugggaggugaugggaggacauggaugagggaguaucauguuuccaaauugcuuaccuuauguuuuauaauaagcauguauuuaaauuuauauuaaaagaaaaauauaauaucuacuaaauuuguaaauuaagaauuauauuaauaaaugaacuauagcaaauuuuucugguuuguuuucuauuuagguauggaaauuugaauauuaauuuauagauggcaaagggagugcuuuuuuacauuacagacugugcauaaguaaaugauuucacucuuaagauuugaaacaucuuucaaacucauaaccugaaugaaugaaaaauguauuauauauauugagcauauuaaaauauuuuuauggucugggcgcgguggcucacgccuguaaucccagcacuuugggaggccgagguggcuggaucacaaggucaggagaucgagacgauccuggccaacauggugaaaccccgucucuacuaaaaauacaaaaauuagccaggcgugguggcacaugccuguaaucccagcuacuugggaggcugaggcaggagaaucacuugaaccagggagucggagguugcggugagccgagaucgugccauugcacuccggucuggugacagagugagacuccaucucaaaaaaaaaagaaaaaaaaaguauuuuuauuacugagagagaaagaaaagauuuauuagucaucaaauccacaucauauuaaaaauuuauguuauuagcauauuuuauuuaaaauuauguuggguucaaaccaggcacaguggcucacaccuguaaucccagcacuuugggaggccaagaugggaggauaacuugaggccaggagcuuaagacuagcugggccacauagcaugacccugucucuauaaaaauuuuaaaaauuagccugguguaguggcaugcaccuguaaucacaaggcugaagugggaggaucccuuggcccagguguucgagacuaaggcaagcugugaucacuccacugcacucuggccugggugacagagcgagacccugucuuuuaaguuaaaaaaaaguugguccagaaauaugaauuuaauuaaacuggauuaaacaaaaaucuuuauauuauaccaaaggcauuuugaaucuaugaaaagagacaguaaaaaaauuuucuaaaaagcaauagauagcaagguuuuucaauauuuauaucucaaaauauuuguuuuaagucuuuuuauggagguuaucuuguaauaaauauaucuguaguuuuucuuuuaauuuuauaauauuuuaaguauacauuuaugaaaauuauagauuaaaauacgaauuauauguguauaaguuuauuuuacauuauggaauccaauuuuaucacagguuucgucuugauauauaucgauguuuggccaguccagcucuaauaauguuaacagaggaggauccaauucugagagcauuugaacuuagugcugauuuaaaagaacuaagucuuguggagguggaauucaggugggaaugaaugcaaauuauauaauguauuuuguuuuaaaucuucaaccucaguuucuucauuacccaaauuauaauuuguauauauuuacauuugauccaagaacacuacaccuuguugccacuuacuuggcaacagaccccugcucucccucaaaggaacagacccuggugcuacuuaagucauuccuuccccaucugcccucugccacccuauaaacaccuuuaaucucuuccccacuuuucaaccuaaccaaaggcauuguagagcaguaugaaauacaguaggauuauagccuaaagcaggagcaaauuuauucauaguugcucucucucucacacauaucuccucauucucugacucuauaaucauccuugaguaaugauccuucagaucuuucaaaagcauauggaaugcuuucuguaugucaaggacauuccacacacagacauagucccuuuucacuauuugcucagauuuucugguaagagaaauaauauauguaauacauguaaacauaaaaauaaaauacaacuaauuaagagggaugaacacccagucugaguucucuucugaaaugaagauuaaauguaauuuuggcacuuggcauaccaaagaagcacuccuauuauuuuccuuuagggggguaaguugaaaaaaaaaaagacuuuguaauagcagccuaugaaacuacuaauuuaaauauuguuuuuaaaaaaauccuuagaaaacuacuuuuauuaauaguagaguugagagaaagcguugagauuuuccuuuauggaaaaguaucccuguugcccucuaaagaaggaggaauugauuacgauuuuuuacuagccccuguugcaagguuucuacuggggaucuauaacuauuccuaccuuuucuuuccuauacggcugcuauuagagccccaugucuugugugacacucuuucagugacuugacaaaauugggaaaguucaaauuucuacuuccuggaagggcaguaagaaacuuggaguuuucuuuagcuuuaacagcaguacuuaauguguucuucauagaccugaguuccagaaacugaaaaaagaccuguuuauauuuucaaguuuggaacuacugucuuguaacuuggauaauuuaaauuuuguuuaaacuugauaugacaugaaguauguacuuuacuuugaugaacacacaaaacaugguucaaauguaacuuguugcuacuuuuaacuuuauuagcacaugaggcuguuaaauuauucuguuuaaauaugaaaaacuuccuauuguaaccucauaauuugagucugaguuauauaaaauaaaacuuacucaacuccuuucaaacaggauuugaagaaacugcuaugauuauauaaucauaaaauaauaaaguuagauuuggaagcgaucauagaaacccauuuacuucaauccaguguuuuauagacaggggaggagauuuauaaaggcuagauuuuuacuaauagcagcaucuaauuaggaauagaguuaaaacuaaaaguaggagcaaaguuauaacuagaauauaugacuccuugcuucugguuuucuauauuuccaucuaaacuauacagccacuuauuugucuucaguaaucuauuagaaaugaauuagauuaauaagauguauaaauuucaccuuugaaucucguaguccaucaaauguuuauccaaagauggaauauuuuuguaauaauauauacuucugauaaacauuccagucugcaguuagauuccuaaaucaagaagcagggagugccgcauuuguuaaauaaauccaauuacuuauuuucaggaguuuugacuacauagaauguauaaagaaugaugagagaaauuaaggcaaagaaguuuuuauucuuaaguuaugauuuuuauauagccaguuccuggaaagccccauuauauagaaagacuaaccagugggaaaucuuccuguuuccccuuccuuucaguuugggaaaaaacugaauaaaaacauuauuuucugaagcccaaccucaagacuaugacucauaauuauuuauuucugacuucauucuuaaguuaugauuaagcuuagacauaaaguuaauguaauugauuuuuuuuuuuuuuuuuuuuuggagacccaggcuggagggcaguggcaccauuuuggcucacugcaaccuccccuccuggguucaagcaauucucccugccucagccuccugaguagcugggauuacaggcaccugccaccaugccugacuaauuuuuguauuuuuuaguagagacaggguuuugccauguuggccaggcuggucuugaacuccugaccucaggugaucacccgccuuggccucccaaagugcuggcauuacaggccugagccaccgcacccagccguaauugauauuuuuuaaaagaauuauauacuaaaacuucuucauuucucacaaauuaguuuaggccugccuuuaauaagcaguucaaacccaagauucaaggaauagggauucugaaagagagguuuuuguuaggcgcauuuuaauaucuuucuuucuaauuugaauuucacucaaaugagcacuuuaaauaugaaucaaaaugcuauuuuaauauuagaaguaacauaaacauauuguagaugacuauugaaaaagcucuaguuaaaaauuuuaugauaaugauuggauagcauuaagauauuaugucuauuguuaaggugaguaauauaaaaggaaguuuuagccaagcuuacagagaauaagggaaaaugaguuaagcgaagaacugguugacaaauauuauuagaauuuuuaggaauaacaucaguauauauaaaugaacacugugcucaucuaagauuauuaguaugaacacagggaacauaauuguguuaugguuuuccccaaagcuguggaaaauucgugcaucacuaguuuccuuugauuauccacagaaaaugacuucagauuuuguguaacacugucagaauuaaaauguugcugaguaaaaacguuuuuagugaauauagcuuaauuagaagauggaaacgacguuucugauaauagaaugcugcauuuuauaggaaugauuaugaggaacuagcccggcaauguaaaauguuugcuaaggauuuacuugcacaagcccggaauucucgugaauuggaaguuauucuaaaccauacgucuagugacgagccucuugacaaacggggauuauuagaagaaagaaugaauuuaagucgucuaaaacuugcuaucaaauauaaccagaaagagguaugaggcuuucuguaauauauuuaaauuauuuucucuacaguagucuaguggcucagggcaaaggcuuuggaguaacucaucuggguuaagauccuaguucugcuuccuaaaaauugugugucuugggauaguuauugaaucuguuugagcuuuuguuuuaauaauuaauuaagaauauauacuaaaaggguuuagcacaguaaguauuagcauuaagcaaguaugcaauaaaugguaguuuuuauuauuuuuaguaauauugauuauaauuauaacauggauguugauuuaauguuuuugcuaaauaguugcuacacagguaagauccuuuguaguagguacaaacuuuauagugaaguuuccaucuuguguuuugucugucacagguugguuuucauugaucugguuauaaauagccccuucuauaguaauagugauuucuauuuaaaaauaaaguaucagauacuauauuuccugauuccucuuauuuauaauucauugugaaacucaaaaguggagagguacaugauaugauaacuaaguugaaucugacuuuucuggcaucaucccuuucuauuaagagauaugcccauuucuacuccccaugcauacauauacauaugauccaggaacuugaaucaggaaaauaugcauuuuaaauuucauuuuugagauaauuaacuaaacagugauauucauauguagauaauaauaauaucuaauugauaguaugggauguugauaaaugguauuuauuagguauuacuucuaagacuauuuucauuguuaacauagauguuuaaauaaaacuugcuuaucaaauuuauauuauuacaaaaauagggccugaaauauauaaugauagaaggccagauacaggaccuuuggugcuaagggcagaauuuuuucuuaccuugguuaaaaauuugagccucacaaaguuauuaggaaauugauggaggaauugauggaggauguuuauugguuaauauauuugcuucuguguuccacaaccuaaaagggacaugaaguccuagaaaaugauagaauaaggggauuacaugguauaaaaucaauuaaagugauuuaaaaaaagaaccucaaagaaaggcguaaagaacuaaaauuauccuguuuaggaaaaaaaaucuuaagagguaauuuucuaaugauagcuauaucccugaaggacucacagaguggaguccaaauggaaccaaauguaccauucuaaagaagaugaaagaaaagacaagaaguaguaguaauauuuguuaguugaaaggaagauauuuugcgauuuuaaagaugaaugaaaauguaaaguaguuuuuaaaacuagauuucuaaauacgaucaguggggaagauauuuucucaaauaguugguaagcuuuguuuagguuaucaaucuugaauagcaaacuacucugaaacuuaguggcauaaaacacuucauaguuauuuuauaauaauuucauaaucauuuuauuaugcucuuggauucuuaggucaggaauuaggaaagggcauggcaaucaugauuuuucucugcuucuccgugucugggaacucaucuggagauaaaugacagggcuauaaucagcugggggcuucuccacucacaugucuggugucugagcagcagcugaggccucaggaacagggugcucagaugggugaguccacagaagguggggcuccugagaacucacaacaggaaccaaggagaggcauggccaucacaaugggcagacuuugaggauguggucugagaagccucugcgggcuggcugggguacauacaugugaccucugugugcagccugggcuuccucacagcaugguggcuucagaguggcuuuuuacaugguaguucauggcuccaagagcagguguuccagugagcaagguggaagaugcguagccuuuuaggaccuaccuucagaagucacauagcaucaccucuguuagaaucuacuaguuaaaucaaucacaagccuguugaauugaagaguaggaaauuuugacuuccuccuuccccaccucuugaugaugggaagaaagcguguccaucuuucacugcagacuuagaacauuucuaguuaaacuuuuuauuccaaauacauaguuaacauuacugcaaauuaaauugucauuguauagagggauagcaaggacaguaaucaguccugagauugcuuugauauuuggaggaaaggugacacuacuaaauuugagauuuacuaaaccuggucauuggugagaggaaaagcuguuucucucccaggcauuucaccuugagggacaaauuaagauuucccaagaacauuggaaucugagcagaagaguaaagaaugaaguauugccaaaaauaaguauuugcauauaacauacacacaucuucccauauacuuuaaaguaucuuucaauuacuuauaacaccuaauacagugccuacacaucauuucauucauguggauucaacauaguacuugcugugaagaauauucaaguuuugcuuauuuggaacuuugugaauuuuuucuuccaaauauuguugauccaugguugguuuaauccacagauguaggacacagagauacagagggccaacucuacaguauacuagaaauuuucuugaaagcacaauaaacaacaaaacucuguccaauucuuuuuuucacuacaguguuaauucuacaaauuauauucuguuuugggauaaaucauuuuaaaacagaagguugaccaaauauuauuguggauuaccugaauaaugucauuuuauaauaauuucaaaccugaucacaugaguauauauagaauuaucaggacccuuaaguuauacuucacaacaugagcauuauauuggaaaaauauugccuaugaaauuugucaacuaagaagauuuguaaacuuugguaaauuaguuucuguaccugaacuaaaauuuuucucauauuugggaauauuuuuccuuucuucucacaugaaauucaguuuuaaucaggcuuaagagugucuuuaauaccuuuuaagaaauccgcagugcuuucuuggagcaagaauaggucuaauauuuagcuuuuuauuguuuuugcuaucuugacuucuuggcuucugguaacuaaaaucaauaguuucucuagacugaagauguccaacauuaguuagugguaucuuuuucuauggauugugcaugauaacuuugaaauuucauaaauauuauuaugaguuuuuauauauuaaacaugaaaaaauggcuaaguaagcuaauaauaauaguuaauacuuauagagugcaugcuaugaaccaggcgcuauucugagggcuuuaccuuuaaucuucacaacuuuauuaguagauacuauuauuauucccauuuuacagauggggaaguugaggcuuagagaaauuuaaaaacuuguuaaaggucauuuaccaaguagcagagcccagauuugaaucuagguaaucuggcuccauagucuauccucuuaaccucuacaugcuuuuauuguuagaaaaagggaaaaaacaaaacuauguugaauguauagaauugauuuuuaaacucuuauucaguaaacuuugaauaucaaccaaucaguauuuaaagguuuccuuuuacuuuuuuucuuuuuaauguguguguauguccuuuucaguuugucucccagucuaacugccagcaguuccugaacacuguuugguuuggacagaugucggguuaccgacgcaagcccaccuguaagaagauaaugacuguuuugacaguaggcaucuuuuggccaguuuugucacuuuguuauuugauagcucccaaaucucaguuuggcagaaucauucacacaccuuuuaugaaauuuaucauucauggagcaucauauuucacauuucugcuguugcuuaaucuauacucucuugucuacaaugaggauaagaaaaacacaauggggccagcccuugaaagaauagacuaucuucuuauucuguggauuauugguaaguaucaaguuaguuugaaagguuuugucuuuauuuagcccacugauucuuucuugauugauggcauugugaauauuggguucaauuugcaauuuuacacuguucacaccacaagaauuugaacacuuccaugaucacugaagacuuaacuaacaugucuguaaagauaaauguuccugaacuugaugauaaggaagcaucucucuuauuuaauauuucuuaaauacauggaauuuuaaaauuauuuauucucagacucuaugguuauucaugauuguaaaacagaaaaucagcuuuaacacaugaaugcuuuuuugguguaagaauaugaaguuuucuuagguauuuugaaacaaucuauuuuauacuguugugcauuuuuaaaguuaacuauucuauuucauuuauaacauuaguuuuccuuuuaagaaccuaugagcuuuuugguuuuuguuuuguuuuguuuuguuuuguuugagacagagucucgcucugucgcccaggcuggagugcaauggcacagucuuggcuuacugcaaccuccgccucccggguucaaacgauucuccugccuuagccucccaguagcugggauuacaggugcgugccaccacaccuggcuaauuuuuguauuuuuaguagagaugggguuucacuucauuggccaggcuggucucgaacuccugacuucguaauccuccugccucagccucccaaagugcugggauuauaggccugagccaccgugcccggccuagaaccuaugaacuuuugcagauauaucuugcuuuaucucuauuuuggaaacauuguuuaaauuuagauuuaaaggagucccuggugacucauuccauaaaucauuucuuuguagagauagccagaucucuuuagaaaugauaguuuuuuaaaaaguauaagacauuuuauuccugaaaauuauuuuuauaaguauuacacuguauaauaaaugucuuaaaucaucuucuacaauuuuuacucgucuugccuucugugugucggggugcguguggagaguugagguagaaucacauuaucuguuuaugguauuuuaaagauauuuucuuuauuucccucuguaucuucuaccuuguuuuuaaccucagcacuucccaucuguccgucuacuauuugcuauagaguaaaaggguaauaaaauuuagucuuaucuauggcacaaaguacugaguguauuuaucuuuugauuacuacauuccugauuguuucaauuauuuaguacuuucauaaguuauuucacaauguucaauuuuagcucuuuagcuauacaaauacuuuuuauauuuuagaauguuuauuugaaaaucaguuaauuucagguaacuagauuguaauuagaguuuugcuuuuaacaguauuuaaucuaugaugcauuaauguuuaaaauuagguagauaaaauaauacacaucuaaacucuagguuaaagagaauuaaauaauuccuucuuguuaauauuuuuauuuccuguaguuuugcucuuaucuaaaauuuaaucuuuuaauuuaggaaauaauuuaaacuuuaccauauaugguuuuauauuggacugugggacucuuucaaugugaaauauguuuguauugcuaguugaguaguuaaaaaauuccuggaagaauuuuacacauuaguuugaagagaaucgcuaaggagcacuuucccuauauucauuuaaacuauuucugauuguuauauauuccuuagucuuaaacagaugaaauuuuauaacauuuaucuauaaccuauuguuuaguaguaagaaagaauauuuucuguguuuuguuagauuuaguuuaccccagucuguauaagaaucaaauuaaaguuuauaugucuuagcaaugaguaaaaacucaccgaacuaaaauagucauaccacucuuugaauagcauaaauauuacugcuguccccgauuuucauaauaaugguaaaacuauagcucuucccuuuuauaugaugcuguuuucaaugauauuacacguauauauacauggguacccccuuacacacauaauaugauuaauuuucuaaccauauucuaccucacuagaagaaugcaugugcauuaagccaguaaaauuccuggaaguaucuuccuuuccucagcacagcuucugcuuugaaacaguuugaucugaauaagccuugccaaggaagucuucuuaagccuuuuauguaauuaggucacucugggcuuuuuuucaguauauagauccaaaccggcucuaagugagcauggaggaauauuuugcuugcuugccuaaauaaagucauugcuugguucaacuuacuauuucaagcaaugaacacagugacuuuuuaacucaucaugaccaauuuuuguauauuuguuuuguuugcuuucauuagcuuuucagaaaaaaguaagguuagguuauaaaaagcaagguagguaaaaagagaauaauuuguugaggaaugcacagaauauuaaugguauccuuuuacuuaauuuuugcuauuaaacauaauagaauggcuauuauagaaauguauuuuuuaaaugucauguaccuacuuugucuaagcacaggcaaaagcagauauggcccauacacucgugaagcuuaugaucuaauaaaagccaaauaaaaccaucaaaaacuugacuugagaaucauauggaaaaaugaaaacucaaaaauggauuaagugcuauugguuaaagaucauaguguuaggagaguaagcauauuauaggggcauuugcccuagucagggagguugggaaagacacguugaggaaguaauaagugagcuaagaucuaaaagauaaauagaugucaacugagagaacugggagaggaagcuacucuaggcugagauaaaagcacauucagaagcucaguggcaagagagagaaugguacaaagaagggucugaguaaaggcuaacauuucuggagcagggagaaccaggagagcuugauucaagaugaagcuacagaaacauauuguaccagaccaugcauggccuuguaggucagguuaaguaauuuugacuuuauauuaagaacaaggggaaaccauugccuaccugaaguaggcaagugacaugaucaguuuugccuuucgaaaagaucauucuaucuacaggguggaggaugagcugggaggauagugcuguggcaggaguagauggagggagaccaauaucgaugcuguugcacuaauccagaugagagcugauggcaccuuggacuuagggugauugugauagagaaagagagaagggaacagacuucagagauauuuauaauguaaggccaguaggacaucgaaauacauaguauaugagaggugaaggaaagggagauuauuaagcaauauuggucuuuuggaagaguacuaggcuuggggauuuguguguugagggguagauccugaguacaguuucggauauguugaguuugaaaagccuuugagauauuuuuuaaauaucccuuuuagggaugucaagcagacaguuggucuggagcuugaguuagaaagguaugcauaucugaaaauaggugguauaugaaacuauaggcauaggugagacacaaggagaaagauaaauugagaaaaagagaggaccuaagaucaagcccuugagaaaucccaagauggcugggauugcugccuucuaauguuauuauuaacauuaauucuaaaaaaaauagacccuaaaauauagaauguugguuauguaguguuuguauugcuuggauuaguuucaacuuacuauguucuuugugauccagcuuggaaacaugcaauacaucaaguguauuagcuucauuuuuguggggguauugcagaggagcugggaaacuaaccaauuggucuucacuguacuuucaugucugucuuuuuugaucaacaguuuucuccaauucauguuguaaguuuuuguuaagaguuucuuuuagguaaaauauugcauuucacagaaauaaacacauuucuguaaacaucuuucuuaguuugauguuuuaaauauuaacaggaguguaucuaaaguuuaaauauaaggguuuuuguuugaagauguuucauaaauaaggauucgcacacaucaggaucuagaauuagacaauaauuuugagucuucaagaaaguauggucauggaggauuuguuuaauauguuucugcuccacagcucugagugguaggugaagguugaacaugagaaauaucagaaagcuuucaucccuacuccuuccccaaauaaaacaguauuugaguuaauaaaauguuaccugcuagacuauuucauuuuacauuuuuagacaguuuucaucuauucauuuugaguaaaaacauacuaagguggaauuguuaaaaauguuuuuccugucaaaucugcaaauguuuuaaacacuuuuuuucuguauaaaauauggguacugcauaauuaagauguuuugaacagagaucuucaagaauguuucuuguguuucccaggggaauuauuuugccuacugauaagccagagaaugauucugauuggccuaauuugaucuccacccaugugugaugcuacagcacucuauucuuuuguuacucuguagucuccccgaaaaugacuuaaugaaggaauguaccauaaaaugauccugaauuauguuacugaagucugguacccauaaaaauauauaguuauagaggagcuucuggccaaaaaacggaaaguuuuucuguuuguuugcuuugguuuuuauuuuuguauauuuauucauuuggcaauauuuuuuagcaccuuguuuguaucagguacuuuucaggacauuuggaaacaucgguaaauaaaacaaagauucuuacccuugaagagcuuacccaaagugggggaaagauaaucaauuaauaauagaccuaauaaguaaauuauauucaguguuagaaaagagauaaguaauacaaaagaaagguaaaagcagaguuaggagaauugggagugggggacaauuuuaaaguugcaaagaguuugcaauuuuaaauaggguagucaggaagggugaugagcaaagacaugaaaaagugagguaguuagucaaauggaucucugggugaggaggguccagccagaaggaagagccaguauaaaggcccuaaaggcaggagucauguguucaaagaacagcaaggaagcaaggaggccagcgcgacuagaauaguacaaggaaagauuaguaggagaugaggucagagaggauagguaauuuggagacuugcaggccauuguaaagacugguuuugauucugaguaaaaugggauuuaagggagggugcagugcccacuaugcacaaugagcagcagugguuuugcauuuuuuugacauuugcacucacagaacaaaacaggcugaaaccugguacuagguuuacuuaaauuuguagaaguaaaagauuugaacuuaaauauauaaacuugagagccuuugccauguagaugauauuuaaagccauuagauugggugagaucauuaaaguaguaaguauagguagagaaaagaaaaggaucagggacugagccccuugugcggggguguguacgugugugcgugcacauccauguguguauccgugugugucuccguguauguuuguaucccuguguaugcauccaugugcaugcauccguguguguguguuugugcccauguguguuuggcauuaauuuauuugguuucuuacguuuguuccacauccaaagaugaaacuuaagguuauuuucuucaagucguaugaaaguuaagguuauuuucuuucagauuuuaagaacuuuucacuaaaauguuuuugguuuuguuuuuuuuucuuuugaauaaggcccaaggauuauuuauuuaauauuuugagucuuaaaguauuauuuaguuuauuuauugaauuaagaaaguguuaucugauuuuuuucuuccuuuucucagggaugauuuggucagacauuaaaagacucugguaugaaggguuggaagacuuuuuagaagaaucucguaaucaacucaguuuugucaugaauucucuuuauuuggcaaccuuugcccucaaagugguugcucacaacaaggugacuauuuacuaugucaauugaaggcacaaauuaaguuuauuuuggaaauagcuaagauauuuagcuauguaacucagaguuacauugagccagaucagugucugguguguuuucauuuuaagccuaucugugugcacauaguuuccuauuuuuccaguaguuuacagguguuacuuaccuuuacaugaugguuauuuauuauauaacagggaccauaguucacauuugguauacuuuaucucuuuuuaucuacacugggauucuuugagacugaaguccuuauuuccuuauucccauuuugcaaguaagaaaaaugaagccuaaaaauauuaaacaacuuguccgaaaccacacaauaggaaaccaagacuggauuuaaauccugcccugucuaggcauuuucuuucuacuagaugccaauuccuuauaucugaccuagguucuuuuagcuuauuaaccuguauauacuuaaaaugagaacaaaguaacuuaaaaugauuaguguuagauaucuuuauaucugccagaaaaagaguuuccauuccauuccauuucauaaugaaugaaauugguuauguaauauuuuacacauuucaaaucaugauuaacagcuuuaaaagugauguaaauguuauuauuuuucuaauaacuauauauuuuuauuuagaauuugacaaaaaucuacccuuauagauaacuuacaauuuuacuuucaucagaauuuaagcucccccaagcccagaaaggguaacaaauuguguguuaacuaucuuuguuuaaacccugaguuuagaauucuucuggggugucacauucaaggaacuaaaauauauaauauucucuguuuuuuauuaguucuuagauuauugaaaaggcaagcucauuauuuuacauaauuuuacuuuauuaaaaaauucuguuuaauugaucaguaguauggaauauguuagguacguucagugucuagagugugaaauuacuaagaaaaugaaaauuggucauauauagauaaaugguuugauaaagggauugagagacauugcuuuuucagauugaucucuuucguucuauaaguggaguacccauauaauuuuuuauccaaaucaggacauuuugagagugaaagggggcacuauuaauaauuaugccaggacaacugguacagcaucuuaaacuaucccaggcaauggggacaauugaccacugugucuagguacaauaaugcccucuuuuuuauuuuguauuuaaaaggggggaaaaaaacucugaauuccaagucaaagcaguagguuaauguaauaugauagggaauuaauugacagcacauguacuuaacguuuguguuguggaauuuaagaaaacuagccaacauuucauuaauaaaaagcuuaaugaucauuuaaaaaauuauuuaauuuucuaaaauuuaagaguuucuggaaaaaccucuucauauagagugauaaugccucacauacauaauaauauuuuauuucauuaaaauauuauuucuauuuuuaaaaaacccuauaaaacauaaguggagauccccuauaagaagacaaaauuaaaauggcuuucuuucaacagucagaauauuugcuuuuauuuuccuaaauugagagagcuuauuuaccuuuggcuuuuucuuccuaaccuuaguuucaugauuuugcugaucggaaggauugggaugcauuccauccuacacugguggcagaagggcuuuuugcauuugcaaauguucuaaguuaucuucgucucuuuuuuauguauacaaccagcucuaucuuggguccauuacagguaaauaauuaaaauuucuuaaagaacauuuuuuagaugucauuauuguuacaucuuucuccuuguccaguggaauacuguucucucaugauauuaaagcuaaacuuugcucuugagaauaaguagcaauuagaaggacacagcauguuuaucuacuuugcuucuggcucagugauaauccuuugcuuucagguauuccaaguuaauuaugcugugguccauuagccuccuccccccacuucauagacauagauauguuuaaaauauaauuacacuucagacaguagaguaacauaaaaaucugcuuuuuaucaaaaugaaucucacauuuaaaguuuuaaauauuuuagguuauaaguauaaaggaggaccugugcaaacaaaaauaaucauauuugaugauuuuugaauaagcuggauuuaaaagaauacuuacacuuucguuuaauaaauauuaaauguaauaaguuggaaaguagcauacuuagagcuaaaaaauuuacagaggcuauguaguucagcuuuauauuuuauaauacuuuauaguuaaagaaauugagcuuuugagaugggauuugauuuguccaaaguaguaugauuauuauguaugagaguucaagacuaaauucucagucucuuugcaccaaagaaaagacucauaauugguugcauuuaccccacagaauuuaguaacugguuuucagaagguggggucaacucugcuagcucuauguaauacuauagcuuauuauuucugaaaaucugaacaauauucauuuuuccuuaagucaaaauuuacuaacaauuuagauugucucauauuuuuaaaggugauauuuuaaauaaaaggcauaauuaccuucuccaaacagggauaugaaaauaaaauauauaggaaaaaccugauuugauuaggcuugugcugucauccagcaacaguguuuccugaaguguggcucucuuaaccaaguccugugagaugcucugaauuaaguaaguuugggacacacuguauacuguauaccucuugggaauugacagugcauguuaucacauuaaagccucugagaaaaaaauuuguuuaaccuuguucaaaucaucauuaccuaaagucauuuaaccucauaccuguuuuucaugaaauaugugcaagucucuguauuuuuccaaaacacaguaagccauagaaacacuggcuuaaacuaucuguccuuuugauuuauuuuugccacuaauaucaucuacgaaugcuuuaaucaagagucuacaguguuuuuacaugcacauugauuuuuuuuuaacugaaaauggacgacagaacuagguuucuauacuggaaauuucuuuauggacuccuauaaaggguuaaaaaggagaaaguauaauauuuuuuaggaaugaagagucaauuucugacuucuguuuccagccaacauggaguaauaaggauuggauuuacccuucuaucuaaagcaaucaaaaaggaaaaaagaacaaaauauaugaaacaacagcuuauaagaaacuagauaucaggcaguaaacaacagugaucucuaagaaacaagaaacaaagaucacuccagcuuacugcuuugugagaauuuuuaggcuauugugcagagugggucagugcagucagagccuggcagaauucuggauuuagcagcacagaaagaaaauucuggagaucugcaguugucucccuugaguauucagcagaguacugauuagcauaugcaugugaggacacuaccucgggcagggaaagaaccaucucauccgacgggauuagaagaauacucagaagggucuugccucaauaguuaucucaagccuacacacugcucuaguuucaacgaacaaauauuaaaagcaagaugugaaaggauuaaauuuuuuccaaguaacuuaaauguguucauuaaaaccuauccaaaagcaacacagauguuagaguuaucagauaaggacucuucagcaguuauuauuauuguguuccauauguacaaaaaguuuaaaguuuaguagagacauggaagauguaaaaaaaagaaaaaaacaccaaauuaaacuuucagagaugaaauuuucacugugaccugaaacaugcacuggaugugauuaaugacagguuagaccuuguagaaaaacacauuaguaaacucgaauagguaacaauagaaacuauucaaaauaaaauggagaagaaagaauuuuuaaaaaugaaaagaguaucugugaacuuugggacaacuucagguggccuaauauuaauacuaauguaauuggaaucccugaaaaaaggagagaccaaaaaaauuuuuuaagaaauaauagcagacauuuuccaaauuugaagaaaacuauaaacccacauccaagaaguucaauaaaccugcaaacacaagaaacaugaggaaaaucacaccaagggacaucauauucaguguaucacugcugaaaaucagugauaaaaaaaaucuucaaagcaaacagagaauagcaggucaucauauacagaaaaagaaagguaaggaugacaguagauuucuugucagaaacagugcaagcaaggaggcaguggagugacauuuguaaagcacugaaagaaaaaaaaaacaacugucaaccuggaguucucuaccuagcaaaauaucauucaaaaaugaagguaaaauguagacuuccagacacacaaaagcuaaaagaauacaucacuggacaccagcacuacaaggaacguuaauagaaguccuucagguggaaggacuacaguaacauaggggaauauggaucuaaacagaagaaugaacaaaauacaaauauacccaaagggaauguaacuacaaagcuaaauagacaggcauuuuuuuguuguuucuuuugcuuuuaugaaggaugccagcuaauccacuucagcagauacaagaaacaugauugggcauaaaucaguaaugcuuuauauuuuaaagaaaaaacgacaugaagauagaaucuguacauaauugugguaauaauaguaauaacagcagacauuuauugggcccuuacuaugugccagauacuguucuaaagucuuuauucacauuuauuaccucauuuaauccucacaaccauucuaagaggcagacucuuuuauuuccauuuuacagaggaagaaucugaggcauagagacauuaaguaacuugcgcaaggucacaugguugguaaguagcagaacugggauuccgccuaggugguuuggcuccagagccagugaucuuaaucacuauacuaaaucgccccccagguuguauaauacuacagaauaauaugauucccucauuaacucuuacuguauaacuucugugggcaggcuuuaauaauuuacaguuuuuuaaaaaguuauucaagucacauguuucaaaugaauuaaacagccuuuuacacugacaguuggauaauuuagacagaaagaacaacccauggccacacagcacucuacccuuuuuuccuuauuuccuuauuuccuuuuuuccuuaccuggucccaggguagggcccucucucaggucccacaugcuuccugucuuuauucuuguagcuuaguacaaaagaugugauuauuaucaguuccuccugcuccaagacucugcugcgugggucccugauucuuacccaucuguagcacauacuauuggaaaaauggcucccauagacuuacucaaaaaagguugccacaaacaacacaguaucuguggagcaccacaaaguuaaguguaauaaaacgagguaugcuuguauuuugagggcaguuacugguacuaaguagugagaggguucuaacugaaucuggcauuuaaaguguagaguggaguggauugaggaggauagaagagaaagaggcaaggccuucagagaaagcaaccuuucaaggaguuuuacuccugcuguccaagggacugucaaauccaaaaucuauccaaagagaaaccuaagguuuauuaugauugucauauuugauaggacccagacauaaagucgaguggaccuguuugcccuuccucuuuuuuucuuccccuucgcacuguaaaacaucaccaccuuuucuucagugcuaugauaagaaguccuuacaaaagcaacaagucucccacuucagcuucuguuuuugaccucaugcuuucaggccucacaucuagagaaacuaaguggaaaaaagguuguuuuuuuuuuuuuuggaggggaauaaauuauuuggcaauuuucucaaauauuaaucccuuuucuucccuaaaguuccuccccuuccuacuucauuuaggauaggaggugcguuucuuucccagagguugaaauguuuccuagggaaaucugccguaucaugugauucuaaaacaguuuaaaggcaccacauacacugauuagguuucucugaggaggagccccaaagcagaaaucucuggcaaggauuaguucuggagggguggugaugagcaaaucagaccaaaggaggggagcucuugagggucuaugcaugcauuccuaggccucaacauuuaugguacuugaaagagcuuguaucuaacugucuugcuuuucuguuuggucuaauuauuagaauuacuaauauuacaaaugaaugaacauccccuuggguucugacagguugguucaaaaucuugcuccaucacuuacuguuuagugucugugagccucaguuucuuuauccguuauugugaggauuaaaugggucaguguauguaagaugcauaccacaguacuugacacauggugggcuuuacguaaauguuuagguccauuuuuuccauuccuuuuauaguuaguuaacuauggcagaccugaaaaauaauauaagaaaacuuggaaagcuuaguacuugaaacaugaguguguauuuuauuucuagugaauuauuugguuuuacuggauaauuaucagauuuaauuuaguagccuguauaauauaaguggcauguuggugcugcuucuaacgaguaaagagcuguuucagguguuuugcauuuugguguauauuagaguuagagaaaccgaggagucauguaguccagagguucaaacugguggggcugcagaaucaccuggggagcauguucaaccuagauucucaaguccuacccucagagauacugauuaaauugauuggguuaaagcuggaaaaugacaugcagaugagucugaugcagcauuugacuauaucccuuguauagaucaggaaacuaaggcccagcucacacaguguuagaaccaggacuugguguuaauuaacuaaguuaauuaagaaacuaagaaagugguaaagaauuauucaacauuuuaauuaaugcacugggcucuggagcuuacuaagacauggugccugcucuuaaagacugcuagaggagacaaacauaacauaaauacuaguaugaagucaaaaauacuguuuuagcaauaacaaacaaaguuacuuuggaagcaugacugaggaaguagccggagagagucaggaaggcuccuuagaggagguggcauuugaucugagccuugaaaggaugagaagccugccuggcaaaggacaaagggaaaguaacacgcagaagcguggaguccuaaagcauggugugcuuagagaagacagcauauccuuuauaguuggaccguggauuggaguuggggagaugaggcuaaaaaagacaggcugggcuggacacugaaggucucugugccaggaauuuuaauaucacaugugcaaaggagguuuuugagccugggugacuuguuuagauagaacuuuuggacagauaauuauggcuuuauucuggagggagauuuggaaagacagugacuagaaguugugauuauuauugcuuucuuuuguuagcaacuuguguaauuuaaugagccuaaugauagcaaccuuucccuuaucagagauuuagguuguuuuuguuguucugcauaguacucuguguaugaggcuuuuugccucuguuauuucuaaggguaagucuccaaaaauaguauuaacagaucaaaagauaugauccaccuaacaccucaguauuuuuauuuuuuuacaauaaaguguguuaauuuucugcaauacaagcaguauaaaaauaguuucacuacauuaauagcauuuggugcuguuuuaaaguuaugcuaauuuaguaguuugcuuuaauuucccuuuuucugauuagcaagaaggauuuuuuccucuguguguacuaguauuaacucuauguaaauuuuaguauuaauauuuuaauuaccuuucucuuuucauuucacaaguuuucauauuucucaaguuaaaccgccaaguacuuuuuaaaaaguaaauguuugagaaagcauuauuacuuuuacaaauacauaaaccuuauaaucucucagucuaaaauaaauuuacuguuuuuaauauuugccuuucacaugaauauuucauuagugucuucaagccaguguuuuccucagugguauccacuguucuacuuuuacuucuucuuguauuaagaaccaauaccaugcuauuaaacaagucaggccgggcaugguggaacacacuucuaauugcagcacuuugggaggcuaaggcgggaggauagcuugaggccaggaguucaagaccagccugggcaacauagcaagaccuugucuacaaaaaaauaaauaaaaauuagccaggcauggugggaugugccuaguuucucaugaggcuugaguggggaggacugcugaagccuaggagguuaaggcuacagugagucaugauuguaccaccauacuccagccugggaaacagagugaaacucugucucuuaaaaauuucuuuuuaaauuuaaaauuuaagcaagucaugaaguuugugguguucucauucagaauugcuuaccuugauauugaacucgauuacauuuauuuaaaacuuagguuaaauuaaagcuacuuugacuacauguuuuaaaauuaaaaugauaucauacauggucacuauuggaaaaccugauuuaccuguaagcuuacaguguccagacuuuccucaaggugaucuuuucuguaguuaucaaaagcaguuacuguauucuuacugucauaagggauugaguucuguacugagaugguauagcuuuauucuaagcaaucacaaucugaauggaugcuuuucuuucucaaggugauccaauaaagcugucauugauuaagaggaaaaugcauuucuucuccuucuuacauauuuugaguuuucugauucuaaguguccccugcuucuugugucagaauuuuguaagggggccaagugagggcagcauaggccuugaaaaguaccacauggucuagucaaaagcacaagucaggcauauuggaccucuccacuauggcagagucuggguuacuagcuuguggcgugccuaagaauuuaaacucaccuauucugcuuaaguagcugguccacuuuagugggcuggaagcaucuggccaguugccuguggcuaccauuuuguaucacugaaagcgggaugugcuaugcuggccgacuugggccaauuaggaauuuuauuuaaagcuugauguaauuaauuauauaaauuugaccuguuaaauuugaggaaggguuguuucaaaacacucaauuuuguacauuaaaaauaaugaggccaggcacgguggcucacaccuguaaucccaacacuuugggaagcugaggugggcagaucacuugaggccaggaaucugagaccauuuuggacaacauagugaaacccgaucucuacuaaaaauacaaaaaauuagcugggcaugguggugggcaucuguaaucccagcuacuugggaggcuaaggcaggagaaucacuugaacuugggaggcggagguuuguaguaagcugagaucacaccacugcauuccagccugggagauagagacugucuuaaaaagaaagaaaaaaaaaaaaaagucucccuacuauacccuuagauauaugcccuuccauagauaaacaugguuaacaauuucuuauguaaacuuccagaaacuuccuaugcauauuaaagcauaucuauauuaaaauauguaucuugucuauccuuuaacaaaauagaaaugggggccguucuacauauacauacuguuuuauacccugcuuuuuggauuuacugucuuacagccaucuuuguaugcuagcacauguagauguucuucauucuuuuuaaaaacaauguugaguaauguuacagcucuuuuagaauuugucuagcaggcuuuccgguucuugcgggaaagucccccccaaaaaauauuaaaaaauaaaaaauaaaaacaauauugaggauuuucuaaaauuuuuuugcuaccucuaacaauguugcaauguaaauccuuguauauacaugcaucuuuguguacuuccuaucuauugguuaaauuucuagggauagaauugcugggucaaaaaaguacuaucacauuauuccccaaauuugcaugccaauuuaaaaaccaagaauuuaugaaaaguaccuaaucucuaaauuuugaagaaugaaauuaggauuaaagcuuccauaugcacuauacaugucuaaacuacaaaagauacucacuacuaauacuggacacccucauuuggcuugcacacauaauauuuucuuaaaauggacccaaagggaaagaaaaucuaucacuucagcaaaagaaauuagggcagucccauaggaggaaaugcugauuuuaggaauugguuuagaauugguuucaaaaaucaggugaaauacuuugccucauaaugauuuuauguuuguaaaauuuaagaagccauguaaauauaagcauuuauuucucuuuaaguuugagcaggguauuuuccuuuuaucccuugcaaauuaggccuuuucuuaaaucuccauaucucugccucuaucuccauaacaacaauguccucugaaacccugauccagguucuaggaacgugccaucuaacacugauaguguugguaugauuagaaugacuuuuuguuaggcagcuggauuuucgauguuuuuaaaaugaucugucucaaccagaugcaauagaagggguggccuguggauuauguguuugucuucuuccuuuuguugcugggucauuuauauuuaauauuuuguuuuucugauaaucuuaaugaacaccuguguaauauauuccacagauuucaaugggacagauguuacaagauuuuggaaaauuucuugggauguuucuucuuguuuuguuuucuuucacaauuggacugacacaacuguaugauaaaggauauacuucaaaggagcagaaggacuguguaggcaucuucugugaacagcaaagcaaugauaccuuccauucgugaguaucuuuuaaauguuuuaguaaauauauuugucuuuuuuuuuuuuaccaucuucuauaugaauuaguaucuauagaaauggaacuucacauuuuaagaaauuccuuaguaauguucauaaacuuuaauaaauacuuauuuuucaugaaucacuauagucaucuuuacauacagcaucuuaaauaguggguccaaguuauuaccuugucuucccuacugcagucuaucuuaacagaggaauucuuggcauuuuguguguucuuagcauuuugagcaauucuuugucauuccuauguauugcaagauguucagcaucucuguccuucagguauuaaaugucaguagcaacucucagucauuguuacagccaaaaacgcucacagcuucaacacuuuuuaagaggucauuagaauugagaaucauuagaacuucaugaacauuuuuuucucuaauguaucauaaggauuugaauaaccuguuuugagguaaacaaaauuccucccgucauuuuuaaauaaaacaauggagaagaguuguggaaggacacauuugucauguucuuauuaugugucaacuauucuuuaguuauuuugugugucaucuuauguaaagaauaagauuaaugaguaugugucaguguaccacuuacuauauaccagccaauguucuaagugcugagcaaaugaaguauuaguaaacaaaacuacccugaugaagcuuacauucuagggaggugauacaggcaauaaaaagaggaguaaaauauucaguauguuacacaguggucagggcuacaaagacaaauaaagcaugagcaaaagagugucugugugucagaguucaguuuuaacuaaggagcuagggagugccccagaagagaugacauucaugugaggaucuaaagcugguaaaggagcaagccacgaagaacauuucugggggaagagcauuuacagagagagagaacggcaaaggcaaguguccagagguaggagcaugacugguauguucaagaaaaagccaggcagccaguguggauggaauguguugaaucagagggggaguuguaggaaaugaagucagaaagguaauggggaucauguaggacuuuuuugcccuuguaaggauuuugaguuauugagauugagaguuauuugaagguuuugagcagaggugugacaaaauccaauuagauauuagcaaaucauauaggcugccuuguugagaacagacagaaaugaagucagaaggguaauggggaucauguaggacuuuuuugcccuuguaaggauuuugaguuguugagauugagagucauuugaagguuuugagcagaggugugacaaaaucuaauuagauguuaacaaaucauauaggcugccuuguugagaacagaaagaaaggcagcaagggguuaaacaguuacaaauaauuuaucuuccuuagggucucuuuguuuaaauuuaaaguaaggcauaucaguacuguggaagucaacaucauuuuuaaauaaggaacuuuucauggauuaucaauguuuuauuuaaauaauuuugauauaaacaaaugauucauuuuugcuaauuucuuuaauugccuuuuaaacagaaaugcaauugucuuuacagguucauuggcaccugcuuugcuuuguucugguauauuuucuccuuagcgcauguggcaaucuuugucacaagauuuagcuauggagaagaacugcaguccuuugugggagcugucauuguugguacauacaaugucgugguugugauugugcuuaccaaacugcugguggcaaugcuucauaaaagcuuucaguugauagcaguaaguucauucuuuuaaaaacuuuauauucuccucagaccauacuaagugcauacaauagauaagauagccaaagauuauaagauuauaagaauugaaaaauaguauuuuuaaauuaaauauagauuuuuaaaauguaaguaauguauaauaauugcaaauguugaacaaaauuuuucugcaagguguggaaacaucccccauauuuguguguguauuaauauucuaguuugcuuuuuaauuugccuuuuauauagaaucaugaagacaaagaauggaaguuugcucgagcaaaauuauggcuuagcuacuuugaugacaaauguacguuaccuccaccuuucaacaucauucccucaccaaagacuaucugcuauaugauuaguagccucaguaaguggauuugcucucauacaucaaaaggcaaggucaaacggcaaaacaguuuaaagguaagaaauuagaagcuugaauggcaacauaaaaguuuuaacaauuccuaaucucagauauuucuuaaagcguaaguaugcagguucccuaagggcugugacugucugacuuuuuuucacugcuauauacccuaauguacggcaucgcauccaacauaaaguaaggauucaauaaauacuauugagagugagagggcugggugcgguggcucacgcuuguaaucccagcacuuugggaggcugaggcaagcacaucaucacuugaggucaggaguuugagaccagccuggugaaaccccaucucuacuaaaaacacaaaaacuagcugagugugguggcacaugccuguagucccagcuacucaggaggcugaggcaggagaauugcuugaacccaggagguggagguugcagugagccaggaucaugcuacugcacuccagcuugggugacagagcgagacuccaccucagaacaaacaaacaaacaaauauauauauacacacacacacacacacacacacacacacacacacacacauauaauuauuaagaaugggagauaguacugagauuuuuuuuuuuacuuuucagauuccuccaauauauaaaauuucaucucauaguuuuaaaacaugggaaauauucaaaauacccauucugucacuguagcuaaagaaugacuacuagaaucagcucauauuuuucugguucuucuugaaaguuauucaauacaucaauaauucaauauauguuacuauaaaccagggguugggacauuuuuucuguaaagguccagauaguaaauacuuuacacuuuucaggcugagacaaaaucagagauauuguaagcagugauacaguaagagagaaaacaaauuuucacaaaacuuuuauugauaaaagucaaaauauaacaauaacaguaauaacuuuuuaaauauaggucuacuagugaaaagaauggaguuccuuuugggaggggauaaaauuucacuuaacuagaguuuaaaauuaguguuauuaucaauugaugauaaauguucaucuguaaaaucuauucuuagcucacaggcuguaaagucaggauauggaccauauuuggcuuguggguuguaguuugccaaucccugcuauaaacuaaggauuccuaagacuaauuuuuuucaaucaagauaagcauaaaauuaaauucauuaaacaaauaugcaggcuauauuuguuuuaaacaaguguugaauauuauaccauguaguagaaaaacuauagucuaauaaagcauuuaaagauguguuugugucugugaauauauuuuugaacucuaccucauuuaaauaucguuucugcauauccuuaguaucauauuguuguuuugaaggaauggaggaauuugaaacagaagagagaugaaaacuaucaaaaagugaugugcugccuagugcaucguuacuugacuuccaugagacagaagaugcaaaguacagaucaggcaacuguggaaaaucuaaacgaacugcgccaagaucugucaaaauuccgaaaugaaauaagggauuuacuuggcuuucggacuucuaaauaugcuauguuuuauccaagaaauuaaccauuuucuaaaucauggagcgaauaauuuucaauaacagauccaaaagacuauauugcauaacuugcaaugaaauuaaugagauauauauugaaauaaagaauuauguaaaagccauucuuuaaaauauuuauagcauaaauauauguuauguaaaguguguauauagaauuaguuuuuuaaaccuucuguuaguggcuuuuugcagaagcaaaacagauuaaguagauagauuuuguuagcaugcugcuugguuuucuuacuuagugcuuuaaaauguuuuuuuuuauguuuaagaggggcaguuauaaauggacacauugcccagaauguuuuguaaaaugaagaccagcaaauguaggcugaucuccuucacaggauacacuugaaauauagaaguuauguuuuaaauaucucuguuuuaggaguucacauauaguucagcauuuauuguuuaggaguauaauuuuauuuuaucuaaaauaauagucuauuuuuucuuuuguauuuuguuauaaucuuaagcaacaaagaaaaaacccuaauauuugaaucuauuuaugucuuucaauuuaaauucacuucaguuuuuguuauuguaauauauuuacuuuuacaugguuauaaucacuuuauauuuuuaauguuuuuuucacuuaauauuuuauauauacauuuccauguauugauguaguuaguccacauuuaaauuuuuauagaauuauauaguuuuugaaaaauacagucaguagauguuuuauuuuuuagcuauucaguuauguuuauaaguuugcauagcuacuucucgacauuugguuuguuuuaauuuuuuuguaucauaauaguccuauuuuuuuuucaaguuggagugaauguuuuuaguuuuaagauagauaggagacacuuuuuuaucacauguagucacaaccuguuuuguuuuuguaaaacauaggaagucucuuuaaugcaaugauuuguuuuauauuuggacuaagguucuugagcuuaucucccaagguacuuuccauaauuuaacacagcuucuauaaaagugacuucaugcuuacuuguggaucauucuugcugcuuaagaugaaaagcauugguuuuuuaaaauuagagaauaaaauauguauuuaaauuuuugguguguucacauaaagggauguagcuaaaauguuuucauaggcuauuauauauucucgcagcauuuccaguuaagaggauauuagguauauaauucucuucuuaaccgaaugucagauggucuuacgccacagggugcagguaacccuuggucuguaagcaccaccgauccagggaucauugucuaaauagguuacuauuguuuguuucaucuugcuuuugcauuuuuauuuuuuaauuuccaaauuuuaaguguucccucuuuggggcaaauucuuauaaaaauguuuauuguaaaguuauauauuuugucuacgaugggauuaugcacuucccaauugggauuuuacaucuggauuuuuagucauucuaaaaaacaccuaauuauuaaaacauuuauagagugccuacuguaugcaugaguugaguugcuucugagguacauuuugaaugacagcauauuguaagaaaaaaaaaggugaauaaaauuugacauuagauuauaaauggagucugu

SEQ ID NO: 16088 - RNA, 17362 nt, Homo sapiens
uuuuagaaauaauuaaaauuggccgggcacaguggcucaugccuguaaucccagcacuuugggaggccgaggcaggcggaucacuaggucaggagaucgagaccauccuggcuaacacggugaaacccugucucuacuaaaaauacaaaaaauuagcugggcgugguggcaggcaccuauagucccaccuacucgggaggcugaggcaggagaauggcaagaacccgagaggcagaguuugcagugagccgagauugagccacugcacuccagcuugggcgacagagcaagacuccaucucaaaaaaaaaaaagaaaaauuaaauagcagucucugugccuaaagacuuaauguuucaguaauaccuauaaagcaauagaaaauaaaacagcagcauuuugucauuguuaaauauacaacuuaaauauuuuaaauacaauauucuugucacauuaauagugaauaauuaaaaagaaggaccuacccaggacauuuuuaauaaucuguaaauagauuagagauacugucccaguagcuuccuuccuaccauucagaagaauuauucauguauaccacauaguaagccuucaaugacauucuuugguuaugaaaugaacaaucuuuaaauauauuugauauaacauuuagaaauuuugaguucuaucuuguuuuuaaauuuauguguauuuuuuaacagugcuuaagaaaagaugcagagucucguagaagagaacuucauauucgaacauaugcaguuauuccacuaaaugaugaaugugggauuauugaaugggugaacaacacugcugguuugagaccuauucugaccaaacuauauaaagaaaaggguacuaaaauuaauucuuauacauauacaguguggguacuaaguuauauaauauggguauaauugguauuaauauaugcuagcauauguuuuuugauauaagcuauagugaaauuucuagauuuuauauacagaaacacuuaaguguuuccaucccuuccuuccuuucuuccuuccuuccuuccuuccauuuugauuccuucccugucuucaucccaacaggauuugagguagcuuacaaaacuauauaugaauauuuguuuuucacagauauugguuaacaauucugaaacuauguauauacaguacuagucuucagcaaguaaguaaauauguuguauaaugagagccaguuuucucacuauuggagaaaggaaggagagaaggcuagaaugaagucugacguuuuagauuggaauaagaggcuccaacuguccaaaccugggauaauuugaguagcaaaauaaauaaugauuguaaacuauuauaacccauggaauaaacaaauaaacaugaguccauacugauauaaacagauauuugaguaaauaaauaaauagggaagugggaauaguucuuccuuauguacuaauagaauuucaaugaauaaauguagaaaggaugauggaaaugggaaaucagcaauuagcaaacacuauaguaauuauuauugcaggcagugauuauuaauggaugcuaaaauuaauaggcaaaagaugagaaacagguuauuugaagaaucuugaaguaucucccuaucagauacuuaacaauuauaaagggaaaaguauaguaacuuuacaguagagaaauauaaauauaacugguccgaacuccuuacaaaugucaaaguaaugaauucccagauuugaugacauuaaggaguugacauuugaugacaacuaaauguaauguguaauccuggauuggauccugaccccuaaacaaagugugcuagugggacagcuggugaaauuugaauaaggucagagguuugguuaauaauacuguaauaauaagaauuuccugauuugaauaauuguacuauuguuacgcaagauaugaacauuaaggaaagcugggugaagaauaugugggaacuccguaucauugaugcaacuuuuuguaacaucuaaacuuguuuuaaaauaagacguuuuuaaaguucauaugguguaauacauuaaaaaugaauagaucaaguugucaaagugaaguagaaaauaaguauauguuuucauacauaauuuguaugguauuugccauaacaaauuacugcaaacuaagcgaguuuaaacaauagaaauuuaucaucucacgguucuggaggcuaaagauacaauaucaaguugucauuaggaccaugaucucucugaaggcuaauguuccuugccuuucucuuaaccuucugguguucuguggcuucuggauguauuguaccacauugccuuuauuguuacauagcauucucucuaugucucugugucucuauuuucucauaagaacaccagucacuggauuauugaauuaagggcccaccuuaaugacuuuaucuuaacaacauuacaucugcaaagauccuguuacugaauaagcucacauucccagguaccaagaauuaggauuucagcauauuuuuuugagagauaaaguucaauuuauaacauuaaguaauacugauaaaucacuauauaauggguauugugccaaguauguuauguacauuauuuuauuuauuauuguuaacacgccugauuauccaucccuauuuuauggacagugccagagaacuuacguaacuugucuaaguucacaguugcaaaacugaaacucagagacacuugagucagaguucaaagaacuugcuguugacuauuuuauuuaugagcaugacauauuguauaugucugaguuuggauuugaaaauauauuuuuucuugauaauuugugucaguguaaaaaauauauguauauauacauauauauugauauguacacauauaugcaaaauaaguucauucauaugggacuuaauuuugagucuuguauucuggaacuauuugauuucacaacacugguuuuaacugacauuaauuuucaucaauaagaggcuucacuuggguaaguacgguggucccuccuuaucuggaggauugcuuccagaauacccucacauaccaaaauccacacauacucaagucucagucagcccugcagaaccugcauguaugaaaagucagccuucaguauauacugauuuuacaucccauguuuuugauccauguuugguugaaaaaaaucacauguaaguggacccacacaguucaaacucauguuguucaagggucaucuguauuaagggaagauaaugugguuuauuauuuuauuauacaaucaguaacuuuauguaugcuuaauugaaaaauguuccuuuauucuuguuuuucaauaacaauuugaauaaaaguagauguuucuuguccaauuuuaacaaaaaaaacuuugccccuuuuuucauuuggcugaugugauuaauggauaucacucuuccuugcaggaguguauaugacaggaaaagaacuucgccaguguaugcuaccaaagucagcagcuuuaucugaaaaacucaaaguauuccgagaauuucuccugcccaggcauccuccuauuuuucaugagugguuucugagaacauucccugauccuacaucaugguaaguuaccaagaauauaauacguuguuaugguugaauguuuauuuuuaauauuuuagauuuauauuggccucauauguauauggauauuucauaggcauuguguuucuuuuagguacaguaguagaucagcuuacugccguuccacugcaguaaugucaaugguugguuauauucuggggcuuggagaccgucauggugaaaauauucucuuugauucuuugacuggugaaugcguacauguagauuucaauugucuuuucaauaagguaugugauaugaguuacucuuacuaauuguguuuucucucaauuuccuuuucucaacaacuguaucuuccuugacauaccuguuaguagcaguuauacucacaguugaguuauacugagaauuuguugacuaguuuucaucaguggaucauguaguaaugcguauuaggauggagagaacuuagaagagugauacuguaaagcuaguacugaauuugaaguccaagagcauagguuuagguucugacucaauuaguuauuaguuaugugaauaagggcagaucaguucauuuuacugagacucaguuuuagagagacagaguaguuuaauacgauaguuuccaauucuagcaacauaucagaauuauccaagaauuaaaaaaaaauuuauagauacccaggagauucagauucuguagguccagagugggaccugggaauaaauugaggcaauuggacccaucuuuaaggcccccuacaauuuuccaauauuauaauccugcagggcagacugguagguuagcgcacuauuuucuucaccuccaucaucuacagguugccuugugcugucacaagaaaccaagaaagaucauagauccaacugagaacaaaucagagauaaaauacuggcauggguuaaaccauacaagagaggaauuuaggguaacugauuggacaagggaugaaaggucccuagaaaaggcagauuagaggacagcagaaaaugaacaacuggacuucauuauaugacauguuuuauuuccuuuaugaggggaugugagcaucugacccuuggcugcuucuguuguuuuaagaugaaaguguuaaagaaaaguagaaauauaugagaauauuuguauuucauauuauucaagaaagacauuaaagaaguuaauaugagacuaaauauugaaugcauaaaauuucucuguaauacugcuuauucacuguacuaaacucagugaaagguaaguccacuuaucuccuagaucuuauccaagaucaaguaugguuucaguucuguaaaagcaaaggcagagcuacauggcuccuucauguuacaaacuucuaaaguaauuacaacauaaauauuuugaggguauuuuugcuuuuugcuaaaagaaucuggacaugaaguucuuugaguaaagauuuuuaaauucuaacauuguuaguuuguaauaaaauguauuguuucuaagggagaaaccuuugaaguuccagaaauugugccauuucgccugacucauaauaugguuaauggaauggguccuaugggaacagagggucuuuuucgaagagcaugugaaguuacaaugaggcugaugcgugaucagcgagagccuuuaaugagguaaucaccuauacuuuguaaauaauuuaacaguaaccucgaauauaauuauuggccccuacauauguuuguuuuuauguagaaaccacuuuguacugacugaaauaguuuuuuuaaauaauagcuuuaugcagauauaauuuauauaccauaaauucaccccuuuaaaaguacauaauucagugguuuuuaguauauucacaagauugugcauccauuaccacuaucuaauuuuaaaacauuuucaucagcccaaaaagaaauuccguaggcauuagcagucacuccugaucccuucccccucccaccccugcuaucuacuuguaaccacucauuuauaauauuuucugucucuauggauuuaccuauucaggacauuucauauaaauggaaucaucuaauauguggccuuuuguguuugucuucuuucacuuaauguaauauuuucaguguucaucauguaucaguacuucauuguuuuuuauugccaaaugguauccuguuauauggauauacuacauuuucuuuuucuguucaucaguuaagagacauuuggauuguuuccaccuuuuguguauuauaaauaguguggcugugaacauugugcacaaguuuuauguggacauauguuuucaguucucuuguguauaccugggaguggaauugcugggucauauguuaaaugcuguacuuaacauuuugaagaacucucaaaucauuuuccaaagcaguuguaacacuuuauaaucccacuaguaauguauguggguuucaacuucucugcaucuuuucuaucuuuagauaacaucuuuaucuauccugguuauugucugccuuuuuuauuuuagccauucuagggaugugaaguuguaucucauugugguuuuaauuugcacuucccuaaugaccagugauggugagcaucuuuucaugucuuuguuggccauuuguagaucaucuuuggacaaaugucuauugaaauccuuugcccacuuuuaaauuggguuuuuuuauucuuuuuuuuuuuccuuugagacaggguuucgcucugucacccagucuggagugcaguggcgugaucuuggcucacugcaacaucugccuccuggguucaaacgauucucgugccucagcuuccuaaguagcugggacagcaugugugcaugagccacuaugucuggcugauucuugcauuuuuaguagagauuggguuuuaccacguuggccaggcuggucuugaacuccugaccucaagugauccucccaccuuggccucccaaagugcugggauuauaggcaugagccaccaugccuggccuauucuugaguugcaagaguuuguuucuuuguuugagacagagucgcccaggcuggagugcaguaacgugaucuccacucacugcaaccuccgcuucguggguucaagugauuucccugccucagccuccccagcagagaagggguuuugccauguugcccagacuggucuugaacucguaagcucaagccauccaccuuccucagccucccaaagugcugggauuacaggcaugagccaccccgcccagccaaguugcaagaguucuuuacacauuuuggauacaagaccuuuuaagauaugauuuucaaauauuuucuuccaucuguggguugucucuucacuuucuuugaugauggccuuugaaacauaaaaguuuuaaauuuugaugcagucuaauuuguuuuuuucuucugguuauuuuugguguuucuguugucauaucuaagaaacuauucccuaauccaaagucaugaagauuuacaccuauguguucuucuaagcauuuuugacuuuuagcucugcuauuuaaaucuuuuaucugucuucaguuauuuuguagauaugguguaagguagggguccauauucauuuuuuugcaugugcauauccauuagucacagcaccauuuuuugaaaagaauauuuugccccucguuuaauuaucuuggcuuuuuuguugaaauggucaauugauuuucagcaauauucuguugaucuauaugccuaaccuuaugcuaacaacacaguguuuugauuguuguaccuuuguaguaaauuuugaaaucauaaagugugaguguuccaacuuugcuuuuuuucccccaagaucauuuagcuauuaugggucccuuguauuuccauauuaauuuuaaaaucagcuuggauuuugauaggaaggacauugaauuuguaaaucaauuagggaguauugcugucuuaacaauuugggaguauugcugucuuaaccauguuaagucuucugaucgaugaacauagaauguuuuuccauuuauuugaauuuuauuuuuuucaucaauguuuugugguuuuuagggucaaguuuuauauuuaacuuuuaaaaauuguauuccuaaguauuuuauuccuuuugauuuuauucuaaauggaauuuuucuuaauuucauuuuuggauuguucauugcuagugcauagauauauaauugauauuuauauauugauauuguaucuuacaaucugcugaauucauguauuaguucuaauaauuauuuuugugccuuccuuaagauuuucucuccacaauaacaugucaccugcagauacaguuuuucuucuuccuuuuuaauaucaaugccuuuuauuucuuuuucuugccuacuugcccuaacuaaaucagugucgaauagacaugcuaaaaguggacauccuugucuuguuccugaucuuagggguagagcagucagucuuugacuuuuaaguaugauguuagcugugggaaacagauuguuugaaaggacuuuuaaagcuuauuuauucaccuucauuauuuaaaagcugucuaucgggccgggcgcgguggcucacgccuguaaucccagcacuuugggaggccgaggcgggcggaucacgaggucaggagaucaagaccauccuggcuaacacggugaaacccugucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaaaaaaaagcugucuaucagacauuaugguagaauacugguuaguuggacauaugcaaaagcaaauucucugaaauaggaaguauaucaucauguggaacaguuaccaagagccccuguguuagucugggucagucaagaaauaauuucuggaggaaguaguugagaccuuaaaaguuaauaaaguugaccaugcaagggagaagagaguguucugagugauaaaaauaucaaggcaagugaagucauggccugccugagaaauacaguauguauuccagaggguauacuuccaggagguggugcuaagagaugacgcaggacagguaagcaggggcuagauuaugaaggucucacauggggccuguuacuacauuauaacuuugccugcagagcaaccagaagucauugaggauuuuaagaaggaauaaaaagggggcaagggguggaaagagauaaucugauuuguacuguagaaaaaauaggguccuaguuugggccaacagccagaaaacuaguuagagguuuauugcaguaacccaggaaaggaugaugguguacuggauagugucacggccguagagacggagauaacugaagagauuccaaagagauuuaggaguuguaauugcauguuagaggaagacggggugaggaugauuccuagauuuuugucuagggcaaauggguggaugaugauuuggggaauacaggagaaauaguugggaaaagguaauuaauuuuauuuuggagauacugaguuugagguguuuggaacauauccaacuggguauuucccauagguaauuggauuugauguuuagggugcagaaaaaaggucugggcuaggucuauaugguagcuauagauguuauaucguuauugaagacaugguaagggauaaaauuccuucauucaaaauauagucauuuaccaguucacaguauacacuuagagauggcacauagaacccaucuuacucuauucuccaaaacaccucugacuccccucuaucuugccuuuuuuccugccuucccuucucuuacccuccccucacaccaaaacagaaauuucacauaacuuaaugaagacguaguaauguguauuauaagaguauuaccauuagcuucucauccuucacuuaaauauugaugucagcaagauuucuucuugcaaagauaacaucauaccauaauauuuguuucaauuuuagugucuuaaagacuuuucuacaugauccucuuguggaauggaguaaaccagugaaagggcauuccaaagcgccacugaaugaaacuggagaaguugucaaugaaaagguuaguagaagguauagcuugauaugggcuguaguccucaucucuacaaaugaacuugauaugcagcuauaguucucaucucuaugcaugagaacugcuuggaaauacuguuagugacuauugauuacucugaaaucuaguucucuaguaucacaaugccauaaguuuucuuuauugucaguaauguuaacaguauucgcauuuguauaauaaaaguucauggcacacuuguuuaaccauagacaauucacaguuaugagauacaguaggaaaaacuauaguacaaauugccugaacuuacagaacaacaggucugagcuuuaauaucaugauaccaguaugucacaagcuauguuaacaaaugcagcaauucacuucuuacuuaguugaagcugcaaaguuugcagauaguuuuguuguuguuguugugguggugguggugguuguuguuuuugagacagagucucgcucugucauccaggcuggaguacaguggcacgaucuuggcucacggcaaccucugccuccuggguucaagcaguucuccugccuuagccucccaaguagcugggauuauaagcgugcaccaccacagcuggcuaauuauuauauuuuuaguagagauggguuucaccauguuggccaggcuggucuugaaccccuggcuucaagugauccacccaccucagcaucccaaaaugcagggauuauaggcauaagccacugugccuagcucagauaguuguuuuuaauaaguuagaauagauugaggauucguuuuuuuugguggggggcacucuuacaucuuuaauaagucuuguacaggcuuacuaaauacaaugaauuauaccaacuauaugcuaauaaagauuaaaaauuuacauuccaguuaacuaccuaaagaguuuaaguccacuuucauccuacugauauagcucgaggaaggcuagaccuguacgcccccauccuucaugucauccuuaacccuuugucuugagaaagaagguuuagcugcuucuuuaguucuucuaaaagaacuaaaagaaaaauuucuuuuucuugcucuauuaucuucaucuguagggugagauuaauauuuccagaauuguggaaaaauucacucuguagcaguugaagagcagauggucucugggacauguuccuuuucguuaagugauagauauacuuggcuuguacuggauaccuuuuacugagggauuccaauaucugaccaguucuugaaccuguuaaaacuucugcucgcuccauuucuguucuaaacagcugaaagagcucuagcaggaucacacucaagcuauauacauaucuaacuggacaaagccagcccuggucucuacaaauaguuuuuguuuuuuuuuaauuagcugggcucaguggcacacuccuguagucccagcuacuugggaggcugaggugggaggaucacuugaccccaggaguuggaggcugcugugagcuaugaugacaccacugcacuccagccugggcaacagagugagacccuuggcaucauacucagauccuuccaacugcugggaugaagcauacagacaagugcccacucuggauauagguguugguguucucuuucuguuucuauggguccagucuguguucuuuuguaagaugucugggcaagccagaccaaagucuccuauuuuuacuugcugaucagggccaugaagaaaaauauuucuaggcuucagaucucuguuuacaauacccauguuauguauguaaaacacaccuuccacuaaaucuugaaaauuuuuuguugcaacacuggccauaaggacaggcaaacuugcccacacacucuuggcccuguuuguuucucucagcuagccagucccacagcuggagcuugcacaccugcaucuggaugugcagcaucaggugguacugcaccucgauccccaacaaguugaaguuuucuuuggaagauuccucaguggaugugaaauucuccucuaggagggaauuacaccugagcagcaggggcuguuucacaauugaccagguagacaaaccagccaggccauuuuccuggagcuccagggaugauucauauucacuggugucucuuaagacggaauugaugguguaguucacagcuuguuguucugauuuugagugucagauucugcaaaggguuuuucuuuucugaggugagcuccgcgaagauaaugggugagcugcuauuuucaccauuuuuaacaccguauugguaucugucugcuuggucggagaacacuuccagaaauggcaacugaacggaagcucugucugcuugugguuggaccacuugaacauguucuguccacgcagugugauaacgaaugauauuagggugcugaagaccugccagcaccuucauuccccguaguucuuucauguaauguguuuuuguugcacccuuaaucaggauuuuuuaaauugcauaauacugaccaucuaauuuauuccugaccuuguauacucuuccauauccaccuuuuccuaagauggcaaguucuucaaauucauuuaaguaacgugaaguuugugcuucaaaggguacuucccuugaucugauuuucuggauaugagaaauagccucacaaggauccugaugaacucucucuuuaguggaccucauuaagugaguaauagcucuguggugauguagucucaaugagcuaaacuugucacaagugaaagaagacagcagccccauuuugauaaaggucuggcaaaguaacuuaaacacugucuugaaugaacuggguuugguucacgcacauggcucaagugcuucaccaaagaaauaagcggcagcugguuugcaacugcaaaagggaaaguuggcuguuguagggguuauuuuaauaccuggaguucugcuggaacauaagucauauuuggaguccaggcucuuggcggaaaagucgauggcagauggcacagcaacagucuccaccccguggcccuccucuuugugcucgugggcugcagcgcagcccaccagcccacccagcaccaccucugagaauuauucuucuaauaacguuauucuuccuuuugcauucagauaugcuuaagaaauuguacaguuccaaguagcucacuuagaacacccauuugcauguacuaacauaauguaaauauuaggcaguacagcauuguuauuugaauauucauugaaauguuuaaguccuaaacacuuccaaagcagauuuaaaaaauuauuuuucuagaauuguaauguguaaauaauucccugguauuucacguaguccagaaacauguccaagcaguugauguugaaucaaucuugcgagccuccaaaucaguaucacaagcuaacuguauuuguuuaauuucuucuuuuccuguauuugcucuuacaaaagggguauuggucaguaaaaugguauuaacauuuauuaaaugucaaaauauaaagaaagguaguaauuccaaauuauuaacaucuguuuuugguuuuauguuucuucuuuuuaggccaagacccauguucuugacauugagcagcgacuacaagguguaaucaagacucgaaauagagugacaggacugccguuaucuauugaaggacaugugcauuaccuuauacaggaagcuacugaugaaaacuuacuaugccagauguaucuugguuggacuccauauaugugaaaugaaauuauguaaaagaauauguuaauaaucuaaaaguaaugcauuugguaugaaucugugguuguaucuguucaauucuaaaguacaacauaaauuuacguucucagcaacuguuauuucucucugaucauuaauuauauguaaaauaauauacauucaguuauuaagaaauaaacugcuuucuuaauacauacugugcauuauaauuggagaaauagaauaucauguguucuuauggucaaaaacuauauuugcaagaaacaagcaagucuaauuucauuuuacaacuucuauugauuuccuuuuaaaaguccuagcuauuguaaggauucacuugaagaacaaaauuauauggaauaaauacugugggcaaggcguugugccagacuugugcauagagcuacccucuccugcccuccaggaagugacagucuaguaagagagauauauaaauauaaauagcauaucauuaaguucacuuaauaaaacuuuguuuuaaagugugauagggaaaaaauauaagccaagaagcgugaaugugaaaacgaaauaaacauucuguaauuugugugaugcugccauacugcagucccagaaugcagaauccaguggucaugaaagacagcgauacuuaacauuuccugagaucuuaaaauccaaaaaguauuaaauguuuaagguuuuucuguaaguuuucauccagaagacuuaaauacaaaguaacggguuaauacauucaaauaaguggaaaacucuuacauuuaaaacugauaauuucacuuaaguugauagaacucuccuuugcugugcgguugaaagugugauggggaaaaauaugauaaacccggaugcaagaaugucaaaacuaaacauuaaaugauuucguauccaaggucuuauguuaacaguugcggggggcggguacaugggaaauuuuuuugaacaauuuggaaaagaacguuuuuaaacguauguauuaagaaacguaaguuuaaauuccucagagaaaaaaaauuauugacaaaacaacaaacuaagccaaguaaaucaccagaucuuucgaaaucugaaugaaaaauacugagauuagcaacccuaggagacaagcggaacaaaaaucaguguucgauacccuucccacaccuucguacgguuuucaugccacuuccaaauccacuuagaaagcacaacucuaucauggggcauuuucgccccuaaguugcaacacaccagcaaaccuccgcagauucccugaccgccacuggacaguaccgcggccccggccgcgcgaggcccggagggcuaagccccgccccucggacggccucggauccugccgcucuaggcccgccgggcgcucucuauggucggccgggcgguguguugucauccgcggagcgacgaccggaggcugcggcggagccccggcggggcguuugguuucgguuuggcccugacugggauuaguguugacgaucgaaaugggaguccccaaguuuuacagauggaucucagagcgguaucccugucucagcgaaguggugaaagagcaucaggugggugagcgaggggcaacggcucagaaagccgaggacccggggcuccgcggcccucuccaccuuagagcuggggcuuucgagccaccucuuuccccucgucgucuggacgauuaguggcauuagggagggggacggaagguuugaggacgcccggaugagccgaaaggggcuaaggacgcagguugccuguguguggacagagccgcuggguucacggcuucucugacagcucuugcuucugcugguccuuccgcgacuccgaaaugaaguccugggaaagaacgcuuuuacuguucuccgguuuccucccggggagcugcaaguugccuuuuuccuuacagaggcugcgaagcuggaguggguguccucguagguucccccaucccacccagagcggcagacccacuuacagacgauaacagccgcuuccgcacgcagucaccuuguuuacuuucccugaucuagagcgcggcccacccggcccccggagccuagacuuuccgacguggcugauggucauauuggugaugccuuuuguuacuuucuguuauuucaaaagcagcaccaauccccuguugccaaaacaaaaaacucuugggccagcuggggaguggggcguaggaccuuuuauuuggaggccucacugugugacagaggggguugggaaacgaauugauagaacauuaauacuacuaauaauauuuggcauguacugaccccaggacaacguuaauguguagauuccgaaaacguaguuuauauauuggaacuguggaaagagaggagaaagcagucgucuauuagguaaacuagacuuugggugauacuuugguguuugucacauuuaaugaauuugaucucuuuucugaugcuuuacagaaaaaaagcuugaaauuuguguagcugauugaaucaguugugauggguaguauuguaaauagccuauuaaauuaugguuuaaucggcauuuacgaacaugaagguaguuuacuucuggaaaggaguuuuuguugcuggauuccaaucagauuugguagaugagaaauagacuacaaaaaguuuccaagguuagcuuaucuugaauuuauuugaaacauagauugaguuagguuuagagagguauuuuuuucccccggggagggcuaaaaaggaaaccaguacauugcagaaauggagacaaccaacuuuggcuuuucuugcauccuucagucaguaccugcuauauaucagucacuuuaucucuaaagugcaaaaauaaugcgauuguuauucgugaugauuuaauacauaauuuguucaguaauauuuuuauucuguagucuguggcacagaauuugguuuggugaaaauaucuuagauucucuccauccugaggaauuuuguuacugaagaaugaaaaucucuuuaaugcaguuuuaugacauggacacuaaggauagguuuugugaaagcuuuauauagaaacugggaggagaauuauuuuuaaauuucacuguaaauaaauuuuaaaauuugguucauuguugugauaccuuucaaaaauguuugauuaaaaagagaccaaagguuaucagcuucucuguuaaguagaacuuaaagaugguaaugccuaaauaagucacaggcauucaaaagcuaguccugggcgggaaggauagggagaagaaguaaguuacgggaagucagugguguggccucaguagcauagguuuucaguuucucugaaucaucuuguaaaaacagaaagagaaacuagaaaccaaaguuuaaaauccauaaaacaauuacaacaaaccaugugacaugcuauccccaugaaacucaaaacauaacuaggugaggcaaacuaucaauagucucuagacaccguugauauugccaucugugcaaaagcgagaaggaagcaauggggcaacaucugaugaaccuuagaacagaauuccagaauagccagcgguauccacuaaaagacugugcuggccaauuagauagcgguagcugaaacagaggaguuuuauucacuccauuauugacugggugaaggucuaccauaagaaagaccaaacaggcaggaguagucuaccuccugugaacacucaaaacugacuugccaaggugccauucuagaccagagcccuaaggaaaagggaguggaauaaagucuuacggaaauguuaugcuggaaguggaauaaaauuuuaugaaagggacaauagagacaagaagagaaggagauagaccauauaaaagugaggcaaagucauagaaucaagaaaucuuagaaaacaaaccacaaagcaaaccacuguauuuuuuaacacuacccagaaacagcuuugugaacuuauauucccugaaccucuacucauucuaaaaguucaagaaaauuaaauucacauaaaaaugagcuacagaaagguauugagaucaaauuacauaca

SEQ ID NO: 16089 - RNA, 2512 nt, Homo sapiens
uauuuucuguagugcuuuaugugaauuccucauuugaucuccauaguaacccuaugagauagcguccauuuugcagauuaggaaacugaaccauagagagguuaaaucuugccuaagaucaccaaccuaagaaucacacacaggcugcaccuuguuuuuuuuuuuuagaccgagccucacucuaucacccagacuggagugcaguggcaugaucuuggcucacugcaaccuccaccucccagguucaagugauucuccugccucagccuccugaguagcugggauuacaggcgcucaccaccacgcccggcuaauuuuguauuuuuaguagagacaggguuucaccauguuagcuaggcuggucucgaacucccgaccuccugugauccauccgccacagccucccaaagggcugggauuacaggcgugacccaccaugccugcccuggccugcgcuuuucacuacuacauuauuccgccucuauagaaguaggugaagugacuuuuucuuaccccuccaaguucccuucaggauuucuuuucucccuuguagaguccccuucuucccucuccccauuugcccaguacuaaguccuugaucuuuagcauucuugcuaaagauguuucccuuccccuuaucccagugaauucuccauuuuuugccuguuucaggcuggcucggcugcuccacacagcagaggguucugggagaugggaccagacccugggccaugcucugcaaccaccuccccaaggaaauaaguaaagaauuggccugccaucuuuacagcacuguagacccccugguguaguggaaagagcaugagacagcgugcaggaaggccuuagauucauuccaaauaauuuucaggacuaaauucaccucuugguccuaaagacagaaaaugucagccauggagcuuugaagggcaccaccuccuugaagagcggagguauuucacugaggagaauggaauuagaggcgcacgccagacuuuaagcacccacauuccauugcagccuccagcugaaaaaauuaauugccugcccuuuaugccauuugucuucugcaugugaacugccuccucagaguagggugggaggagagaacgcgccaagcagcguggagcagguccaaccacgcugaccucuuacagcuggguuuaacuccugcaguuacacagggcccugcgccucugucucagcagcaucagaaccgucuccuucagugcaugugaccagaaccgccaugcccagggcuguagggauugcccgaguaucagcaccucuuaguggagggguguguggguguguguguguguauguguuuuauccuuuucuggguuuuaccuuauuuuacuuuggguuuuauggugcccuuuccagacccacacagucaacaccuggucaggcaaaaaccaaguauacccagcauugggcgacaucgaacaacagaccucacgggguuuagcacgccuggcagugccagugccccucccccauccccucaggggcagcgggaaguccuucuaguacaguaaucucaagcuuagucccaucagggccaccugucaccaacagguguccagacauuggggaagguagacaccuuaaggugugauuaagaucccaagcccguccagauacccccuacauuguucuugcuguugggugcuggccucuuccauugacccuguagcugucacucugaaccgaacuggcagggcccaggcuggcccuggacagagucccaguguggcucuggacaaccaggaaccagacugugaccuucgcagugcagagaacauggaggggcuucugguggagcugagagggcacaguucaccucuuaacaguuuuacaaguccaugaaaaaguaugagugugcgcagguccuucaaggucaaggacacgagcaacccuccaccucccauuaaaucugaaaacuuggcaaccuccaauuccacuaucaaaagaaacggccgugucuucccuugggguggccgggccaggcuggauuagcgacgcagacggggagaaaggagccggagaggaagcuccgcgaucccggcgcggcccagcaaaagcacacuggcacgccgagccagaaaucgcccgcggaugccucuucccccagcucaucacaaaccagauccagucgacagcacaauccaaacagaagagggaaucagaauguacauguuuuguuugccguggcaggagaacuguugagcagaggaaaaaaacaagcugagcuuagcgcuaucagcuguuuccuggggcucucuccuuccuuccuccgaggggggccuggccgcuuuguucucguucccagcugcuccucugcgccuuuaagcaguggccuuugcagaccucggaggaaugcggcccugggaccccaggggacuuagcucgaggcuccgcccgccccgcaugcucggccccaggccgcagaaucaggagcgccgcagugucgcgcggaggccgcuccugccccuggcuucucagggcu

SEQ ID NO: 16090 - RNA, 128389 nt, Homo sapiens
cggggcgagucgggccgaggcccgggggcggggccaggcgcgcggcuggccugggccuaggccgcugcugggcuccgccucgcccggcuacgcaggcggcagggcugcggcacgggccgggcggcaccauggcggcggcggcgccugcugcugcggcggcuucuuccgaggcgccagcggcgagugcgacugcagagcccgaggccggggaccaggacagucgcgagguucgaguguugcagagccugcggggcaagaucuguaagcgggggcugggcugaggggacgcccuggcggcgcugggcgcgaggcugagggggcggcggguucgcggcgguggcggcgccgagcugcgcugggaucgcgggcccgggagggggccugggccgggcgcgguugaggcuggaaggggguguguuggggggcggcgucgccucgacggggcggcgugggccggggcugcugcucuccggagggagugggagcuggagaugggccuggggugggagagcccgggcugcgccggcgugaggggcucggucguggggagcggccuggacgcggggacgcuggaguccggggcgcggccgggggcgcgguccgggggcgugaggagcuuccggccgcccucagacucaggccuucgcgcggcugcgggcgcuggggaguggccccgcggugggagccgagcaguaauuauacggaggcgcggcccgaggagguggcgggcugggaaguggggcuggcccgaggggagggggcuguucguuuccugggcucggcgagccugggagagguugaaaaaggcgcccugagcugcaggaaacgggccgcccuggggcccgaguggcuaccgcgcggucuguucgcgggugagcgccccgggaggagcucggcgggacaccuguacuugccccaccucgcugcggccgggacuugaaucgagggacggcgugacaggcgggacuaaaggcaggauguaguggcuuccugugagcaggucucaaaacacaaucacccagcccgcacucagcccgcuuaauucccuuccuucucaugcguguaauugcuacuuuagugagcgagccuaccaguugacuaaauacgaaauuuugcucagaguuguccgagcauuacuguggacagauuauuugaguucugucauuugaacauuuuaguuuuaaaaacgacccuuuggugucagguugccauuuuuuuuuucacagugguuuauuuagaugaagugcuuuuuguuuucuguuuguaagagagaucaauaacauuuauuuuugcauuugucgaaaauuagcauuauuuucuucaugcaguauucucagauuggaaacaugcuucauguuucuuauaaauaacccucaauuaugagggcguacuuuucacuuugaagaaaauugacuugcauuaaaguggcuaacaauucuuuccugggcaggauguaaaauuuuccucuccucuaauaccaguacuguugagcucacauucucccacuuuuccucuuuucaggugguucacguauuugggauuuuaugaaaccucagaagcagacauguuaacuuuucuuaucuuuuuauucccugagguaguccuggggcucuuaagagauuacaguucuuaaaaccuggaaagugacaccagagagguagaucuuaguucccaaaauuaaaguuacuuucuagggcauaaaaccuuuucagaauucagauuaaauuuuauuuauuuuuucuuuuuucuguaaccuuauauuugaggggaaaauuuuguuuucaacuuuugcauauaucuaauuuaacauuugggaaaacuguaaaugggccaaaguuucucccuuuauaugauuuuccagauuuuuaccacuuucuuagugccacuugaugcuaggcauugucuauuggagacucacugguacguaacugcagguuuuaccauggaacuacauauacacaugucuuggaauugaggguuaggguuuccagaaggacuuaguuguccugugcuuuugucugccccaugccaaagaccacuaagaacaguuuuguaagugaaacuugggucuacacguuaaaaaaaagaaaaacaaaaaaccacuuuguuucuaugguuuaaagcaacccuggcuuggaaauugaucauccagcugcugggaaugauauuacugcuuuaaccacaguugaaguauucuaucuguuauccuagucaguuucuugcuuuuuaaauugcuuaucuuauagcucagguuauggagugucugcuuucuagaaaaaaaaaauguauuuguauacuuauauacagaagcucucuucccauuucuuuguccuccuuuuaaaugauguaauccacaguugguugacauucagaaccuugugaagagaugcuguuuucuguuucccugaaacuaacauguggguuuuguaggguggggacugagggguuggaagagucauuagcaggugucaaggucacagaaaugagaugguggugguucugacaagauauuaagcagcuuggggaggguguaaccgugucagcuuuucucuucaccacaguaggaaaccuuggaagaaagccugauagugcccacuaggagaugugcuggcagauuuuauacuacugauugagagccucuuuucuggagaguuagagaucuguaggggcugaaaauuagccugaagaaauuuucuuauuucuggacuugcauaggacuuuuaaacugcacaucaccccagugaaaagugaggauggauugguuuauguaucuugaauguucaagagauaauaguccauaaccuucuuuagggauuucauuccuguaauuauuuccccuuauacuucacaaggugaaauaucugucaguuggacagauauuugucuauuggacaagaggaaacuuaacaaaaagugguaaccaaaaagguggaggucacaaaauaacaacaugagaccucaauauauauaaaggaugaagccccaauaccccuuuuuugcuugaguguacuuuuuuuuuuuuuuuugccggggggcuggggaggagggaagaagggacaugcaaauauguuucagguguuuuauaugcgcucaaacgaacccagggaauucgagauccaucuauaagacaaaauauugucagcaacccuggauuugcugcaguuugcgcuaggaaaccaugacaguucugaauugucugcuuccuuaaacuuuuucaagaggugaguuugguuguuugauauccuaagguugucauaugaacccuugauaaaggaaauuagggguguacucgacuccauucuucggucugcacuccuguguagcgaguagcaaguaugcuagaacaccugaaacacauuugcaugcucccuccuccccucaaaaaaaaaaaaaaaaaaaaaaccguauucaaacagaaaagagggauuggggcuuccuccuuuauguaucuucaggcuucaugcuguuauuuggugaccuccuuuuugauuagcacuuguuaaguuuccucuuauccaauuacauuagauuguaaaaauguugcggagagcacccaugccaccauaugugugggcuuaucuacucaaggaauaccagaucaauaagagagccaaaugggaaaauuuugugugaauuuucagaugugugguacagugcgagaucugugggacuauguguuccaaaacucacuuaguuucucuggugucuucagaccaagaauagccuaggguuauuugacagaguagggaagaucuauaggguaugguuaagugcuugagcuuagaggcugggugaaaaaguuaguuaccuggguuugaaucuucaccuaauuuccaacuuuuguuaaugucuuugggccuucauauucucauauauaaaauggggauaguaaaaauaccuaucucacggguuguuaugagguuuaaauaagccucccucccuacucugccccuccucaucucugccugcucuuucucacuccccaggaucugggucauacaccgaccaucucuuaggaaggaguaaaguaggagauaaaaacuaaucuucaucugauguucuuguccaauguauacuggaguuuccagguguacaaagcugauuaaaaucugaagaccuauauucuucuuuaaacguuguuaauuaaucuucauauggcguuagccagcucacuuaucuugaagcuuaccuuccgcaucuuuuaaaugggaaugaugcuuuuccacuauccauuguauacagguuguucccucugcuugggauugucuuucuucuuuacuccaccccaucuuuaugucaggaagcuccuacucaucccucaaaagccugcucuaugugaucuccuucccaaaaccuucugagacacuuccagugccaucucuggccagcaucucugcugcuggggaacacaauuccuugcucauuuccuuauuauagcacauuucauagaaaucauuuguucacuucuccuguuagauugugagcucuuucaagauagaauugauucuuguucauuuuuaaaaaaucaucccagugucagcacaaugccuagaacagaauaggccuuuagaauaugcccuaccucacaauguuauccuguggauaauuacuagauaugaaaguauuuuauaaauuauauaccuaaaaaaacuagaagguguuaguauuaagagaaaacuguaugagucugcaucaggaaguucaucccuuucaaaaucacagugcccacuaagcuuagguuugaauugaugccaaaguugccuuguuaggaaaaagauuaaauuuuucuuaaugcucugauuacuuauuauuagggcauuugaauauuguuacuaauugguccuggagcuuggaaaagaaaaucucauauucauacuuuacacauuaaguguuuuaauuugacaugacagguuugaauaaaaccgucuauuuaauucugugaaguauaaaucaaaacauuuuauugacuauccaguaaaguugaguggaagagauuaaaaaggguguauucaugcuaagaguucauuuuuaucagauauuugaaaugagaugaugaguuauuuaggauggaggaagaauccaucuuucagauggauagaaacuggggagaaaaggguucuuuguaaaaguucacagagcagucugcuaaucauuugcucuguggaagacgggagguaaaccucagugaguucauagaguuguuuuuuuaaaacuuagaacucuuugaauagauccuuaagugacuaauauagccagaauaaaaccaucauuuuauccuuuaaucauagcugcuaauccuauuuccuuguuaaugugcuuuaugaaauuauuugacaauaauaucagauuacauguuuuugcuacuaauaaaguucuauucucuuuugagaacugcaaacaaaauguuguauagucauauauucauguaaguuaagcuuuuuauguguauuaagacauuuuuauggcaucucuuuagguuuguauguaauuuuaguuaucaaaaaccccuaucuaaagugauaaacauuaaaaguuuguaucaguacacauacagagaaccauaaaugacaaauuuguuuuccugucauuaaugacaaugacuuugggcaaauucuuuaaccuugcugagcccguauuuccuuacuuguaaaauuagagguuuggauauggucuuuaacaucccuucuaccauuuugauuauugcuuuuuaacuugaaccauuugcuuuaaggcaguacaucagaugcuuuauuuuaguguuuaaauguauuuaguacacuuguuuugcaugauucacuguuuuaaaaauauuuaagauuuauuagauaagagcguuugaauucuaaauuuuuuuucugugacuguuaauuaauucagcagcacguaauacauaucgaagggucuguuaagagacgcuaacccacuggacugaaaugggccuaagcugugaaucggaugaaagauccuauuuuauccuaaagucuauacuaagcaauagcuguuuuuagacaucuguauucuuagacaauuauagaaauuuaaagcuggaagguagagaacaugaagguagagaaaauaaagguucuuacccuucauuuuacaaaugaagaaucuaacagagacagcaagugucacacaguugauggccuguucggcacuaguccacuauuaucaaaguucuuucuagaaugcuauaugagauuaacuuauuacuaugaauguugcaaauguacuacauuuaauacacagagauuauacuacuuaucuguuuauauauugagaggugguaagauuuucacugugccgucuacacacucuuaacuguuccuucuuaagaacuuugugaagugguuaggauuagugaugaaacuaugguuaugaccuagguggagauugaaccuggauguuuaguuacuugugccauggucuaccucagcuauuuucaguucugacugucugucaccaucaccugugaacuaaaaaaauuaugaugcccagacuguaccccagaccuacuaagucagaauuucugguuucaaaaguuccauagggggugauguugggcagcuaggauagugaauuucugcuuuugucacaaauagauuagccacauacccuaccuaaaugauggcaaccugcugugcuaucauuuaaaagguaucaguagaaagguugguauaguuacagugagauuuuaguuuguuugcauauauauuugauauauuaauucuauuugauuagauaauaugaacacuugguacaaaauucaagagguacaaaacaguauauacauugaaaaguauuccuuccuuucauuaucuucuagccauucccucccaagaagcaagcauuaccaauuuguuauauccuuuuuguuguguguucuuccagaaauuaagcauuuacaaacauaaauuuaugugcacuaauauauuccuuccaccaacauacaaauuauagcaaaauauauacauuuuucuguaucuugcuuuuuuacacuuaacaacauagcuugaagauuuuuucacauucacauaaagagagaucugccuuauuuuuuaaacaacugcauaauauuucaucauuuggcuguaccacaguuuauuuagccaguccccuauuaguugacacuuagguuguaaacagucauugcuauuacagacauuacuacaaugaauaaccuuguaagcaugucauuuuuaauaugagugucuuuuuguaggauacauuucuagauagauguuaaauugaugaauugaaggauaugugcauuuuuauuuuggaaagacaaugcuaaacuauagcaauuuaagcucucaccagcaauguaugacugccuauuucuuuauacccacguaggguguauuuuaaaacuucuuaaucuuuacuggucuaugaaauaaaaaggaacauuuaauuuguaguuuuaauuugcacuuuuaaaugagagugaggauugcucugucaccagggcacgaucuuggcucacugcaaccuccgccucccggguucaagcgauucuccugccucagccucccgaguagcugggauuacaggcaugugccaccacgcccagcuaauuuuuguauuuuugguagagacgggguuucaccauguuggccaggauggucucgaucuccugaucucgugaucugccugcuucagccucccaaagugcugggauuacagccgugaaccacugcgccuggcccuaauuuuuaaauuuuaaauuuuucuaaggcuugaaauuaaguuauaggaucucuucauauuuuuaagagccuuuuuuuuugaugugcuaugugaacuggucuauuucuuuuguccuuuuuuuucuggugaguuacagucuucuugauuugugagaaaaugcuuuaugcuguaaggaaguuagcuauuauuuuaaaaccugugcaaagauuuaaaaaaucuguauacuuuggcugaugccugaauuuauucuuaaguugauugugagauccagugagggcagucaguuguaaguuucaucuacuuauauaacgucugaugguugagaaauugagaaagaacugcuugaggaaagguaagugaagacuuauaaacaaaaguuaaaagacaauagauugggagaaaauauuugcaguguauccuucagacaaaggaaauguguauaacacugaauucuuugccaggcacuguuuuaaagcacuuuaugcguauuaacuaauuuaauccuuacaguaacucuaaaaauaccauuauuauccccauuuuacacauuaugaggaaacagauacacaauagcuaagcuaaguaaauugaccaagguuagauggcuggugaaugguggagcuaucaaucagacugggcagauuggcucuagaguccauccuguuaacucuuaaccuacugugcuauuaugccucucuauuuauuauguccagauuauauaaauaauucauacagacuuaaaaacaagaggccauuagaaaaauaaaggauacgaauaggcaucucacaggaaaggaaauacaaauguccaguaaacaugaaaauauugguaaaguaaaaauuaaucagggaaauaaaauuuuaaaacaucaauuuacaaaaaaaggaaaguuuaucucagucuuuggugaggguuuagggaaauaaguauuuuccucauuguuguugugaguuuaaauugauaaagcaauguuggagagcauuuuggcuauaucuguuaagaauuuaaaugucuauacaccaugcauuuuuacuucuaccuauuugcccugcaucaacaguuguacauuuagagaagaggcauauacaaagauauucaauguugccuuguugguaaaacagaauaauuggagacgacuuaaauguacaucgguaggaaaauggauaauauguucauacacguauucuauagcaacuaaaaagaaugagguauaucuauguuaugaaaggaaagaacuccaggaugucuuguuggguaaaaacagcaaguuguagaauaauauguguaguauccuguguauuguuuuaaaucucaaaacauuuuacuuuucugcauguagauggauaaauacauaaaaagaggucugaacaguuguacagauaacagugauugccucaaugguggauaaagggaguuagccggugcugggaaaacuggcuaggcauguguagaaagcugaaacuggaacccuuccuuacaccuuguacaaaaauuaauucaagauggauuaaagacuuaaauguuagaccuaaaaccguaaaaacccuagaagaaaaccuaggcaauaccauucaggacauaggcaugggcaaggacuucauguccaaaacaccaaaagcaauggcaacaaaagccaaaauugacaaaugggaucucauuaaacuaaagagcuucugcacagcaaaaaaaacuaccaucagagugaacaggcaaccuacagaaugggagaaaaauuuugcaaucuacucaucugacaaagggcuaauauccagaaucuacaaagaacucaaacaaauuuacaagaaaaaaacaaccccaugaaaaagugggugaaggauaugaacagacacuucucaaaagaagacauuuaugcagccaacagacauaugaaauaaugcuuaucaucacuggccaucagagaaaugcaaaucaaaaccacaaugagauacuaucucacaccaguuagaauggcgaucauuaaaaagucaggaaacaacaggugcuggagaggauguggagaaauaggaacacuuuuacacuguuggugggacuguaaacuaguucaacuguuguggaagucaguguggcgauuccucagggaucuagaacuagaaauaccauuugacccagccaucccauuacuggguguauacccaaaggauuauaaaucaugcugcuacaaagacacaugcacacguauguuuauugcggcauuauucacaauagcaaagacuuggaaccaacccacauguccaucagugauagacuggguuaacaaaauguggcacauauacaccauggaauacuaugcagccauaaaaauggaugaauucauguccuuuguagggacauggaugaagcuggaaaccaucauucucagcaaacuaucacaaggacgaaaaaccaaacaccacauguucucacucauaggugggaauugaacaaugagaacacuuggacacaggaaggggaacaucacacaccggggccugucgugggguggggggagaggggaggggggagggauaacauuaggagauauaccuaauguaaaugacgaauuaaugggugcagcacaccaauauggcacauguauacauauguaacaaaccugcacauugugcacauguacccuaaaacguaaaguauaauaaaaaaaaaaaaagagcgaguuagccuuaucuguaaugguuugauuuccuauagggaguauauuuauauauuauauuaucaaaaguaacuauuuauauaaaugaacuugauacaguauuaaucuuaagcugugccagucucuguugcucuacuuuggaagacuauccuaucugcaaaacaagaguaaucaaauguuagguuuuguaacauuuugagugcuauagaagaaauaaagucaacuuuucuguuaaguuuuuuugguaacuuuugauauaauuucaaacuuacaaauuguaagaauaggcugaggaggguggauggcuugagcucaggaguuugagaccagccugggccacauggcaaaacuccguuucuacaaacgaaaaaaaaaaaaaaaugccaggcauaguggugugugucuucagcccuagcuauuaauacuuggaaugcugaggccagagaaucacuugagcccaggagguugaggcugcggugagcugaggucgcaccacugcacuccagccugggugacaaagugagacccugucucaaaaaaaaaaaaaaaguagaaauaauacagcaaauucuuauauacuuugccuguuugacuaauuguuuauguuagaaaaacuuuuuaaaauuuuaauacauuguuucagagaaaugugguaaaaagggucugaaaauuuuggauccuuuaaaauaugacauuugugugagugguacagaauuuuaguuuugaauuuuacaguuuuauauaaaauauucuugguagauggggugaacuaauguuuauugaguauuuccugguuuccagauguuguguuaggauacuuugcaaaauauuucauguaauccaauuucaugaagaagauuguuauuccuauuuuagagaagaagcaacagacagagguuauuugcucaggauuguaagggagcagagccaaguuuucagaaagucuuuauguuaccaaagcccacaucccuuucucuacaaagcugccugugagaugauauauuggaaggaauugaugaauacauuuauguugucaagaaguugauaauuacuccuaaauuggcuauggucuaauguaguggauauucaauaaaauuaugauguuugaaugccauaagaauuuaucuucuggccuguuuuggggguucaugaauguaauuauuuuagcugccuaacugcuuauguggguuuguauguacuuuugagugguucuuggauauguguacacacauacauacacacacacagauauacacauacacaccuuuauaugcucauggguguaacuucuuuaugugucuaggugucuuuuuuuuguggagggggggcgaagaucaauaugaauccuauuuuggcccccuggaugcugucaccagaaauaacagccauaucccauauauagccuguccauguagcccugaguucugccagcaccuggcuuuuugccuuccuuuuguuugucauaccaggcucucuuggucaccuugguagccuugcuaagcuucuuguagcuauagguaccauuggcuuagcccagaagagauuccugccauauguacuucagaguuugguuugccacuugaggaaggggucuguagggagcuuguagaucagcacacauucaaaacugaaaccggaagugggcaaggcaaaccacaggaagauccugcccgcaacuuggugacguaucuauauaacccauagacacuuccuggcaauaccuugugaaacuugccuuuucguguauaguaguuuccuaacuucuuguucuagauuaagcuucagugaaaagugauuaauaugauagcaguguagauaacuguaugauaguuauugugcacaugacuuccaugcagcaacuagccccgauuauguucuguagacuuuaucacugaggaguugcagugguauuuaugcguuuacuuugacuuugucuugucacuagccauugucuuacuuauguguaauuguacuuauauauaguucagguuuuauacccacaaaaacccuugugauauaauaccacuauacaggauugccuuauuuauguggaauuguacuuauauauaguucagguuuuauagccacacacacacacacgaaaaaacaguucuuugcuucacugagucucggcuagccacccaaacugugucauauuccuagaguccugugcccacucaaguguuugcucacugguacuaccucauuuuaucauagugccuuguucuuaggcagaaccagauuucugguaggaguuauuuaauguguugauuuuuuuuuugagacggagucucccucugucaccaggcuggagugcaguggugcgaucucagcucacugcaaccuccaccucccagguucgacaauucuccugccucagccucccgauuagcugggacugcaggugcacgccaccacauccagcuaauuuuuguguuuuuaguagaggcggcauuucgccauguuagccaggauggucucgaucuccugacccgcccaccucggccucccaaagugcugggauuacaggcaugagccaccgugccuggccaauguguuguuuuuuuaaagauuaccaaucgagugggauuauagacucuuggauuauuuuacagauacaagucauuugccaggagugaggaaaauugcuugacaacugaguuaucucaccauguuaauuuaugcauuggaaaacucugcuuagugguagauauuccagcagucaccauaugccuauugguacuauuucucauucucugucugauuaaugucacaaauguguaacuuuccagugguguuuucaagaugacaguuaaggagccacuaaggaaggaaauaacagcuacauaacuuuuuucuuuucaguaguucuugacaguccccccuccuuuuuuuguuuuuguuucuucauacccugcagcaaucugauguacucugaaggggguaaauuugagacucuuuggaaggucaugugugauaaagacaguucuucucuuccuuucuccauucagaacuguuaaagauaaaucaaugggaguguuuuuuucuuguguaagauuuauuauauacaaaauauuuuuuaagugugugaaaacugauuaaaugauaaaggcuaagguagcauguuuaaagcaugguuuucugcuacuuuucuacuaaucacuuaaccucucugagccucagcuuccuugucuacaaauuaggaauaguaguuuuacuaaucauauagcauaguugugaaaagguuaaaugacucgguauacugccuggcauuuugugcucaguuaaguguugguucuaacaugagcaguagugauacucauaaaguaucuuuucauaguuuucuuaauggauaacuuauuugauagaaauguacuggaguauucauacuuacauguauauccaguucuuguaguguucaucagguuaaacuggcaauaaguguuaauaucugaaagcauuagaaaucaguguuacucugugcuuuuuaaauuucaaguguugucucucagauuuuauuuuuuuauuuuuuauuuuuuuugucucucagauuuuagagcuauagagaaccuagaagauuaacuggcuaaggaguugcaaacucaaauauacacagaccagguauaaugcaguaaagcccagcagagauuauuaugauuuaguaagauacaccugucugcaguuuccacucaaaaucauuuugccagauuuugauuauuaaagagaaaccagaaauacaaauuuauuuauuguuagcucucaguuucuagauggucacaaauuauuuuuuaaauuuggugcaggccaaacaaaucucuggcuagccaaccucagauuuguauccucauuuuagagauguggagcuugagguauaaagguuggacguguuuccauguauuuccuauaauagaaauccauugauucuguaacaaaggacucauuuuaaacaaugaccuccucuguuauacccaguuguuauauuacagguuauuuuuggucaggagcuaauggcuuggaugaagggaauuguauauagaugcuaauuuuuaagaaugucuagccaagaaagggcacuaauaguuacuauccauugaauauuuacucugucuuaggcauugugccaagcgcuuuaccuuaguuaaugcucacaacaaucuugaagcauuauaguuaccucuuuuuacauaagagguugagaguaaggacauacagauaguuaaaugcaaaguucauguugaaacgcagaugucugccucuguaaugcauucauuuaacuugcuauacuauacuaguacuguauauguuuuuauaauuaugcauaccuuuuaucauauugcaaaaauugaaauuaaacuuuagaagaaaauuucaaagaccuuaugauauauuaccauuauauaggguugucuuauuuauauggaauuagauuggcacaacagcauuuuaauuuuacucuaaacuagucaauaccagagacuauaucauauuuuuaaaugugcauuagauucauucuuucucacucuuuuuuuuuuguuguuguugugaauguaaaugacaaaaugugcauauuuuauaucuuuucaucuccugaaguucuacuguucuguuuagguugauauuucuauuacugguugagcauuccaaauuucaaaguccaaaauuccaaaugcuccaggaugcaaaacugagcaccaacaugauucucaaaggaaauacucauuggagcauuucagauuuucagauuugggaugcacaacugguaaguauauauaaugcaacauuucaaaauguaaaaacauuugaaaucugaaauacuucugguccuaagcauuucagauaagggauauucgaucuguauuagaacauuauguccugagucauucaagccaguuaaugccaaauucuguggauucugucuccauaguagcucuucuauuuuuucuuuccuccuaucucccuuuguuaccuuaauguaggcucuucagacuaucagaguacuuuuccugaaguaugaaccacacagaaacuuuuagcgacccuuguugccuacugaauaaaguuaaaccuuagcuuggcauuuuagguucucuguuugauacuagcuguccuuuauaaucuuuucccucucauucccccuucaucucucuuuaugcuuuagucaguuuauacuauucacugccuccucgauggugcucuucuuguugccacccuccagaacuuguucauguuaugccuuccuccuggaacguuauccuccgauccccaauuucuguauuuugaaaauauauaucauucagaagaguuauugugaagauuaaguaaaauaauauauaugaagucaaugaaaaaucuguguaauacauguauuaauuuauucaguaagugguagcuauuauuaugauuuggcuuucugucaccccaaauaauccuuaacuuuggaucaucuuguccaggacccuggcucuuugcaguuuuucuaggggauuaaucccacugggacccauguuggcgccuacccuuguacuucagguaaccuuugaagcagaccuggaccuacuacaucucuuucagaugggaauaguuucucagcacagcuguauucagaaagaccuuaagaguugaauagaaagacucuaggcuuuggaguuugauuuaugccagauaaccuuaccagcuauguaacugaauuuuuuuuucuuaauuuaugaaagggaauaguaaugcuuaucucacaggguugucguaccgaucaaaugaaacauuugagaaaauauuuaacacugucuuggagcaucuaacuacuuaauaaaucuuuaucuucuuuucugucuuaucccuguaguguccuccccuaggacaugaagaaacauacaugcaaaccuucagguauaaaugcaugcacauaauccucaaacauccacauaggcacauagguacauacucacauauguacauacucacauacaugaacagaagcauauacaucagaaucucuaccuuugauaguagccugauauuggaauuuuuguccuagauaaaauuuauaugguaggauuugaauuuacugucugaugacuguuacauggaaucauugaucuuguacauagagaguuggcuguuuuuccauuucuguuaaucuuaacaguuuugauuugaugguguuuaucuuucgcgcuuuaaacuauuuacuuuuuaacaauaucuaaaagcugcuguuuucuauaguuacaugucucuccucuuuuuucagguauuuaugcagaaguuacuuucucaaugaagccuuccuugagcuaccucauuucuuguggugcccauacuuauuaguauuaggccauacauuuuuacuuauuuaucuuauuuguugucgaucucuccauguguguuagccuaauaaggacacagacuuuuugucuguuuugcucacugucauauccuagcagcuuaguagguacucaguaaauauuugaaugugugaacuucagcacugguuuauuuucaaaacgucucuguauuaauacaauaaagauucuuuaagugcuuuugguaacuguauacaggagacuuuuuaaaaaaucuuuggaguaguugacauaaaucaacuuaaaugaaauggaaaaaagaaguuuacauacaauuuuaugguuugugaugugguauuggaaccucuuuuuugcccaugccaaaguuauauacacacgcauugauacuuauucagcagcuguuucauuauauauuuuaugcuaaggauggugcuaagaauugguccccuuccucaagaaguuuauaguucagugaagagacaaccaaacugcuuuugcuugguugugucucaucuuuaccaccucaaaacauuagagagcccugaggcucagucuucaaauuucuuuucuauauuugcucccauugugauuuuguauugucucuugguuuuguaaauuuuauguacuuacugaugauucucaaauuuuuucucuaucuaggacccuuuguccuuggacagauugucugcacuuggauguauaaggcaucucagauuuaauauucaauacagucucuugaauuugguccccaacaagaggcugugucucuagaaauagcaucucuauucauccagcugcucagacuaagacucuuagaagucauucuugacuacucuauuucucacacccugcaguaaauccuguuggcuccaucuucaaaauacaugcccaaaugacccauucucuccagacccgugucugcucugccccuccccugaccugcaaguuuucgcucauugagauuacuacaguagccuccuaucuagucaccugcuucuaccuuuccccucugcacugauuuuaaaacaaaaaaucuugccauuuuuaugcugaaaauccuucaaaaccuuaccaucugacacacaaaaaaagccuaagacuuucccgugccuguaagaccuuauuuaaccugucuccucccauacccuuacuccaucucuuacuaucuccucccucuccccacuuugcuuauugcuuuguagccauacugcccuccuugccacuccuccagugugccaaacuauccugucucagggccuuugcacauuuuauucuuucugccuguccgucuccuuccccagauaucuguauggcuuauacccucaaugacuuccuucagguaucugcuuaaauauuuuaauugaaaggccuucccugcuucccuauauaaaauaacauugaccuccucccugucucuacccucugggccugccauucccuaacucucuuaaccugcuuuguuuucuugaauagcaauaaauauuuauuucuuccaugacaauaaauacuauaugcuuauuuaagaguuugugguauuugucgucccuguauauauuguacaacaguuucguaugggcagagaccuguuuuuauucacuguuauauccccagcacuuagaacagugccucguguguuuaggcacuuaguaaauauuuguugagugaaaugcaacaaguacaaaacaauaugaucacuguaguagagaugcaagguacaguagaaacacaugggaaagagugacaugacuacauaggaauugaggaagacuuugcaaagaugcccuuaagcagagcucuuuggagagaaaaacagguagggcauuucauacaaagaaaauagcauugcagauacacagaggaaugagagaacaguguguucaaggaacuaaaauauaguacugcuacagcauaauuuguggggguaaagaugaacuagaugagguugaacauguaguagauagcaccugaucauggagggauggaggguuuuugugccagacuaaggaauuuuagauuuuguccugucaagugggcagugguagauagugugagccauugaagacuucuaagcaagggauguuuuauuuauauuuauuuauacgugucucuguguuuguguguguguguguguguacguauuaaaaagguaacuagcaacauugugaagguugaguaucaaagcuaaacacagcauuuuauuuaagauauguaugauuuaggaagauaugauguagaaaaacaauuacuaucacaugugggcgagaggauauuucauuuuauauuuggacaaaaucauggauguauagugggaagauguucuuggcauacuugcaguacauuugugaaagagaagaaaugcacaauggaggauuauucuguuugucuuugaaaauccacccuuuaagaaagaagacuuuaaaaaauuaguuaacaguuauguuguaagucguaauguacacuagaaaagugcuuaaggaguaccaguuaugaaucaacaagaaaagauguuacagaauaaaauaaauugugcuugaaugucaaccuccuuucuucguagaggaacaguugguugucauugauauaccuccugaucuugauuuauuguugaaggaaauagugacaguuguacacacaaucaaaucuauacuguuugcugugggaacaauguaucugccuuuguaggacaaaugucugcuuuugcauauugcaggacuccgcaugcacagaauuuuugaaaugagggaugaacuauaaaaacauuucuuccuuucauucaaaugcaaguaaaaaccauuuuuauuauuucagcuggcuugcuugugucauaucuuagcaauauauugaauuucuugaauacuuuauucuuauuaauuuagggucaaacuaugauuugugaauuuaaggauaaaauagaggcacccaaaauggugcacacgauuugaauguuaagaauuuggauuuggcacucccagccaggcaugguagcucacgccuauaaucccagcacuuugggaggccaaggcaggcagaucucuugaacccaggaguucaagaccagccugggcaacauggcaaaacccugccucuccauaaaauacaaagcaaauuagucaggcauggugguaugugucuguagucccagcuacucgggaggcugaggugacagaaucacgugaguccaggaaggcgaggcugcagugagccaugauugugccacugcacuccagcgugggcgacagagcgagacccugucucaaaaaaaaaaaaaaaaagaaaaagaaaaaagaauuuggcauuccaaauucaugaaaauaugaauacuguauuauugaauauauuuuuaaaauuuuauccaaaugcuacagaagaugaagaaauauuuugugaagguagauacaacuauauauggaguuaagauccauuucccaaguuaaaggauucccuuuuuaagugugcugcuauucaacucacuaucugauggaacaaugaaaauaauuuucagugaaaaauugcuugguaauuucuguguccauguuugauccagauagccacguguagccgguggauuuacccaaccaugaugaccaguaacucaaagugggauuuucuaauuuguuggaaacaaagguuagaaaagaauugagauuaggugacagcaucaacucuaguuaguuuaagcagaaagagcuuuaauaaaaaaauuuuaaguggcuuacaaaauuguugacaaggcugaagaaacagacucuagaucuagaaaaagccauguugcaucuaggccaccaagagaguuauugccucuuuuaggaucagaaagacuuuugcagaauugugaaacuguaacuuuuagaugccugucuuagaaccuuaccaccucugccaugaucaggagucuacuacuguuaggaaauagccauuagcaagcagccaccuuccucaguaagccguuguuguugcuggcccuagagccaagcccugccuaccacaaccuguacugcagaauggaugccuugugccuuucuuaauauucaugaaaucugugacugaauacuaggacuucaacaaauacugcugugaacaugaacaucuccaugacaauguuugcuaguaaaacaacccaaacucaaccucccuucucuucuguccuugaaauuucuagugagugcaucugguugguggaacuuaaaucacauuuacaacuguagccacaagagaggcugggaaauguauuuuuuaacuuucucuucucugcagcacaggaagacauacacugaaggagguugaaauggaugugaacaguaaucuaccauauuuacugcagguuuagaaccugguucuccuuaaggcuggcugucauuaaacgggcuauagauaaguugagaaaguuuauaaauaauaccgucaaacaauguugagaaacucauuuguuucuuuguauauuuuuauuguuuuauaaugacuacauuaaaaaaaaaacuagaauuuguccuucaccucuaugaugaauuaaguggucuguggauaccgaaaguuuccucacguuuaagaugugguuaguggauaaaaagaccaaaagagggaguauaagaaaaacccucauacaagguuaccugagcugaggaaagguuaguguugucaaauaaugaagaguggucaaauaaggugggacugaaaagcaguguuacgauuugggcacuuaauauuagugguuuuuuggguuuuuuuuuucuuucuuuacuauugagacagggucuugcucuuuugucccaggcuggagugcaguggcagcucacugcaacucccauccccugggcucaagccauccucacaccucagccucccaaguagcugggaccacaggcaugcaccaccacgccuggcuaauuuuuuguauuuuuaguagagaugagaucucaccauguugccaaggcugguuucaaaauccuguucucaagcaguuugcccaccuuggccucccaaaguguugggauuacaggcaugaccacugcgcccagccuguuaguguucuucaagguucuaaacaagaaguagagaaguaggauaagagggcaaguugcagguuuaggcugugaguugaagggagcacuugaaaggagagauuauagaauaaguuuucaagaaauuuggcaauggauuuuuuuuuuuuuugguccaaggcgcaugcucauuuauauaccagaauuggcuagaguucaugaggcccugaacaaauaucacacacaagcaaguacagucuuccaaaguucuucacuuuugucuuuuuguguagcuugauguaaaguguggcucuuaacauauucucuuuaugcuuagagauauaauaggcacaauauuacuuuuauuauaucuguaaccauuacuuccuuuuugauuauguuguuuauaaagugccaauuaaucacuacuauaguuuggaguuacaguaucugacuuaacauauuuguacaauugauuguugagccgggcauugauuagaugaauuaacuuucaacaaaguuuauuugaacuucagucauugguggauauuuaagaaguacagauuaugauaacugcuuuuauaggaaaggaugcuugguacauuuuuucauaugacauagaucuuacauuuuuauuuauucuggauaaauaucugauaaugucagguucauuggauucuucaaaauaaccucauugucucucucuuaagagggagagggaaguagaauauguguaaauuuauauaauguuguuuucucaaaacugcaccuaugugaaugaaacagaaacauguucagggacaguuaguguuucaaauucucccaauuagauauggagcauauuuauuauggagcauauuuauuaaguagaaaauuauuauggucuaauuccaaauuuuuuauauuuuagguccuauauugcgaccuaguuggacuuucguuuaaaaaaaagucuaaauuaugcagaagggagacgucaaagaaaaaggagagacugaagaacaagaaggcugaaaguaaugaaaauagaauugcuagacaguguccuggagggacaagagggaaugggguagagagagcacagguaaauggaugagcuuuggaugagaagaggaauaacuagucuuuggaggaagaggaaaauggaugaauaccgguucagauauagauuauuugucuuagugaccugguuuauuuguaaggacuaacccauuuuaggcaguuaauuaaauuaaucauuuaaaaggugagauuccucaauucugacuugagauggaccuaaauuuguuuauucuguuuaaguaguaacuuuauuuuuuuagugacagauuuaagaaguaucuuacugguacuauuccauugguuuucuuauuucaauuuuauaaauaauguguuuacugaguuuuuuuauaggugcuucuuagguuucuaauagacuucucuaaaauauauugguuuaaauggccuuuaaaguugauaagcagaaagauacuugaguuuaucuaguccaaaccuucaucaggaaagcugugauugagugauuugucugaagucauacagccacuuaguagcagaguaagagaggaauauugguuuuaugguucuugggguaaugcuguuucccuuaugccaacugauugcauaagggaacuaguguacugauuucagcgcccauacuuguguauguccuuugagcuagaguaucaaaggacuucaaaacuucaaaacuagacuuuuuagguuauuuaauauuccuucaacaaauguuucucagcugucuaccguaugacagucacuguuuaagaucuugaagaucaacaaguucuugggccucaagaaugagggaaccaaaaaauaaacacugaauuaaaaaugaacagaaauuuagauaaucaucagugcuaucaaagaaacaaaauggagaaauagaauaugguagcagaacuaugugcuuuagauagaauagucaaggaagauuucucugaguuagugauauuugagcugagacugaaugauaaggcacucgccauugaagauaucuaggaguguagcauuccagacaaaagcccuaaacuugaacaugguguggcacaguugaugaaugaaaaaaacuaaacacugaccgggguugggggaauggaaggagaagagaucagagagaccauuaaguagggcuuuguagacugugguauagaaagauaauuuuauucuaagugaaauggugugguauuggaggaggagagugagugaguaaccuaaagaauauguuucaaauaucacacugcuugauggagaauggauuguaggagggccaaaaguggaagcaggggcaccaguuaggcaacucucauguuuguucgaauaaaagauugugguggcuuggacucggugauucuggucaaggcaaagagaacugguuggauuugggauuuauuuuggaggucugcuggauuugcuaagagacuggguaugggaguuuggggaaauagaggauggugagaguaagagagaaaaaugguagacuggggaaagggcacaucuuggggaaagaaaucagaugguuuuucugggacuuguuaaauuugaaaugccuacuggauauccaaggagacaguuaaauagucacaucuaguguuuguugaggagagguuagaccugguguugcagaucugggaggcguucgcauuaacaccauauacugcagaguuggcaaagagaaggaagagaaggugguuuggaauugaggcauugcauguuuagagguagccagggggagaagucagcagagagccagugacguaggagaaaagucagaaauacuguguuguggaagccaagagaagagagcauuuuaaagagggauauuuauguucacuuggguuaaaucaugcugccaggccggguaugaugaaaacagagaagugaccguugauuuggcaauguggaaggcauuaguguccucagcuagagcaguuuuaguggcaugguggggucagaagcugauuggagaggguugaagaaugaauggaagguaagaagagacaacgacuagagaugaugcuuuuaagaaguuuuuuuuccuuuucuuuuuguguguuuuuuuaaguugagaaauucccaucaucguuuauaugcugaugggaaugaucgcuagagaggaaaauuaauggugauuugggaaagaaagauuaauuguggaguaaaguccuugagguagcacugguggaaugggauagagagcacaaguagagggauuacccuuucauaggaguggggaugcaauuacguaauauaaaaaagggaccucaagccacuuuacacacagccccucccuucagucuuaacaaucuccuuuagaccagcuugaucuuucuguaaucacuaguguuuuuuuuuuuuucugugccacauuaauauguucuuucagauugaagucauccuauauaaggcuuaguaugaagcaguugaugauauuuaauaacaauuuuaaauuuuaugccaacaggugaagcaaaaaauuuauugccauaucuuggaccccacaaaaugagagauuguuucuguaccauaaauuuggaccaggaagaaguuuaucguacccaaguuguggaaaaaucuuuaagguugguagaaaaaauugguaaauuauaauuuuuacuauauagauugguaaauauuaugcauuuuccagauuauaauaaucaagaagacaagacagaaacagugcuugcuuucauguggcuuuucauugccucaaaauguaucuuccucuuaauuguuccuaauuuuaucuuuguuuucuggagaaaaguuuuuucacaugacaggcuaaauauugccuauucguuugaacuuuccucaaaguacaucuuuauuuuauuuaucuaaagaauaaguuacuuaaaguucauagaaguugcuuaacuuaguagugcauuaucagggaaugaauucucagauagaugucucaucuuugaaaguguaauugcccuuugagaguaucauauuaaauucuaauucauaaaacuggaauauaccaccucugcaccguagcaaugugaacauaauucuagugcagaguugugcugagaaucuuguucagagacaaaagucaaaauaaggaggccgggcgugguggcucacgcuuguaaucccagcacuuugggaggcagacgcgggcagaucacuugaggucagaauuucgagaccagcuugggcaacauggugaaaccccgucucuacgaaaaauacaaaaauuaguugggcguggugcugggugucuguaaucucagcuacuugggaggcugaggcaggagaaucgcuugaacccaggggucggagguugcagugagccaagauuaugccauuggacucuagccugggcaacaagagugaaacuccaucucagaaaaaaaaaaaaaaacaaaaaaacgaaaaacagggugugggguauuauuggaaugagcaugugguggaugaaauauugaaugccaugccuuaucugaaucauauuuuaggucaguuguauuuuagggaucuguuuuuuuuuuuaugccuuuaaaaaaauaucuuucuuuuacauuugccuuugaaguuucccuuuaugucuuuauuuucauuuuuuauaauuuuaaauaucuauugaauucuucuuagaaaagguauuguauaaaacugaaaauacuuuaguagcccaaaaacauuucaaggaguaaacuugaaaucuuuagucuuaauucucauauuguucuuauuuggcuuuagaauguacuuuaaacauaauauuugaauguggaugugauauauaaaggaaauucugcauuuauaauuguuuagaaaauaaugcaaagagauacauaccuacacaugucuugucuuucauaucauguuuucauaucauauuugacuaauaguucuuuuugcauugauuucuauguugaaauuaauuagaaggcucuaguuacuuugugagaccaacuuuuaaaaguuuaguuugguuacauuugaagggaaaaauauagugacaaaaguucaccaggcauuuuaacaacuaaaaagcugaaccaacuguuuucuagacaagaucagauaugacuucuguaggaguauuuuacuuuauauuucagcuucucauuuaguuaugacaucauaaagauacugcauuucauagcgauauuucuagagaaucuuuuuguucuuuaaacuuucucaggaaagagguacacuugacaaaagaaacuaucauuucagagauucgcgucuucauagaagaaucauagaaggauaaauauaucaaaauggcauucuuaaaaugaacuuauaaaaauaagcuuugcaacaugaggaugggcaaagauuucuugcuuugaaugcaagaagcaccacuaauuauaaaagaugaaaauugguaaauuagauuuuaucaaacuuagaggcuccuuuucuuuaaaagacacugucaagaaaauuaaauggcaagccacaccugggagaaaguauucugacaaaagacuuguauccagaauuuauuuaaaaacaaaaacccugauaacucaaaagaagaccgauggccauuuaaaauauggggagaauacuuaaacagauauuucagaaaagauauggccaagagcacaugaaaagguauuggacauuguuagucaucaggaaaucaauuuaaaaccauuuuugucacuauagauucuagaacauaaucugcagugauagaaaucauaucacugguugccuguaagaauauggugggagugauugcagagucacaagggaacuuucuggggagauaaaaauguuuuguaucuugauuauaagguagagauuacauagguguauacauuuaucauguuacauucacuagaauagcuaaaguuaaaggcugucaguaccaagauguggaacaacuggagcauugcuguuagggguguaaaacaguacaaccacuuugaaaacaguuugacaguuucuuguaaauuacacauucaccugccuuuuaacucagcaguugcauucucaguaaucaaaagcaugugucuagaaaaagcuuuauauaagaauguucauagcagcuuuacuuuugauagcccaaacuggaaacaacucaaauaacaucacuaggcgaauggauuuggaaugcaauggaauacuaugcagcaauuaaaacaguugaacuacuauguacacaacaacaucgaaaaaaucucauagacauuaagcugaaugaacaaagcuggacaugaguacauacuauaugauucuauuuaugugagauuuuaggauagauguauagugauagaaaacacaucacagguuggggcagguaugaugggguaacugaaggagaggcauaagagaacuuucuggggagauagcaguguccuuuauuuugauugggguggaagcuacacaguuguauaaauuuaucagaagucaucaaccucuauacuuuaaauuggauuuuuauuguuuguaacuuauagcucaauaaaacugauuuaaaaauaccuuguuuuaauuuuuuaaaaauauuuuuuaaaguugauuuuaaaauugcauauuuuaauuuuuuaaaaauagcuuaauuuaaaaaaaaauuuugaaguagccuuucacauaacauuggcuguuuuagguauuauguauuguaaauaauacagcuuuacacauuucuaagacaaggaugguaugaaugacacuauccucaccucucaaaugguccaccuuaggugagcaugaccccaggcaguuacuguaucuucuauccacaggacugcugaaaagcuauuuguucagaacucauacuggcaacuuagaucccuucaguguucagcuugguuuguauagaacuuaguugaaauuuagcauugagaauuauuuuggggcuuuucaaauucuuuucaauggcauuuuaguccauaauuucauuaacuuuauugaaagugauauuauuuggccaggaacauuagcucacuccuguaaucccaguacuuugggaggcugaggcggguggauugcaaggucaagagauugagaccauccuggccaacauggugaaaccccaucucuacuaaaaauacaaaaauuagcugggcgugguggcaugugccuguagucccagcuacucgggaggcugaggcaggagaaucgcuugaaccugggagcuggagguuguggugagcugagaucacgccacuggacuccagccuggcaacagagcaagacucugucucaaaaaaaaaaaaaaaaagugauauuaucauucucagcaaacuaucgcaaagacaaaaaaaccaaacaccacauguucucacucauaggugggaacugaacaaugagaacacuuggacacaggaaggggagcaucacacacuggggccuguugugggguggggggaggggggagggauagcauuaggagauauaccuaauguaaaugaugaguuaaugggcgcagcacaccaacauggcacauguauacauauguaacaaagcugcacguugugcacauguacccuagaacuuaaaguauaauaaaauauauauauauuaaaaaaagaaagugauauuauuugaguauuuauacaauuauuauugaaagugauauuaauuauuauuuauuuuauauuauuugaaguaaugagcuuuccuuuucuuucuagcccauuuuucagugaagaauuuuacuuugagauuccaagaacuuuccaguauuugucuuucuauguuuaugauaagaauguuuuacaaagagaucuccguauagguauguacuauucauaauuaucuuuaaucacaauguuaauguuuauauucauucguucucuuaguauaguuuugaaaauugcagaauaauauaugcucaacaucucugaucuuuuucuguagacuacauguucauuugugaaauuucauuuuuaauuuguauguucagcuuauaugacacuuucucagggaggccuuugcagcuccccuagucacuaugucauauguuuuuauaauuccugaugguucccuuuccaugguacucauuaugcuuauucauuaguuggcuguuucauaucuagguucucuaguuaaaugugaaauuuaaaagggcagggacucuuuuuuuguuuuuuuuuuugacacagaaucuugcucuaucucccaggcuggacugcaguggugcgaucuuggcucacugcaaccucuacuucccagguuaagcgauuucuccugucucagccuccugaguagcugggauuacaggcgugugccaccacgccuagccaauuuuuguauuuuuaguagaaacaggguuucaccauguuggccaggcugaucuuaaacuccugcaggaaauccaccugccucggccucccagaguguuaggauuacaggcaugagccaccacgccuggccgggcagggacucuuucuuacggagcaccuuacacuuaguaaguguuggguaaguauuuguuuagugguucaaauaauguuuuuauagaaagauugcaguuuugauccuuccaaagaacaucuguuguugagguuuuucuaauagaaguaauaauucacuuuaaucuauuuauacauuuucuuccugucuguauuagugacuguauuaguccauucucacacugccauaaagacauaccugagacuggguaauuuauaaagaauauagguuuauuggcucacaguuuuucaggcuguacaggcuucugcuucuggaaggccucaggaaaccuacaugagugaaaggcaaaggggaagcaagcacaucuucacauggcuggcaggagagaggagaguugggaugugcuacacacuuuuacaauaaccagaucucaugagaacucacugucaugagagcagcaaggggaugucugcccccaugauucagucaccuuaugccaggccccuccuccaacagugggauuacaguuugccaugacauuuucguggggacacagagucaaaccauaucggugaccaauaaauauauuucucuuuuuuuuugagacggagugucacucugucgcccaggcuggaguucaguggcgcgaucucagcucacugcaagcuccgccuccuggguucacgccauucuccugccacagccucccgaauagcugggacuacaggcucccaccaccacgcccgacuaauuuuuuuuguauuuuuaguagagacaggguuucaccauguuagccaggauggucucgaucuccugaccucgugaucugcccaccucggccucccaaagugcugggauuacaggcgucagccacugcucccggccaauaaauauauuucuuaaauaauugucagacuagagugugaucugugggcaugaacuagaacagagcuaacuggccacauaugugucacauuccugaucuuugcaccacuaucuuuguauuuuaaucauaggcagaggucuaauuuacauuuauucucuuucuuuuuaguauccuaaauuucaucucccuuuccuuuuuuauuugaaauauggucaagucuccuacagcuuaaaaaauuaagcauuauuuggccaggugcaguggcucaugccuguaauccuagcacuuugggaggccgaggugggcagaucacgaggucaggaguucaagaccagccuggccaauguggugaaacugucucuacuaaaaauacaaaaauuagccuggagcggcggugcgcaccuguagucccagcuacucaggaggcugaggcagaagaaucgcuugaauccgggaggcagagguugcagugagcugagguugugccacugugcuccagccucggcaacagagcaagacaccaucucaaaaaaaaaaaaaaaaaaaaaaaaaaaaaaaaaaaauuaagcguugucuuuguccucuuaacuaacuucugauguuucucuguguuugauauugaacuccuuaacaaauggucugugucaguccucugcuugcuacuuauuucuuuuaaaaucucuauaaucuggcuucuauguuuuuuugauaaaccuuucuugaaauuugccaacaucauuuuaaucaaauaaccuuuaaaacaauauguuuuucuuaauuauaaaacuguuauauguucuuaguauuugguagugauucucuacagaaauaacuacaguuaauaauuugguguauuucuuccauucuuuauuucauacauuuguauuacuacauuuuauucagauuuuuuccuuuucaauuaauaccauagugauccuuuccccauaucauuaauauuuguuaaaacuauuuguuacauaauauccuuuauagaaaaguguuuuauuuuaaccacauccuuguuggugaacauuuacauuuccaaauuuugggcauccucaaugguguugcuaugaacaaauguccuuuggcauaaauuuuugcaugucucuuuuuccccaggauaaauuccuagaagugaaaauacugagucaagggguaugaacauuuuuaugauuuccucuguaaauuucuguauugccccucugccccacagaguaucauacuaauauggacgacauaaauguuguacuaauuuacauuuccucaaagaugucaugggcauaaccauuuuaccacccccuggccauucuugcauauuaucauugaaaaaaauuugccaauaugauaggugaaaaauaacacauuauuauuuuaauguguguuuucugauuuugaaggaauuugaggaauuuuucauauguuuauugguauuuacauuuuucuucugugaauugauugcucauuccuuugccuauuuuucuuuugguuggaguucuaacauuuauccuuaagccuucuuauuuuuagauauguuaacuuuugucagcuauauacauaccaaauacucugucucacaaaaggcauuuucuuaguuuuuauuguuaucugccucugugucacauuucacucucuugauugcuuauucgguuugcugaaagugaaagaaaagacauuuucauggugguguauuuuuuuagauguguuucucccucugaugccuucuuauaugcagacucuucuguuuguagcaaacuguugauuauagaucacccuugaagcuguauccucaauucaguuuaacauuuaccaaacacuucuccguggcacacaaagguugggacuuuuaagaugaguaagacucguugcucaucagagaggcagacuucuagucuaauacuaauauauuaauacuaauauauuagggucugugcuggagauaugaacagaauacuuagaauaguagggagaacagcucauuuuauuugguaggggaauaacagagacuacauagguaggaaaaagaagaacaauuucuuuucuuuuucuuuuucucuuuuuuuuuuuuuuuuuuuugagauggagucuugcucuguugcccaggcuggagugcagugacaugaucuccguucacugcaaccuccaccuccuggguucaagcgauucuccugccuuagccuccaaguagcugggauuacaggcaugcaacaccacacccagcuaauuuuuguauuuuuaguagagacaggguuucaccaugucagccaggcuggucucgaacuccugaccucgugaucugccugccuuggccucccaaagugcugggauuacagguaugagccaccacgccccaccaggaagaacaguuucaaggugacagggauuggcagaagcagagggggaagaaugaaucauguuugugguguaccugcuggaggagggugauagaagcugaggauauaaauugggaccaaacugaugaacccuagaaaccauucuuaauuccaaaagcuaaggaacuuggacuuuauucuguagacagugguuuugaaccuuuugagaauguauguaacuauauauaacuggaguguguguguguguguguuauaauauacaugcauuuguacugcuagaaacagaagaaucugcauauuguauuauaugauauacaguuauauauaguuacauacacauauauauaugcacacacauauauacacauacacuuauauacacagauauauauacacacacaguuauauacacacgcagauauuauauauucuaauuuaaauauguaaucuauauacaucgaguuuguaguacuguuguaggccauaagaaguuguugauuuggaauagggagcgguuagaggcaggaagaccaacagguaugcuguuuucaaaugaaaugaguuagggcaguugcaguggaaauacagaugagggaauguacuucagggguuucaaauagggcauagggaccaagaugaacaggagaugugaaaaggagaagaguuuaaaauggucuuguuuguauggcugucauuaaauuagauaaagaacacagcaagaacauucacuuuugagugagaaggggagaggaugacuuugguuucaaacaaguuaaacuuaguauuaccgggguacaucuuaguggacauguugguugacaguuggaaauauagaucugaagcuuagagaaaagagcuagagauguagauuugagaguuauuagcauuaagugauaggugaagccuguguuggaaugaacgaaauuaccugggaguggauaaggaggguuucagggaagaagagacuugaagauagauaaggcauaucaggaaguagaaagaaagaugggagagauuaaugucagagaagauaaggaaaccuuuuaaugucagcaacuagagaaagguggagucagauaaggauugauagaggcuauugguaguuauuaauaaccuuugagagaauguauaacuucggccaucauaccuuaagaaaaauguuuaguaauuuucgucucuuuacauguuauaaucuuaagguaauauuucuugaaaaggccuuuaaggccuuuuaaauagcagcauaaaguugagguuuaugauuuccagaaguugccuuuguuuuuuguuuauuuugaaaguaaaaaucaacuuuagguaaaauaauuucuaguaaaaaucaguuguuuagggaguggugucagaaagcuguaacuguuggugugauaacuuuuucuuaaauguuuauucuuucuaagggauaaaauuuauacauuuaacagaaaauucuuuuuccuuuugcauauagaguuauuauuaaacacacuacauacccuuuaagguuggaagugguugaugguuuuacuuauacauuuuuaacauuuuucuaguucaguaucauuuucuuuugucauuaacacacagguuuuuuuuuuuuuuaauuuugagcuauuggaaguugaguuuucuuaauuuauaauuuggagccacucaauuguagauuaaacacugacacagcauuuucuggaaaugaaauuugagcuagaauuuagagaaucaucuuuuaaacuuaagaucuuagauucaguacaaguugagcauagauagauuuuagggguuuuuuauuuuuaauuacaugaguaauguauggauuuuuuuuuugucauucauuuauuucacauuuauucucauuguaccaggcaaagagaggaaggagucaugcaccaacacacacagauugugcuguuuuucagucuuucugauagaaucaggauccagauucuaacugucuucuaaaucuggaucagucaguagagauggaccacugugguggagggcccggggcugcugagagaaaggcaggauacaucuguagaacugaccauggcagguucauguuccagggcucccaucuggguaccugagcauuuuccauauagaucacagguguuggggcccacaucggcuccugaaagucuccgggaaugccauaggcguggggcuggugcucgggaggugcaaggucagccacaucagcacagggaggaccugagaagacgcugaucuuccaucuguaucccagaauccugugcagggccucuccauaaggacauugcaagggguggcaccuuggccucugguuggccucaugaauagugaaguauaaguccugcaagcuuaucagcaucuggagacauuccugccagcucuucuuuauaccucugugcuugagaugcggggcaacugcuuuugauacugugugauacuucuucaccccguacacuucacgcucaagaaauucccauucuugcaggaaacucuggacuuccuggcuacuccaugguuuaauuaacuggacugagggcuuuucuggucccuggacugcuuuuuuucugcuucauuuucaggauguuucugguaguuucagucugaaguaucacuuucuccauuuuuauuccugaguuuucuucugggaugauucucacugagucugcagggccuguuccuggguuggcggaacacuggcacuuacucugcucuaauggaaccuaggagagucagaaggagccugaguguggaaauguguuugcuucucucugcuucuuauguauggauauuuuuauuuuuguaaaaaaauuuuaaauuauggcauagauaaucccauuuuuuuuuuuuuugagacgaagacuugcccuguuguccaggcuggagugcguuggcaugaucucggcucacugcaaccuccgccuccugguuuuaagcaauucugccucagccuccugaguagcugggauuacaaauacccacccccacaccuggcuaauuuuuauauuuuuaguagagacgagguuucgccauuuggccaggcuggucucaaacucuuauccaccugccuuagccucccaaagugcuggaauugcaggcgugagccaccgugcccagccuaaauuacuuuugaccacugccuccucccaguccucuucccagagguaauaauuguuauuaauucggggcauaauuguuuauauuaggcaucuuuauaugcuaggaacuguuaguacaaaaugagagaaaaagaaaaacuuuaagcauauauuuuuauuuccaaugaggauucuaauaauauugaaauuaaaacauaaauguuuuaccuccuauuauguauuuuuuaguuauuuuguuauucaagagcucaaacaaguaaacuaugacuauuuuucuagagcucaaacaaguaaacugacuaucuuaguagacucuggcaguucuccccgaccccucacuccaccuugguucagaaccauauagaaaugaaaggauuuuacuagaaugucagagaccugaauaccagucaugacuaugucacuaucuaucuaugugaucuucauugagucauuuucuuaggccugguucauccauaaaauaagauuggguuuaaaauugcuaaggucuuuuccaacacuuugaauuguaauuucugcugacauuuagcuuuuaagcaaaauuuacuguguauaaauugcuuauggcuacacuuuggugucuguuugcacagggacuauaucaguuaucuacugcuauguaaguacuccaauacuuacuggcuuaauacagcaaccguacauuuacucaugauccuauuguuugucaguuugagcugaaccuagcugaguggcucggcuggucucgccuggggcugaugugcaguuaucugggagauuggggcuggcuggucugauucauaugucugaugguuggugcugacuauuagcuggaccuuccucaccacauggucuccugauugguucuaagaaggcaagcccuaaugcaaaggugugucacauuugcugaugucccauugguaaaagcaagucacauaauccaagagucagugcuauaggagaccacacaaugguguagauaaccaggaguuauggaggccauuaauauaccaguuuaccacaaagaccaaaauaugucuaucgaaaccucguacacuaaggcuucgaagugcugccauugucucuaaauugcugcuguugacuguuugccaggauuuguucaguccucugguccuguuucauuuuucuauagacaguaauauuugucacuguuuuuguuuguuuguuuuuuugagauggagucuugcucugucgcccaggcuggagugcaguggcguggcaugauuucaucuuacugcaaccucugccuccuggguucaagcaauucucuugucucagccucccgaguagcugggacuacaggcgcacacugccacgcucggcuaauuuuuuguauuuuaguagagaugggguuucaccguguugcccaggcuagucucaaacuccugagcucaggcaauccacccaccucagccucccaaagugcuaggauuacacgcgugagccaccaugcccggccugucacuguuuuuaucuccucuuuuagccauuucugcuagugcucaaguaggaacaggacuaucaggauuuuccuaauuggugaauuguaucaggcugaaauuucuaagaauauauuguaucuaaaaaugggucccaaggguaacacaguauuuacugauggcaagaaaaugcugcugaaaaaugguauuagaaagcuaaaaaugcuuuuuuuuuauuuaaagaucaacaaaggugguuucugugcccacaguuccuucauuuccuuuuguguuuccuuucuuugucugauuuuaaggaacuaauacagcaucugguguguauauguuugguuuuaagcucuuucugucugugaguuugucaggacagugaggaaaugaaguacuaacuuuaaaugauuuguugggacguuuguuucuuguugacuuuuuuuuuuuaagaguugggggucucacuguguugcccaggcuggacuugaacuccugggcucaagcaguccuccugucucagcuucccagguaccuggaacuacaggcaugcaccacugcacccagauguguuugauuuuuuuugaaguugguaacuucauagcuagugaaauaaugaauuaauuuuguuuaaaauaguaaucaacaacuggccacaguggcucaugucuauaaccccagcacuuugggaggccaaggcaguuggacugcuuaagcucaaaaguucaagaccagccucggcaacauggugaaaacccaucucuacaaaaacuauaaaaaguagccaacugggaccaacuguaaaaauuacuucuggcuacuugggaggcugaaaugggaggaucaccugagcccaggagaucgaggcugcagugagcuguaaucaugccacuacacuccauccugggcagcagagcaagacucugucucaaaaaaaaaauuaaaaaaaauacauaaauaaaagaaaauaguaaacacuaaacuaaaacaaucuuugggacuauuagaggcacaaaaaggguuuuuaagaucauuaaguuaaaagucauucuaaugcagaggaggcacaucagauguagaguuugaguaauucacccgagauuacacagcuaauaaguaacagaauugacacuagguuauggaauuaguguuuguguuggaaggagcacaaacaggcaugccuugguuucaaaaucuggcugcagcaccuguuagcggcaaguuuaaaaauauuguucagcuuuccucaucuguaagauggugauuauacccucuaccuccaagauuguuaggaaaauuaaacaagaaaauauauaagaaugucuccuaccugguagagacucaguaaaugcuggcuuuucuuucaguucagugcucuuuccacugugucgggcugccuaccuuuuacuguuaaugccugccaguuuagugauuaaacaacaaaucagaaucgugaggcuuuuuuuuuuauucuauuuguguuucagaaacuuguuccuucuuuccccauccucucuucucccucucccguacuuccuucucauuuauccuuccaccuuuuuuccuccuucauucuuugucugucuucuccucucccucuucccuguuuuauucccuugggcugaugauguauauuucuuuuuauauguuauauugccuaauaaagugcuggacauguuguagguauccugcuaccuauuaacuucaaauauuuuucuuaauuuuccugugccauucuuauauaucauuuucucuaacuuuguggaaucauguacucuuucuucucuguuucuucaggccaacuggccucaugcaacuagaucuuuacauaucagaaacugacaucuuaaaaaggagcuuaagaauaagagcuggcaauaaaauuacagauuauucucagcucacaaaugacuuguuuaugcagcuagucagagaaggguuucccucucauaggacaagaaacauucaacucuucagugacagugaaugucaugauacucaugaugcagaauaggaggaagaggcugcuugcuuuagaauauauuaccugugugacuaagagaggauucucuuuugggaaggcaccugugacagaugagauguauuuccagugaucugagaguagugagucauaaauaggacagguaaauuucuacucuaguuuuuagcagcauuguuaguuaaauagaguuugguuagggaagccuggaaaucaaaucagcauuuacaacacaaugccauugugauuguugaaugagggaaugaauuugucaaaccaauaaacuccuaaauaaacuuuguaggcaacccucuuuuagaauuugggacuuguuuuagugguguuuguauguauuauauguauguacauauguacaucuauauacauauucauaaauuguguacaaaacuaaaaauuauggaaauuguaaaguagaaauuucaccagaagucuacugauucguuucuggaugguaaguaaacucucuuaaaauuuugugccagauauuaucuguccuuuuucuggggagaggacauaaaagauacacaguuacaaagauucuuaaagggaggauaaugguucucaaaagguaagagcuucagcuauaggauguauagauguauuucuguauguacauauauauuuuuugaguaucaaacuguuaugcauugccuuaacauuuuauuuaugucugguguggaaucugugguaauuaggacuacuugauagaauuaugguaaucauuuguggugugcaauauugaauacuuugucauaauuuuauaucuuaagccauuccugguaauauauggauuugccaggaauuugauacaauucauagauaaaacauauccagagauuuggaugauuugucucuuaaccuaaauucuuccugcaguuuaaggaacauuugaguauuccaguuaguaccugaauuuuauauuuggcuuuuaaucuguguauuuaauacuauaagaauuucuguuuucccaucauuuuuaucuuaaauuuaaccaaaaaagaacuaaaauacauuauuucccuagugucauuuuccaugugauuugaaugaacuauaaaugcuguauauucacauaaagauuuugaucuucaauuacauuuuauccaaaguauucaaaagaaaguugggaagauacguauuuguuaucaggaccaauuuauuuuaaaauuuuauauguuuuaacuucauguauucauagacauauaaagaugaacuuucaauaggccuccuucgauuguauuuuuuuaauacaguuaccacucguauuuuuuuaauacaguuacaaacucuuuaauaaaauacagcuguguacuuuacuauuuucuuuaaaauuagauguaucgauugucuuuacaguuugaauuccaagacaugaaugagaagcuuaucaaaaacuguaaugugguuacauucuaaaaauaacaguuuuauugagauguaauucacauaccauuaauucacccuuuuaagguauacauuauauuugcuuuucagugguucagaaaaagaaucauuauauacguuagagggagagaaacauuauaaaaguuaacaguaggggaaugugaguagaaaauauggaaauuuuuaguguacgguucuuguaacuuuucucuguuugaaauuauuucaaaauacaucuuuuuuucuuuuuuccagcacuaauggcuugggugaauuaaaauauuuuuuaaauuaaaaaaaguguaugguguggugggggccuuaauauauucacagaguuguguaacugucaccacuaauuccagagugaaauuuuaagcauaguuuguguuuguuuuccuguuccuuccuuuucacuugauauacaaaaguugacguaucuugacagaaaaauuucuuuacaauuuucuuaaaguuuucaaauguugaacuaaaagaccaagguauaucauaaguacaaggaaauaaaguagaauuagggcguauaaaaugaaaauucuuacuugacaaaagaaagugaacugcuuuuaacuuuauauauccuuuguugaaacuuuuguguagaauccuggaauaaaucauuagucuuaugcaaaacugugucuacuucuuaaaacuugaauugaggaaggaaaugcuuuguaccaagauggcaaauauuuuauuauaagaacauuucuguuucuuccucucauacuacuauguucauuguacuguaucuuccucugagaggguuuaaacucuuuagagaacugccuuaauuuuuguauguauuggagcaacauaaucaguguuugcaauguuuugauaaaaguaaauucuuaauaauaaaauuguuauaaucucccauaauuuucaagucaguuuucacuguuguuaaugauguaugauauuguuuuuccuuuucucuuaauuggaauuuauaaacucuuacuaaaugcagauacaucugcucaaaacuugucauuuguucuuagggucaaaaaauugggaagauuaguuugcacuaccauuguaccuugcuuuuuauaaugaguguacucuggguaaaaacaugaaucugaauaaguacuaaaaaaaugcaguugccuguaauacaacugagguuuuaucuaauccccugauucaaaaugacccagacaaaugucugccaaggggcaaggagaaaugagacacuuuuucauucuuuagaauguagaaaaaaugcuuuauaaaaauggauuuuuaugucaauagguacaaaucauuuuaaaauauuuucuauaaaguauuauauaaaacagugcuaaugagucuuaggauuauacgaagcauguuuucuuauauuguuuuacuuauuuucuguaggaaaaguagccaucaaaaaagaagacuuguguaaucacaguggcaaagaaacuugguuuucauuacagccuguugacuccaauucagagguucagguaaauauuaaggcuuauguaauacaagagauugucacaggaaaugaguaaaaaaugaacuaauuaaacugguucauguaaauagagcauauuauaccuuauuuuaaauucuagcaucaaauauuauagacuuuuggguaauauaggacaggaagguaauggcuuugucauauuguuucaagaauaaugcucauguauaugcauauguguagauuuguggagauuagggcauuucuuucuuaccuucuguuugagucacaauagcaaauuauuauuugucuuugaggggaaaaguuuuaagggaaaauauguguuuuauuaacucugacuuugggggagaaucccuggaagucugauuuugucugucuugauucucuguuuacucucuaguaaacuggacuuggggaaauguuauucauuuaaacccugccugagcccacugugcacagccuucacucccacacccacccuuuccuguuguucaccucgcuuuuuauuugaaagaguaucauuacucuuuaaucuuuuucuuuuuuccaaaauaagagaccuuuuucagauucugaguaaagauguguguuuagccauguagcugaaguuucuauuuguuuuuagaaaaucugaguugcucuuagaaauuauuuuucuaacuaaagggaaucuuuuugcuguagccuuauuuauuuauaaaauaugguaaggauugugaaaccauuucccgagggcauaauugcaagcaggauucuuccucuccaaaagaaguuuuaauuugccacugugacucagaaguuuaagacaagaaaaaagugcuacacccacaccacagauaauuugcaaauaagugccugugucuccauuuccucauaaucucucaagcauucucuuugauuaauuauuaaauucucaaaaaauuaaguacuuaugcacuaaccccccuucuuaacugcaaaauuuaacauacuuuuccuguuuaaccuacuuugccauguuuuaauauucuugucuuuccuuaugaccauagcuauuauucagaucccaguuguacaguauuguaaaugauccaugugagaagcaaugugaagaaguggaaaguguuuaaauuaaaaggcagaaaacuuagguccuaguuuuuauauguaguuacuuaaaugacauugaauuucauuucuauaaagugggaauaaaaguugcuguguucgauucauaugguugugagaauuaagugaaauaucuguaagaauaguuuaaaagcuguuaaugcuauacagauguaaaauauugucuguuuaccaccagucagucugguggcuauuucccuaauauuccuuuaccaaaaggcagauaugaaaguuuuaaaguaccaguuuuucuuuuaauaguuuuaagaaaaggcaugauaggaaaaggcuuugaaaauuuaaacugaaauuuuaugaaccauuacauuuuauaaaacucauaaauuuugugaauuuuauguaaauuugcuaaacaauuuaagaguuccagcucucaaaagguaaaaaucuauauagaauauagaauucuuguagaugguacuaaagauuaauacagagacacaagacuuuauuugaugguguguguguguauauauauguguguguauauauauaugcauauguguauauaugcauauguguguauauauaugcauauauauguauauauauacacacacauuacauacacauggguaugcauauuuauagauauacauauauaugcauauaugcauguauauauacacauuugagagauauauaucucaucuaugaaacaugaaaauuggggaagcaacaguuacccagauauaauauagucauuuaaaaauuuuguacaaguuauuuucaugacugugaguuauuaaacuuuacaacucuuuugucuuaaaugauacuuacuuaauaagauuugcucacuauuuaaaacagauuuuagaaggaaaaguacuuugugggguggaagagacauauaacacuuuuggguuaauaugguaccauugaaaauguuguugucccacugcugauaagggaauacuaaauuaugagucuagaaaagauagaaaaucaucccaugguucauacaaauccuacuuuguuaauaaauuuguucacuuccauaaacuuuauaaaauuuuacaaaaauaccaugaaacauaagagcaauuaauagggaaauaggugaaagcuaugaaacagauugcguucaacaggaacucagucugauaauuacuauuaguaauuauaccaguguauccuaagcacaguacuaaguacuuaaugucauuuaacuuucaaaguagcauuaugagguaaauagcaucaccugcauuuuacaaauaaggcaaaugaaauucagagguuaaaugucuucuccagagucacagaacuacuaaguaguggagccuugauuccaaaagagaucugucugauucuaaaacuccuaaccacagugccuuuacuaccuuucaccauucuguacuauuagucauuaaaaaaaauagauuaggaguaucacuuaaguaacaucugaguguaaggaagagaagccugcucagauuugcucaaagaaaaugggagaggccauuggaaagcuccuaaagaguuucuuggaaugucaucauaggaacuuuacauugccagugugagcuagaaaguugucaggcauuugcagaggagaugcaucuuaaguggaggcuagauucuuagaacaacagacauuaaaauuugccuaaguucaucuguaaaaugaguauacaaaaugaaaaguuaaaaauuuuugcguaaguuacaauuauuuuugaaaagaguuuaguuucuuauaaaauacacuaagguauuugggugguuuguuuguuuuugguugacuaccgcauaaaauaauuggcuugcauucugggccaugguaaaugaaaacuauauacuguaucuuuaaacuguagaccuccccccugcccugacucaguacagcaauagauacugcaaguggcacauggaaacugagacccacuaaucauuucuuauauuccuauguucacugugcuuauugagcauaaguucucacuguuuaaauauuguuuuuuuucuuucccuuucaugaagugaauaauguuuucucucagucuuucccucucauuuuaauaacuauuugcuuugcaaaauauaaaggaaagaaaaaaacaccauuuugagaugccauuguauucuuuuuguauguaugaugagacaugucucuuccucugcuucucuguaaaucuacuccagucucuuuuugagaccuaaaagacgccacaccaauuuuugaguccaugugaccauacagcuuccucaccuccaacaucugacucaguuuucugccacaaucuagagagaaaguuuggcuaaacuugggucagaugucuacuucaaucuaauuugauaugguuggaggaaaauucacuguaaggcaguccacuuuagggcuuugaguaggcauguucccuaaggaagggguuugaguagaggaaaugaauggcauugcuaccucagagggagagaugcuuguuuccuaguucuaccacuaauuagcauuugugccccaaauaaucgcaagccuguuaccugaggaucuucaucuaugaaaugauaaugucagcgcaaaggguucccuuaguugugaaguucuagggaaauaacaugcagaaauguaauuuagcuuuccaguggaaggaucccaguaguauuaagaugggcuuuaugccaaaacaguugaaaaauuguuuagaacuauaaccucuuaccuugaauugucucccagagauaauuuuuuauuauugcugauacuguuauacuugucaauaauguuaauaguucuuuucaguuucaucuucaguaguucaaaauauuguuaguaacauuucaugaguguauuuuucuacuuuuuuuuuguauuuagauuuuggcuugauucuaccuuuuguaauuuuuccuucugggcugaaccauuuuuuuccucaaccuauucuaaucugcuuucagacucugcagugggucagagagagagcagaaaugguucuuuuuaccaaugacauugugucaauaagucuaguggacauuuuucaguccucaucuuacuugaucuuugagcagcuuuugauacuggugaccacucccuccauuuugaagcauucuuuuccuuaguuucugauccuguuuaugguccuaguuaucaucuauuucauuugguauucuuucucaauauucuuugccacauaugugaaguuaauauggguugugcuggugccuucuauaaauccucuuuuggcuucagugaacuacagccgugcuauuaguuauuagguccuguaacucaccaggaacauuagguauuuauccuuucuuuauuucuuaggcacagugauaaaaagcauacuuuacauaugguugauuaaccaggccggguaugguggcccacuguagucccagcacuuugaaagguugaggcagacagauugcuugagcccagaaguuugagaccagcuugggcaacauagcaagaccccaucuuuauaggggggggaaaaagagugauuaaaccaaaucucccauauggagaauuugcugcucucauuaauuaaggaguuugucucacacaacuuguccaagcaguaaauccagaugugcuaucaaccauguccuauaugaugcaauuacuuaguuaauaggucuuuaccaacaagcauaucuugaauuucuggaucaugccauaaguuauugauuguuuuauagguguuuuuuuuuuuaaagaccucugccuuaccuguuuaaaaagacauuuaaaaagaaaugcaaugauuauagcuaauaauaaauacaugaggauuuuuaaaacaugcccuauucaagacauaacaaauguaaaaacauaauucauuauugcagguugauuuuuuuuaacuucauuuuaaauuuuuaugugaauuaauaaugagccauucuagaucauauuaaauacuucuuuaaggagaaaacaacaccuucauaaagaacugccauuaauauaagagauauuaaauaaaauuuguauuuugcuuuuucaucugaugggcgauuguguccaaaaucauuuauagagguaauuucuacguauuaaaacauccaucagaaacuccgaaguugggauauuuuucaccucauguacaggcauaccuucuuucauuguacuucacugugucgugcuucacagauacugcauuuuuuacaaauugcagguuugugacaacccugugucaagcaaaucuaucugccucauuuuuccgacaucauaugcucaccucauuucucuaugacagccuuuuuuagcaauaacauauuuuuaaauuaaaauauguauauuguuauuuaagacauauugcacacuuaauagacugcaauauaguauaaauguaacuuauauacacuagaaaaccaaaaaauuuuugugacuuucuguuuagauauuugcuuuauugaaguggucuggacccuuagacaguauuuccaagguaugccuguaaaaacauuuuuuaccaguugaaacauacugaguuauuuuauauggaaaugguuguuaaaauuuaguguuuugugauaaaaacaaaauaaaguuuagacuugagaggauuuuaagugcauguauuauguuuugcucaaauaccucuauauuaguccauuuuuguguugcuauaaaggaacaucuaaggcugaguaauuuauaaaggaaagagguuuauuuuggcuuacaguucuucugcaggcuguacaggaaguauggugcuggcaucugcuucuggugagugcuucaggaagcuuacaaucaugguggaagguaaacggggagcaggcauauuacaugaugagagagggagcaagagacagaaggcagaagucccagacucuuaaacaacuagaucucacaugaacuaacuaagcaagacgcacuuaucaccaaggggguggcacucagccauucaugagggaucuacccccaugaucugacaccucccacuaggccccaccuccaacacuggggaucacauuucaucaugagauuuggagggacaaacauucaagccauaucaaccucuguucaucuuauuuucccaaacuguaugcagaaauuuacacaguaucuucuauaugguaccaagaauauauguaauacacaauugaaauaaucacagauauuuuugugugaaauuuuuguaaaauuaauugaaauaaaguuagcguauaaaauacuaaaucuucaaauaguaccuguauuagcccauuuucacgcugcugauaaagacauauccaagacuggaaagaaaaagagguuuaauuggacuuauaguuccacaugacuggggaggcgucagaaucauggcaggaggugaaaggcacuucuuacauggcaguggcaaaagaaaaugagagagaagcaaaagcggaaaccccugauaaacccaucagaucuugugagacuuauucacuauuacgagaauagcacaggaaagacuggcccccaugauucaaugaccuccccccggguuccucccacaacacaugggaauucugggagauacaauucaaguugacauuugguggggacacagccaaaccauaucaguacgagaguaguguaaguuccucagaaugccccuuaauauaagauaaugugauauuauaacugcauguaucagccuaacauagucagugcuauggaagucauauagagcaauaccuuccaagaauuugguuuauuuuuuauuaaagacguauaauacagugcaagguaucugaucuuccaacauuuucugacauacaugaaaaguauacugucauugagcuuccuuuaggagauugaauaauaagaaugcaguuguagaccaaaucacauuacauguuuauuaucaaacauaguaccuuguuagauucuuuuuuuuuuuuuuuuuugagauggaguucugcuggagugcaauggugugaucucaguucaccacaaccucugccuccuggguucaagugauucuccugccucagccucccgaauagcugggauuacaggcaugcgcugccacacccggcuaauuuuguauuuuuaguagagacgggguuucuccguguuggucaggcuggucucaaacugcugaccucaggugaucugccugccuuggccucccaaagugcugggauuacaggcaugagccacugcgcccagccuccuuguuggauucuuaauguuacuucuucguagguucuuuauuuuucuuauuugucccuaggaguucuugaaucuguggcuugucuucuaucaguuuuggaaaauuccaggcaauuaucuuaucuccuuuuuuuuucugcccuguucuuuuuuucucuucucugcugugacuccaguuacaugaauaauaggccauuucaccaugucucauaugucuccuaugcuuuuucccucucugugcuucauuguggauauuuucuacugaccugucucccauuucaccaguccucuuuucagcuguggcuacucugcuacuaaauacauuuucauuuugguuuauugcuuaguucuaacuuuuuuauuucauucauuuuauaguuuccagguaucugcuggauuuuucauuuuguuuuaugucuuuuaaaaaauagcuauuuuaggcuggaugcaguggcucacaccuguaaucccagcacuuugggaggccaaggcgggaaaauuacuugaggucagaaguucaagaccagccuggccaacauggugaaaccgugucucuacuaaaaauacaaaaauuagccgggcgugguggcacaugccuguagucccagcuacucgggaggcugaggcaggagaaucgcuugaacccgggaggcagagguugcagugagcugagaucacgccacugcacucuggccugcgugacagagcuagacucugucucaaagaaaaaaaaagcaauuuuaaauucugucaauuccaauaucugcgucucuuguaaguccacugcuuuccucauuuuuucucuugguuuuugaucuucuggcauauucuguaauuuuuaauggaaugcuggagaauaaaauauaaaauauauuggagauaauuugagggccugaaugguauauuuccucuagagaagaaguaugauucccugccagcaacugcuguuucuaucuuguuggccagaacuacaucauauggcuaucccugaucucaagggaggcuacagaaugucaguuugcugggcucauaacugccccaucaaaaaacaaaacacacacacacacacacacacacacacacaaacuuguuuugcugcaauucaaaucuauuaaaugauuacagauauaaguaaaacugaacuuuugugugaaaagagacuaaaaaguauucuaaaauguucacugauuugaguuucuaaaacugaaaagcaguuuuaaauaauuuaaaacuuuauuuuucuuuacuaagaacaacacaguaguaguaaaaacuuugaaaauuaaauugguaguauauacuuuuaaaaucugaaaauuaaauugguaguaugaacuuuuaaaaucuagagcaaaaaagcaaagaaaaucuucugaaauuucaccaaccaaagguaucuucuaucaacauuuugguagaugaucuuguaauuuuauacauauauguuuuuuauuuuuauaaguuaacauuauaguauguacccuauuuugugauuuauuucuuuugcuaaggauaguauguauuuccuuguuaaaguauauaaugaguuaguguuuuacaguuuagaaauuauaauuuccuuaauuuaacucauaaugccuuuuaauuuaguguuccacccuaacaguauguguuuugugucugccuguucuguccucacacuuuucuugaccugguuaauauauaauuguguuauuguugauuaauaccuaaggaauguuuuauuuaccagucagugggaguaaugaacauauuagguaggcucugacucaauaauaaugauuucuggcagaaucucauuaaauauccuuuugacuugcuauaauacuaugauuuuaguuguaaacaaaaugauuaucuuuuucuacucuauugucauaguuuuuauuucuuagaacuggaauagaucccagacauuuccugagagacaguuguguuagcauacgauuucuguaauaaaauguauauauguuaaaauuguaaaacugcaaauuuuugugccguuggcuuggcucccuugcuagccaaguaauacauacaugcugucacaacagaaaauaugauuucaaaauucuaguugaguaauauuacaaauuacagaucauggaccuucaagaucacccuugaauaguagagauuguaaauacuaaaugcaggaauaaugaaagaccuaguuuacaaauuauauaugauuuuaugaauauuugugccuagauuuuuaguggaagauuugcuuaauuuaguuccagcuccacguaacugcuauuaauuuuucuaccacagauguguuugcuccuuuagaccuuagcuuucucaggcagacuucuguuuuaagauccaucaguauuuuuugcucaucucuuacuauucaucuaacccugagcuuuguaccugguggaccucagauucauucuuguauaaguccccuuaaaauagugaggguguuucagguuagguuucugugaaagaauuuuugaaaaggguuguucuaaagaggaacagugacuagauaaugaacuuuccuaccucuaaugaaaucacucacgucaucagucccuagacaucacuccccugaaaucuccacauggcaaugugagaauuugucuugucagcuggagggagguaauccaguacuguuucuuaaccaguuuagaauuguuagcgcagaauugcucaucaccagcggcagguuagaaauaucaagcucuagauuauauuguuccuaagccuuuauuucuugagaaguugauuguuugaauucuuuugaacuuacacuacuuaauuuuuaaaaauucgucuauuaauaucucuuuaagaaaguacuccuuuauuuucagugucccaucuuuccaucaagacucuuggccauauguuaucuuuuguuuauugucuucccaacuagauuguacgcugcuuguaagcagugacuuacaucuuuaacaucuauggauuccuacccacucccacagugccuucugaaacauaguagacauuccauaaaucuuuauuguuugaucaaaguaaguagugacaaauugaguuuuauuggcuguaacuuaguuuuuaguuguuuuagaauuguaugauuucucugucuuuuaaugagacugcuucuguccuuaaugcugguuuaucuucuggaaaaagcauccuacauuuuauaauuugguuuuaucucaaaauuuccuuaaauuuagguauugucuuuccuuuuagucugugauaauuagauauauaaauauuuauugaauuggacauaaaauucuuaaauuugaauaccauguuugacauaaguauuuguuucauaucuuucagaacuuugaucucugguuuugguuauuauucauuuaacaaguacuuaguguaggcaaagccaugugcuaguggucaguggauaaauacuguggugauuugaaaaggcacauaccuuuaauauuuugucaguaaaauagacuacucaguuuguaaucuuuuugucauuauaggguaaaguucaccuugaauuaaaacugaaugaacugauaacggagaauggaacuguaugccagcagcuuguuguacaguaagcauuuuuuuuaaccaaaaucaacuagaaauaauucuccauuuuguauucuuucgauuuuaagccaacuccuuguuuuaacuucagaaacuuuuuucaaaaaugaaauucugcuaugucauuccuuuugugaaguugauuuucaauuuaauuuucucauagucuacucagguuauggugagucauuaauuuauucaacuaauauuuauugaauauggguuaaaugauauauaugggcauuaaggauaagggugucuaacucucuggcaguggagaauuggaaaggcuucccaaagaagguccucuagaaauugucauaccacagagcagagcuuuagagacuuuggagcuagaacuaaugcccacucagagaugaccaguauugauucccaccuacuuugaauuccuuuuuaccucuuccacccucaagucauuuuuuaccacccagacucuaaucuccuggcuguucuggaaaucuguuguagcccaauccccuacucuuuuccuccccuccaaacccuuacucugugauaucaauagacugccagauaaccuucacuucuucuggguguuuuccucuauuuuugcauuaguugacaucugaauaucccacaaaguacagcaguuucacagccuucucaguuagaggcuuuguuuuucuaucauguccacauauuguaaggucagggaguagaguagauauuacucuccuauugcugcuccagacuguaacuuauucucaucaauugugaaccccagcuccuuugagguauucuaucuguauauaaauaugucuguuugcuacuauauauaauauuuauuucauuaauuuuuucugaccucuuugaaagaagauugcauauguaugacucuuaauauaucaguauguauuuccuaagaauaaggaauauuaucuuaaauaacuccaguacaguuaccaaauucaggaaguuuaacauuguuacaauacuuuuuaaaaaucuauaguuauuuucuaauauuuuaaucugcaguuauuauauuccacuuuuguuaacugucccaaugaugucuauuaaggcguuuuuuuccuucuaagaaaggaucugcuccaagauuauguuuuauguuuaguugacaugucucuuuaaucuccuuuaacauggaauaguuuuuugcuuuucuuugauuguauuaacauuuuuuaagaauauaaaccaguuuuuuuuuuuuuaauguuucucaauuuggauuuaccuacuaaaaauaguucaagaucuguuugcagcuuuuucuccacagacugacucuguagaccaacugagagcauauggugaaaguaucuggauuaggucuuccacuccucccuccccugcuucaguuuaauuauaauagucauuugaaauauaguuaguuugguugguuugguuuguuugcauucaauuuaaggguuuuuuugugccccuuccccccaauuuaaguuuuuucccccauccuucuaggcuuaauuuuauuuuugaauagaauauuugcaugauuucaaaaaucaaaacuauaacaaaaggcguuacucagagauguguguaguucaguucccucuccccacacccagcuccaagcaaccaugaucugauuucugucccuacaguuuuugccuuuuccaaaguguuauuugaacaaaaguauaugauaugucuuuuuugugucugcugucuuucacuuagcauaaugcuuuugagauucauccacacuguacguauaucauuuccuuuuugguguguuauuuguuucuugccauaauuugguagauacuguuauccucauuuugcagaugacaaaacugaugcccauauugguuaaauaagccuaauuucacacaggaaguguuggaggcuggcaguuugauuuuuuucccccaacuuuaaaauuuugaaauaauuacagauuuacagaaaguuguaaggauaguacagagagguccuguguacccuucauucuuuuucccucaguggguacaucuugcaugacuauagcacaauaccaaaaccaggaaauuuacauuggcauaauguauguauauaguuauagaucauuuuaucauguguguugauuuguguaacuaccaccaccaagauacgaaacucuucugucaccauaaagauaucucucaucccauagcuuuauagucauaaccacuccucucuucuaacccuuggcaaccucuaaucugucuuuauaucuauaauuuugucauuucaagaauguuaugugaauggaaucuuauaauaugugaccuuuugagauuggcuuuuuuuacucagaucuaucugaaugacuguguguaguuuuuuguagacagaauauaguugggucacuuuuuuaaaaaaaucauuuuugccaaucucugucuuuuuuuggugaguuuuuuccauuuauuuuuaauguaauuauugaauauuaggcuuaaauaugccauuuuuuguuuguuuucuguuugucuccuauuuuauaguuuucuguuuucuuuuuccuguggguuacuugaacacuuuuuagaauuccauuuugauuuauuuauauuguguuuuuaaaaaaucuauggucucuuuguauagauuuuuuuuuagugguugcucuagguauuacauuauacaugcauaacuaaucauaauguacugaugucaacauuuuaccaauuagaauaaaauguauguacuuuaccuuucuuuaaaucccuuuacccucccccauuuguaauauacuuugucuuaaauauuuugucuacauauauugagaaccacaucaaacaauguuauaauuuuugcuucagccaucuaacacaguugaaaagaguuagaggaaaaggaaaguguaagucuguugucucuacccacauuuuugcccuuuccauguuauuuuuuuccuuucugauguuucacgauuccuucugugauuaaguguauagaguuuccucuuaacauucuuuuagaguaagucucuuggugauacauucucuugguuuuccuucaucucagaaggucuugauuuccucuucauuuguaaaagauaauuauacuagauauagaauucugaguggacaguucuuuucuuuccacauuugaaaauguaccacuuccuuguguccucgaugguuucugaugugaaguucauugucauucaaauuguuuuucccuauagguaacacaccguuuuucucuggcuucuuuuaagguuguucuuugccuuuagauuucuuuucuuuuuucuuucuuucuuucuuuuuucuuuuuuuuuuuuuuuuugauauggagucuaguucugucacucaggcuggagugcauuggugugaucucagcucacugcaaccucugccucccggauucaagcgauuuucaugccucagccuccuaaguagcuggaauuacaggcaugcaccaccaugcccagcuaauuuuuacauuuuuaguagaaacaggguuucgccauauuggccaggcugcucucgaacuccuggccugaagugauccuucugccuuggccucccaaaguccugggguuauagguguaagccaccacgcccagccugccuuuagauuucuauauguuuuagcuugauugugauguauccuggaauagauuuauuuaauuuauccuguuugggguucgcucagcuucuugacuauguauauuuaugucuuuugccagauuuggggaauuuucaaccauuauuucuucuauuaauucuuuaucaccucugcuaucuuucucuucuucuuucagaacgccaguggcacaaauguuaggucuuuuuuuuacagucccagaggucccccugaggcuuuguccuuugcuuuuccccccagucuauuuucccucuguuguucaaauugggugauuucuauuguuaugucuucaaguucacugauucuuuccucugucuucuucauucuucuguuuagcuuaucuguugaguuuuuuauuuugguuauuuauauuuuuaaguucuaaaauuuauauuugauucuucuuuauaacuuuuuuccuuuggugagaguuucuuuugcagagacuuucuuguuuuuuuguuucaaacauauucauaauuguucauugcauuauucacaauagcaaagacauggaaucaacuuaaauggccaucaaucgcagacuggauaaagaaaaugcaguacauacaugccauggaauacuagccguaaaaaagaaagagaucauauccuuugcaggaacauaggcggagcugaaggccauuauccuuagcagacuaacgcagaaacagaaaaugaaaccaaauacugcacgugcucacuuauagugggagcuaaaugaugagaaugcauggacacauagagaagaacaacagacguuagggccuaccagaggguggagaguaggaggagggagaggaucaggaacaauaacuaaugggugcuagccuuaauaccuaagugacaaaauaaucuguacaacaaacccuugugacacaaguuugccuauauaacagaccugcacauguaccccugaacuuaaguuaaaaagaaauugcucauugaauuauuuuuaugauggcugcuuucagauccaugucacauaaucauaacaaucaugucaucuugguguuagugucuuguguuaguccauucucacauugcuauaaagaaauaccugagacuggguaauuuauaaagaaguuuaauucacucaugguucugcaggcuguacaggaagcauggcagcaucugcuucuggggaggccucaggaagcuuccaaucauaacaaacaccaagcgggagcagguguccuacauggcaggagcaggaacaggagagagaguggggagguacuacauacuuuuuuuuuuuuuuuuuuuuugagauggagucucacucugucgaccaggcuggggugcagugacacgaccuccaccuccuggguucaagugauucuccugccucagccuccgaguagcugggauuacaggugugcaccaccagaccuggcuaauuuuuguauuuuuaguagaguugggguuucaucauguuggucaggcuggucucgaacucuugaccucgugaugugcccaccucagccucccaaagugcugggauuacaggcaugagccaccaagccuggcccucuuuuaguuauuuuuaaauguauaauaaauuauuguugucuguagucaccuucuuaugcuguuaaauacgagaucuuauccauuauaucuaacuauauuuuuguacccucacuucccgucccagccccuggaaaacuuuguucuacucucuguuaucaugaguucaauuguuugaguuuuuagcucccacaagugagaccauacgagguuugucuuucugugccugguuuauuucacuuaacguaaugaucuccaguuccaucccuguuauuuugaaugacaggaccugauucuuuuuugugacugaaaaguacuccauuauguauauauaccacauuuucuuuaucaguucgccuguugauggacacuuagauugcuuccaauucuugacuauugugaauagugccacaguaaccaugagagcgcagauaccucuucaauauacugauucccuuucuuuagugggauugcuggaucaugugguagcucuauuuuuaguuuuuugaggaaccuccaaacuguucuccauagugguuuuauuaauuuacauugccaccagcaguguacaaggguucccuuuucuccauauccucaccaauauuuguuacgcaugucuuuuggauaaaagccauuuuaacuggagaaaaauuauaauuucauuguaguuuugauuuacacuucucugaugaucagugauguugagcaccuuuucauaaauuuguuugccauuuguaugucuucuuuugagaaauauuuauucagaucuuuugcucauuuuuaaaucagauuauuauauucuuuucccguagaguuguuugaccuccuuacauauucugguuauuaauccguucucagaugguuaguuagcaaauauucucccauucuguggguugucucuucacuuuguugauccuuccuuuguuguguagaagcuuuuuaacuuggugugaucccauuugucuauuuucgcuuugguugccugugcuugugugcuuguggcaaccauuaugcaagaaaucuuugucuaguccaauguccuggagaguuucccaauguuuucuuguaguaauuucauagucuguggucuagauuuaagccuuuaauccauuuuuauuugauuuuuuuaauauggugagagauacggguuuaguuucauucuucugcauauggauaucuauuuuucccagcaccauuuauugaagaaacuguccuuuccccaguguauguucuuggcaccuuuauuaaaaaugaguucacuguagauguacggauuuguuucuagguucucuguaaugaucuguuggucuaugugucuguuuuuaugccaguacaaugcuguuuugauuauuauagcucuguaguauaauuugaaaucagauaauugugauucuuccaguuuuguucuuuuugcucaggauagcuuugguuauucugggucuuuugugguuucauauaaauuuugggauuuuuuuuuucuauuucugugaagaaugacauugguauuucaguagggauugcauugaaucuguagauugcuuuagguaguauggacauuuuaacaacauugauucuuccaguccaugaacuuggaauaucuuuccauuuuugaguguccucuucaauuuccugcaucaguguuuuacaguuuucauuauagaugucuuucacuucugugguuaauuccuagcuauuuuguuuuauuuguagcuauuguguaagcaguauuacuuucuugauuuauuuuucaaauuguucacuguuggcauacagaaaccccacugauuuuuguuguguuaauuuugaauccugccacuuuacuaaauuuguuuaucaguucuaauaguuuuuugguggagucuuuagguuuuuuccaaauaagaucauaucaucugugaacaaggaugauuuuacuucuuucuuuccaguuuggaugccuuuauuucuaucucuugucugauugcucuagcuaggacuugaauaacaguggugaaagugggcauccuugucauguuccagaucuuagagaaaagacuuucaguuguuccccauucaguaugauacuagcuauggauauguacuauauggcuuuuauuguguugagguuugauccuucuguaccuauuuuuugaggguuuuauuauuaugaaggacuguugaauuuugucaaauacuuuuuggcaucaguugaaaugaucauaugguucuugcccuucauucuguugauaugaugugucacacugauuaauuugcacauauugaaccauccuugcaucccugagacaaaucccacuuggucaugaugaaugaucuuuuuaacguguugucgaauuggguuugcucauauuuuguugaagauuuuugcaucaagguucaucagggauauuggccuauaguuuucuuuuuuugauguaucucucucugguuugguaucaggguaacacuggccucauaggaugaauuuggaaguguuccccucucuauuuuuuggacuagcugaguaggauugguauuaguucuucuugaaauauuugguagaauucagcagugaagccaucaggucccaggcuuuucuuugcugcaagacuuuuuacuguggcuucaauuucauuacuuguuauuggucucuucagguuuuggauuuuuucaugguucaaucuugguagguuguauauguccaggaauuuauccauuucuucuagguuuuuccauuuauucuuuuuuucaaaguuucuuaagcuuuugcucuccauacucacugucuuguagcagcagaguuccagugguagcuuuauggaauuuauuguugauuucucauccuuauagauauucugaaauucaugacauucucuguuuuuuaguauugcuaaaggcaugguuucacauauggcuuucuuugugcuucuugcuggacuuugguuuugggggaguaauguaugggaagauucauauccuaguaguuacuauuauccuccagaccuagaaaguccccacuacaacauuuuuugaacuuuagugagaccucccugccauccauugaucuucacuguguuccuguuuucacuucuuucuacaucuuuuuccgugaccuauugcuguagucauuuucucgcagguuccguaaacuccccuauuguucucaucauucuuauuuaucuggaaaaacucuaauugaaaaugaccucuuccucuguguucaaucugcacaugaauauagcuggagaaaaucauguaggcugauuucacuuuaaauuuaucaucacaggccucacaugggcacuuauaucugcccuggaauuuaacugugcuucucuaauacagcuauaagauucucuaccaccacagccuggaaauugcuuacaucuuccugaauccaaaucuauaaaccuaauuugcauccauaauuuuguccuuagagcagaggagguacuccuuuucuugacauugaauucuuccaucugagcucuggauuccauuuauuuccucuacuuaaugaguuuugcuccuucaguuaugccuucuuuuucuuguuuugucagcuuuaccuucucuccuacaugguucucaccacaaauaaacauggucuaguaucucuguccuaaaaggcaugccuccccagaccucaucucugcccacccauaccccaguccuuuuuaucauucccauuccucugcucuccuuugaaggcagacuucucuagggaaaaauagugguaggaguguguaugagugugugugugcguguguguguguguguguguguguguguguuugcaauucuccagucagcacucuccaguagauuuuucugugauguggaaaaugcuuuguaucuucacuguccaaaacaguagccacuagccauguguggauauugaaaacuugaaauacagcuaaugugaccaaagagcugaaguuuaauuuuauuuaauuuuaauuaaauguaaaaaaccacacauggcuaaugacuacagcauuagugcagcuucaguaaaagaaccuggacuccuuuuuagcaguagcuuauuucaggacuugggcagggaaaauaugagaugagucuggagcaucuuggggucucaaaaaguaagaaagugcuaaaaaauaauggggauauguaaaaaggacauugaagccaauguaaagggacuucaaauuaccaaaucuggaacaauuugagcuucagaauaaauaauaauaguggauuaaaacuuauagaauaaaauaaauauaagcgaauacugguacaaauaaacaauuaaaaacucaaauacuugguagggagaaaggacugauuuuuccuauaguagaauucuaguuaaugaauguaggaggaaugauggaaaugaaaaucaacauuggcaaacaucacaauaauaagugggugaggggacaauucaaaaaaucaucuauggaugcuaagugagcauaaguguggugacaagaugucugauagaugccaccuuaauugagugaucaaaguuaacaucaccaauaaugagacauccaguacuucccaauaggaugcauugagaaggacaccaagauacauaaccucaaccuaaucaugaguaaacaucagacaaacucagauuaaggaauacacuacaaaauaacuggccaauacuggcaagaucacggggcaaagaaggaaaacuaaugaacugucucaggauggagaggaauaagaagacaugacaacuaaaugcacuaugggauccuguauuguguccuagaucaaaaaaggacauuggugaaauuugaguaagggcuacagauuucaguaauucugcugugguucuacaaaacguuaacauuuguugaugaguauacagaaacuauuauuuuaacagcuuuuuugaauaucugaaauuauuucaaaauaagguuuuuaaaauugccuguaccuugugcauucaacccaggucuguuuucugaguuucagauuaauaugucuacuuugaugaaucacauugcaaacuuaacacauuuaaaacugaaguacagggaggcugaggcaggagaauggcguaaaaccgggaggcggagcuugcggggagccgagauugcgccacugcacuccagccugggcgacagagugagacucugucucaaaaacugaaguacugauucucaugucuauccaacuccucccccaaagucuuagcaaauguuuaauuccgcucaguauguuuuucaucucuagauuuuuccauuuuuauugucuucugugucuggauggaucauauggaauauaauuauaacuuuuaaaugucuuugucugcuaguucugucuucuuugucauuucugauucuguuucuauugauuuuucuuuucauuauggaucauaauuucuuaguuccuugcauuccugguuauuuucuguugcaugccagacauugugaaguugcuggauauuuuaauauuucuaugaauguacuugagcuuuguucggcacuugguuaaguuacuuagaaacaguuugauccuuuugugguuuacuuuuaacuuuuguuaaacagacaagcacagucuuuacuggagggcuuauguuuuccuacuauuaaggcaguacccaugaauuaccagguuuucuacuguggcugaugguaccucuugcuagccauguguggguuuuaggaacuauugccucuauucuuuucaaaugguucuuuccccagccucagaugauuuccucauauauacacguaucaauacucagcugaauacucaguggggauucuuguagcucccuggagguuuuucuuucucugugcaacuuucuucccuuuaguacucugcccuggggucccuagucacuuugaccuccuccugcugacagcuuugccucuucuucucagagaaaccauuuagcuguaagcuggggcaguuggagggcucaccuguccuucacugcugauuuuguucaauucguuuuggguggagaguaaaucuaguuccuguuacuccaucuuaccuggauguagaaguuaaaauuuucuuuuaguuuaaaaaaaaauccaaagaaaagaaucagaucagucuuauucugaacuguuuauaauauuuucuuaccuuuguaaauuuuagauacuauauuguaaaugcuuuauaugucacauauaaauaaaauaucaaauuccuuauugagguuauuuucaacauuuguuuucugcccauccaugauuuaugauaugaaauugcuuacuuacagauuggaagaacagugcuaugcuagguaauuagaaaaauaauauuuccaaauauauguaaugaauaaccuauauuuaauaauauuacuuaaguuuugcagaaaacucaauuuuuaacuguuuuauauuuaaaaauuaagaguacugaugauuucuguagggugcacuucugguuuaugggcauccguguuuugguuuguggguauucuuaucguuucauaaguuuuuuauaagucaguacugcauuuuccucugcuuuuuuuuauaccucauaaaauagaaaauuggauuucugucauuaagguuucucauaauugguguuuaugugagauaaaugugguauuacaaggacaguaauauuguauuugggggcacagugggaauguagaagggcacuggacuucaguaacaaaauuaaaaaguagaaguugagucuuggccagcuucuuacaaguuacgcuaccucuuugagccuuaccuuguaacuuccucacauaaccugugagccuuacuucuuuuaaauggcauaauucucuucucaaaggcaguugugagaauuaggugcauuuugugaaagugcauaguaaacugcaaaugccgugucagauaucauuuugagguuuagccugagaaggguaaguuuuaagcaguauguacagugggaaaaucugacuguaccucaacccaacauuaaaacccagaauuaucuuggcuuguguuuucuuuggcuaguuucaaaauuucuuucuuuauuuuuuuaugcucagcuauaauagaaaugagucguauuaucauuucugucuuuacucugcaguauaccaauagcacuucacucacaucugugaccuguggguuguggagagaaauaaggauguacucaacagcuugcaucuuucaacaaagaauacuuuucagcaacacucaugaguuucucuuaggcauuagaaaaugcagacccuuagacauuaaacuaaacucauaaacucaguaauauuuagugagaaaauuggaggaacaaaucacuaaaguuagauucuguguucucuguaaaugccaacaacugugagccauggaguagauuagaugaccuugguuuuuauggucuaaaacauuuucuacagaauggugcuuacugaggagcuguuuacugagaauuggaauaaaaggcugcagaauugugugaagcuugcccuauauuuaugaaucagauuuuuaaguggaagcugcaguuguuuccuuguuugucauucaugcuuuagcagaggauaugaugccauagagcuggcuugguuuguagcuucucauuuaggguuugcaccacuuucuuuuccuuuuuagaggccacagcaguuuugauguauuaucaaaccgcaaaauguaccuuguuggguauuuagcagaaggaaauguguugacuguuacacaucccuuaucuacagugcuugagacuguuuugaauuucuuauucuuauuuuuuuuuugaguauuugcauuauauauacuugcccauuaagcaucccaaauccaaaaagcccaaauuugaaaugcugcagugagcauuuccuuggagcaucaugucagugcucagaaaguuuugaauuuuggaggacuuuggauuuuugaauuuggaaugcucagucuguguuugauaguuucauuagugauuguggcauuccuguuuagucucauuuugaaaauacagcauaaauuuaaaaaugcauacauacauauguccauacauauuacuaccuauuccauauagguaguauauagccauacaacugcagacacauggaaaacaauucuuaaccuuuugaauguauuaguuuguguuuaaagauaauguuuuaucuuguuuaacuggaaucuaauauguuaaaucucuuuuauucuaccuuagcaucaaggcaugccauggguugccucucauaaauggccaaagcugugacccuuaugcaacaguuucucuagugggcccuucuagguaauauuuauugaauuauuauuagguuuuaaaguuuugauguuugauuuaaaaauuuaaaaaguaagauucuacgagcaaaugauaaauagcuauuuauaacacacaguaauaaaugcuuugaaagaaaaaucuuuagugaguucuauuauacacuugucaauaacaaagcccucuuuuuacagacagaaauugguaccccauuuuaaaucugccaugcucuuaggcuuuaaggaacaacuucaguuuuauacuaguacaauguaguacuuuaaaacauaaacuugacuuuucaugcaucagcauuccuacuuuucaaauauccugaauuuuaugcauguaaaauccuguuuuaaugaaugccaguucagaauaacaagacaauuuauauauuuuuaucuggaaggcagcucaggacugaaaauugccuuuucuacucaugaaaucuguccucuacagagagaauuccaacuguagaaaaacugcugaaguacuagagcauggcaaaguguaccauaucauugauuuaaaugauuuauaauaauuugugaaaaaaccuauagcacuuuguaauacgguguguuauaugacuucauuaugauuucuuuaaggaacugacacaucugaaauaugucuacaacuugaagguuuagaaucaggaagcaagaaacacaguauucccucuacacacacauacaugcauacauacacaccccuuuuccccauccccagaaucucuaguuauucuuacuuuguagaaaaucacuacuaagucacuuugaaaaauguauuuauguauguauguaaaguaccuaguaccaugccgguauuuauuaggugcucaaacaauaguaugcuauuagcagauacucagucguaugacauuaaaugcuauuagagagauuuauuuuuguguguuaaaaauguucaaucuaguggagcuauuuuuguuuuuuuuaauaaucucuaccugacaaauuauuugguaacauacaguuagagacaauuuggcauaugaauuuguguuuuaaaaagucuggccaggcgcagguggcucacgccuguaaucccagcacuuugggaggccgaggcggguggauuaccugaggucaggaguucgagaucagccugaccaacaaggagaaaccccgucucuacuaaaaauacagaauuagcugggugugguggcucaugccuguaaucccagcuacucgggaggcugaggcaggagaaucgcuugaacccugaggcgaagguuauggugaaccgagauugugccauugcacuccauccagccugggcaacgagcaaaacuccaucucaaaaaacuaaaaaauaaaaagucacuguugguuuugcuauuguacuguaguuguguaagauguuaacacugggagaggcuggguaaaaacacaagauuuccuuaugcguuuuuugugaccuccucugaaucuauaauuaaauuaaaagauuuuuuuaagaagucucuauuauaccugaagcccaagaaguaagcugaguuaagaauguuuuucaaguuccuuggguauuuuucaacauagaugaaggugcucuaaaucuuauugucuuccuucuauuuauucugaguugcuuauagaauagaauguguuuuuaaaaccccugaaaaagguuggcaaucuaguguguccguagagagaauaauacaaucuuggcacauaggggaugccuaaagcuuauauauucuuugauuugaguuuauaaggacaguuacuuuuuuccaagcaauauuuaaaacugaaucuucccugagucaccuuaacuuuuaaauggaggucaggcucccugguuggaaauagcauguuuuauaauuguguacuguuaaguucuacaagguaaaacucuaccacauuggaacaggaaugaccaaaagaagacaaaaguaaagaagaaaacaagcaauccgcaguuuaaugaaaucuuuuauuuugagguaauuuuuuguuuuacguaaauguuaacauuaaauauguaauauuuaaugcuaguugauuucuuuuuucaaaccacagucauaguaaucauuuuaucaauuaaugcagauaagcauuucucuccugaaagcaguagaaccauggugugaugcaauggaugcccaauauauaaaaugaauaaaggcagagcucuaauuugggagcaggaagggccagggccauacccacuccccagucauccucacuauucaugcccuuccuuugcacccucccuuacccuacccagcucccuaccuaacacauaguggccacaggauucuucugcaggguacccuuugacagucacuagugaaguaaguguaauuaucacucaagaaaucugaguuccagucaaguugacugaaagagucacuaaaugugacucaaguuucuuauccugugaaagaauaaucggaagggaaacuagcagcacuaccugacucagaguuuuuguaagacccaaagcaugugagaauccuuugagaccauaaaauacuuuaugauuacagcuuuauuauuacuuuuuuuuuuaagccuaauucauucuguggacgccugcuuaucuucauagacagcuucagcugccuugaaguugucccaaauacaguuuggacaaaagcuuuggagugcuuuucuuuggagcauuuguuaaagaaauccuuuuucauauuauuugcaaacuacagaaaaaaaaaaucaaacucucaaaaagauuguauucuaauaaagcauguugcaguucauaucaacguguagggaagguuugaaaaaaggaguuacauuuugugccuuuucuucuguguguauuuuucuugguauuucacaguggagagaauaacgguaccucuagucaugccugauugcuguacuuuaauaaaggaacacaggccgaagaaaaugccaaaagugaagcaggaagaauuguggagggggaagcaagggagaaaaaaaaaacaaaagaaaaaguaccaaugugagacuuuuccauuuccuggcuaaggacuuggugcaguuguucuacguuuauuaauggcgguugcaucuaaccuggagaaaacaaagaaggcagcaauguaaagggccgcugacuaaaggcacucacacuccccauuagcccacauaccuuaaaccucagcuggauggaaucuacucugcuucauggauccuuacagucagcagaugaccuuuuaaaaguagaaggccugaccugccugcuguagcaggaguacuuguuaggccuugcaacauucauucagagggccuuuaguugguuauaaagauagauacauuuccaucucuguccuuuaacugaagcaaggaacacaaagcagacauauguaugcauauacacaacaguaaaaugcaguagauauuggggaggucagaugaacucugcuccauuaaaggcuugaagaaauauuggauuuucuaagauugaggaaagagaguauuagagaugacgaacauuuugagcagaggcacagagacagaaaagcagaaaguuauguccaaaguacagugaguacugauuuuacugggcuuguguaaggaaauaauggaaacuaagauuagaaagguagaguaagaccagcugaugaaaggccuugagugccuaguuauggugcuuaaguaaaugauuuugagccuauaaguuaugaguaaaacaguguuugggaaggaauuaacuaugaucugagguccagguggcuuagggagaaagaacaaagcuggggagacuguuguacuuuagguguaagaaaaauggggaggggaugggguaucuuucaagagagugcuauggaaauagagaggaagaggcagauaaaagagagaaugcaaagggcaagguaacaaauugguuauagaaaaaaagagaaaggaaguaguugaaugcugcccccaagguuccaaaucuggaaaaauagaagaguagggaagaaggaaaauaaaaguggcuuaguuuggagcauaauuagcuugagggcugacauuuuaaauccuccaguagggaguuuaugacugaaacuuaauaugagugauaguuauugaccaacacucaagguuuguuuauauaaacagccaagaaagccaagagaauagagguauacaauacaggagaaaagugaagaaacuaauuucugcgacucaaguauuuaacuuucagcaugucauuuaauuucuguacuucagcuuccucauuuuuaagugaggguaauaaaucuagcccuguccgccucugagcagcguucugaugaacaaaggagauaaugcaugugaaagcacuuuguagauuguacagcacugugcagcuccaaguuguuuuuagugcaaaauaaaacauaaaauuuugaagaauaauuuaucuauagauucugaaaaagaaacaaagacagcagcauaagguugccaagguagugcccagguaaauucuauagaguguuucugggaaaggagauacaguuguaugaucacuaaauuaaauaggagaucaagggagguaagaacugagaauuuaucgucagauguggugaugaagagagauuuuaggagagugaucugugaggaagccaagauuauaaggaguuacuauagugaguggguggugaggaaguacaagcuguaaggauggauugcaguuuucagauuugucuaagaaaggaaagagauaggaagaccauaauuuaaggggagaauuuuucuuagacuugagugagaugaacaagcugguauuauuuugauuuuuuuuuuacacuaccuuauucuuuucugcuacuuccauaguugcuuuuauauucagcuauugaguaaaauauuacuuggacauuuuccucugcuuuuauccacaauugaauauuuugcagaugaucauuuuuaagcuguaggaaaaauguauuuuuuuaaaaaaaauuuuuacuaaaauauuuuguuuacagguaaccagauccaguaguuacaccagaaagucccaguuccagguagaagaggaggacauugaaaagcuagaaaucagguaugugccuugggguuuuacagaauugcuuuuuuguauaccaaaagaaaauccuagauucaaccaaaaaaaguaaaccaacuuuaauagaauucucuauagcaaguugguugaugaaacuuagaggaauaugcaacuaauuuaaauccagauuaucuuuccaaagucugauuuguuugcagaaauagucaaaguguauuaauuuuauaaacaaagaugaucuaauuuucaucuguuuuauuguauugauuuuuaauuuuucccaaauuguuccuuacauuucuggauuauaguguaauggauggaaaggaaguuauaucucagccaauuuagaaauuuuuuuuuauucuucuuaacauaucugcugucuaacagaaauuucagugagguaagaagauaauucaacaggugcauguguuugaaguuugugcuguuuccugggucuuaaauaucuaugcccuuugcgaaggaaaaaucuuauaaaugcauguguaggugugauguuaacaguguguucaucuagaugguauauuaaucauguguuuggagugaucagguaauguauuuuucuaauuuuucuauauauauauuaauuggugguaaucuagagagaaacuguagucuuauuguaguuucuuucuguaguccuuauugcuauagguuaaaauaaagccucgacuuucaaacuaagacaguuuaagugccuucuuucagacuauuuaaaauuacuuucugugcuuuuuaaauaaaagcugcuguaguauuuugcuucucuagucuggauagugagguauguauaugguguugcuaacaucuuuuaagcauguaaaauuaaugcuguaauacagaucaaaguaauuugaagcuguuuuguggugugaacucucuuaaacauuguuugcaaaacauaaagccaguuuucaauuuucaggaucgacuuguggaacaauggaaaccuaguccaagauguuuuccuaggugagauuaagguuccugugaacguauuaagaacugauuccucucaucaagccugguaagggcccagcauuuuagugaacuccauaguuuaauucucuuuaguacaguauauauaugcaaauaaaugcuuacucugaacauauuuuaaauuugccauguaauaagcuaaacgucauuaauauugauauguucauuaauucauuguugcagaaguaaauuguaaguuuuaugacuugaccugugguacugagauaaaagaacugaaucaucuaggaauauuuuucuguucagaagugaagacgacucuuaaggagaaaaaugggaaacauuuaaaacauuacauaagaguuguucauguaagaaaacgcuuggucacaaaucagugucugcauuucagaaguuuuauuaguggucauaggaacuguggguauuugaaagcaaaggauuuuauuuaggggacucaguuguuuaugggaacuaaccacuguucuuccuucaccacaccccauugaaauguacuguagauggcccuaauguuacuuuuugaaugucuaaggucuuauguuguugagcuggcacuuuuuagggcucuugguuuucaauaaugacuauaauauuauuuuaguuuucagugacucuaauaauaacauuacacugauguuaaauucaaauuaauguucagacauuacauugagcuaguuuccuuagcagaaucaaugugaaacuauuguuuuuuuucugucuauagcacuuaaaagcguguguauccuuucaguauguugcccagcaucucucuugcuagauuuugguuucaacuggguauaaaugaacaugccuuucucauuugccuuuuaaggagcacuuuuuggaucucaguuucugcugccucaaagaggaguguuuagguguuucuuauggauaucaguuucaucuguuccuaaaagagccugccucuucugauuggccaucagacaucuucauuuuagagucuuguccuagagcaguuaucacuuguagacugauauggagacucucaaaauuuuuacuuuauuuuugccucucuauaguccaaggcagaucuaagauuuauuggucuuuauguuggcauuuuguguauuauaguuuguaaaaugcauccacagagggggaaaaaaaucaaauguagucacuaugaaaaauugaugaagauuugggaccugucauccucccacuacaccaugucuuccaccuuccaucaaauagcauacauuuuaaaaugaaaauuucugagcucaguuugucaaguuuuuaaaauuaugugccagaccacucaguacagaagagaaaaacacguuguagugccuccgggucccucaaaaugaacuugaaaugugccacauaaucuguuuuuuaaguaagacugucuccagagaugccuuccaaauuuggcaaaacuuugugcagcuuccuuggcaguauguaagaacauuaacaaacuaauuuuauuuuuauagauguuuuuggcccaugauauuuuaaaguaaccugccagaaauauaagugcugaaauuuauauagcaugaaauaggaacaucugguaauucauauauaauuccacaguuguaaggaaacauaaaaaugugaaugccauuucuuuuaaguuggaaauaaaacucuuaaccuccuccaucaauuguagagccauagcauccccuugugggguuguuaguaacugcaugaaaacucaagaaaagauuuauuuacccucaggauuucaggcaaauucuuucuaauguugauguuaagagaguaaucaucaguaauuuaauucuguuguuugaaaagucucaaaauagauuaauuuuuaaauuugaaaguaagauucaaauaauagauaaaaugaauuacuggguuuuucuuuucaacagaagcacuuuauacaugauuuuagacuagaugaauauuugauaugauuuagcuuuccaguuuguuaauuuugacaccuuuuguccucaaacuuuuuuuugugggggggcggucuuacuuuuuuugagacaaagccucacucuguuguccaagcuggagugcaguggcaugaucucggcucacugcaaccuccaccucccggguucaagugauucuccugccucagccucccaaguagcugggacuucaggcacacaccaccaugccgagcuaauuuuuguauuuuuaguagagacgggguuuuaacuauguuggccaggcuggucuugaacuccugaccucgugauccgcccacuucggccucccaaagugcugggauugugagccauugcgcccagccuuuggucucacauuuuuaacguaucuguuuaauauuugaauuuagaaaauauaacaagucuccugucuucaguuaaaaaaaaaaaaaaaagaaauaggccuggcacgguggcucaagccuguaaucccagcacuuugggagcgcaaggcaggcggaucaugaggucaggagaucgagacauccuggcuaacaauggugaaaccccaucucuacuaaaaauacaaaaaauuagcugggcuugguagugggcaacuguagugccagcuacucaggagcuggcgcaggagaaauugcgugcaccugggagcgggagcuuacaguaagcugagauccaccacugcacuccagccugggagacagagcgagacuccgucucaaaaaaagaaaacaaaaaacaacaacaacacacaaaaaaaaaccagaaauaacguuaaacuuuuuuuuuuuauacggagucucgcucugucuccaggcuggagugcaguagcgccaucuuggcccacugcaaucuccaccucccgaguuuaagccauucuccugccucagccuccugaguagcugggaugacaggcauccgccaccacacccagcuaauuuuuguauuuuuaguagagaugggguuucaccauguucaccaggcuggucuugaucuccugaccucuugauccccccgccucggccucccaaagugcugggauuacaggcgugagccaccgcaccuggcccacguucaguuauuaauagaacugcuucuuuauucucucauuuacauagcauuauguacaaauaauugcacuuuggguuugucuaccucaauuuuaauuacacagacccuaugguuagaauuguuuaaaugcugauuuuuuucuguuaagggacugucaaaacugcuuacucuugagagcauaaggauugcuuuuaugccugugaaugaaaaguacauguuuagagcaacugaaugcuacuuucaguuaaaaauuucucuuuauucccuguuucuuuuucuuucaaacggaaauauuucauucaaaaacugacauauauauauaugaguuuuuuguuuuguuuucacuuagaaaugccagauaguccugaacuauuuaacaaaucuugagccuuuucucuuuagcucuaauucauacagaauuauuuaauucacaaggauccuucaggcaguuuauuaaauugagcuuuuguaauaauauuuuaaaauaaucacauuuauauaguuauacaaaugacuauugauaguuauucauauauuuaagugguaauaguuauacaucacauauauaaauguuauauguguaacauuuacauagugauuacugugugccaggaacuauucuaaguacuuuacuuauaauaacuuuuuuagggcuguuguaggguuuuaauguguuaagacacuauuaauacuccuuauuugacaaaugaggaaaaagcacagagaaauuuagcaacuugucuaaggucacacagcugggauuugaaccaaacuguuugaccccaaaguuugugcuuuuaaccaguguacuguaaguuugaacucuggcauauuucugaauauauuuaaaacucaaaaacauucuuuuaagccauuagcaaagauuugagugucccuugcuuauaaaauauuauauaaaagagaaucagagaguucccuacucauuuaaaaaaugaucuuuucaagggauggguaaaacaacaacauguugugaagucuuuuuuuuuuuuuuucaaguagacauagaugagauauuuugucuauggggauuucuuauccugcaaagaaaauccaaggaaacaaguuuagaaaguauggcaggagugaacccuucuggaguucuuaagcauccaaaaacaauguaugcauaaaaaugaguaauugguauagcacuacccuaauuccucuacauagaacaaugcuauguuaagacuguaggccugguaauuuucaguuauaugagaguaaagagggaugucauaccccucccucaguuauuuggagcuaaaggaaauaaaguugcgcucugagcaaaauuucuguaguaaaaaccaaaacagaguuuguuuugacuguagaguucagagacacuguuuaagauggauagggauggucccagagaggcagaaccaguuguaacugaguaagcaguaauacaaguaauguuaaucuacugugcauggaaaacauuaguucaauaggaggaaaagauucaucuagaguaauaaaaaaggauuccaaagagguaggcaugguacugccuauucaagcacaauugaggggguaggggauucugguccagaagaauuacuguuuccuuggcaagacuguugucuuagcugagagauucuuaaggcugcauaaaacuccuugucaugccucuguacucaccacaacgccuuuugauaauuugccuuuccaaauagccuaccaacagguaaaaaaauacagugaaagauauagaugaaaacccuaugguaaauggugauaauuguuguaaccaagugacaagcacauggggguggugguaagaaaggguguucauuauuacuauuaucacucuucucccuacuuuuguaagugagcauuucuauaauaaaaugcauuggucacuuaacaauccagguacuuaugccacuugacuauauuucuuuuucauaaauuuaauaauugaccugcuuuuaaguauaucaggcucugcacucagucauugcaauucaggugcaccuuauucuuuuuuuuuauuuuuuugagaugcagucucucucugucgcccaggcuggagugcaguggugcaaucuuggcucagugcaaccuccaccuccuggguucaagcgauucuccugccucagccucccaaguagcugggacuacaggccugugccaccaugccuggcuaauuuuuguauuuugguagagaugggguuucaccauguuggccagccuggucucgaacuccugaccucaggugauccacccgccuuggccucccaaagugcugggauuacaggcgggagccaccacacuugaccuucagguucacuuuagaugugcugauaaaacgagaugucugaauuugcaagguugccgaacaugcccuggauugugaaaaauugaccaaaguaucaauugucaggaugcuuggucaucaaccagcuaaacuuccugaugugguuuggcugugucccuacccaaaucucaccuugaauuguaaucauccccacaugucaagggcagggccaggugaagauaauugaaucaucgggugguuucaaauccccauacuguucuugugguagugaauaagucucaugagaucugaugguuuuauaaaugggaguucuccugcacaagcucucuugccugccgcauguaagacgucccuuuacucuucuuugucuucugccaugauugcgaggucuccccagccguguggaacuaugagucaauuaaaccucuuuccuuuauaaauuacccagcuuuggguaugucuguauuagcagcauaaggacagacuaaauacacuucccuuagagguacuucugagucaccuuugcuaacaggcuuguuucuaauuauuucauugaccauaucuuuacaucacuauuucuuaaaucagacaguagauguucugaagguugaucuuccucuuuugugggauagugauguaauuucuucuuguauuaaccaucccuucauccuuuaaauuugccuugguuaauucgcuaguugucuuuucugucuuuaucuuaucuuucucaaagcuaauaaauguucuauuaaagccuuccuccuucuauuuuuaaaugaauuaauauauuagaggaggucauagcugauaaauauauaaauuaaguauuaaaacuacuauuucuuuuauaaaaagcaucucagcauuccagcuaagugaaggaggagugauagaguuauaaaauuaucauuuugaugauuaauggcucuaagccgugaucaucaguggcugcugauauugcaaaaggagaaacaaccagacauuuaugccucuugguagaacuacacagcauuaucaaugaagcauucuugccagaacaucaaaucugaaucuaaccaagccucuagaucuaacuaccaauauagaggaaauacagagaggaugaaggaauaugguaaaugacauuguggagguagagauaagaguuaacacaauuccaaagguggaaaacucuauaggaccaacagugaggaaucuauaaaagagacuuaagaaugcuauuaccaauucuaaucuauggaccuuauuuggauucgaacaaacuguagaaaaacauuuaugauaaguuuggggaaauuugaauacuaagugaauagugaugacuuuuuaaaauuauauaugaaauuauaccuggaaauugcuuuaaaauaauaaugcaggaacaggaugggagagugagugaagguauggcugaaacaagaucagucuuuuauuaaaaaaaaaucaguguauguauuuuuaaauuuuguuuggcauugccuuuagauagagaauagagaagauggcagcuuuuuucucauguuaguuagaaacuucuaauugcuuucaaaaagugacccaaggcuucaaaaccaaagcauucauucacucacucucuagucaauauccauggaaugucuacuacuaagcccaugugcccuauucugaccuaucuacugaaaauaaaaucguggguucaaacagcaaugcuuaaaaaaacucaaacugcuuaaaaauauugcaccugugaaucuguuuuaguauuuuuagggaauuacuuuacuacugggcuuuguaauuuuaaacuuuagaaaggccuuagcacaggauuuauaaaacuugaaaacuaugaguauaaauaaauaauuccaggccaggcaugguggcuuacaccuguaaucccagcacuuugggaggcugaggcggguagaucaccugaggucaggaguucaagaccagccuggccaacauagugaaacccugucucuacuaaaaauacaaaaauuagcccggugugguggcccgcgccuguagucccagcuacucgggaggcugaggcgggagaaucgcuugaacccgggaggcagagguucagugagccgagagcaugccauugcacuccagccugggugacagagugagacucugucucaaauaauaauaauaauaauaauuccaaacauucuacauucuuagauaaaauauguaauuuauuucucaaacaguauaggggaaauauugacaacauuuaaaaugcauuuuaauguauuuuaaaacuuuuuaaauguauuuuuaaaacauuaaaaugcauucuuaauguauuuuacauguauucacaaaauauaagaaaaugcaauucgugucauaauugugacaugauaccaaaggagaaaaucccucccuuuacuguagcaaguguauaccauagaggcagugaguaagagaggaacagaauagagcaguaacaagaugaaaauggaaagacaaacucuuccucaguauaaguaaccagugcuauaaauuugccgugccuaguacaaauguugaacaauuguauaaacagagguugaggauuuucugcaaauaauaaaagaaauaucagugcagauuauucugggagaagaauggcaaagaaaauccacaaaagcauuuuagcaggacuuggguaacagaggacugagagagagaauuucccagacccaaaaagcaaauaaauaauuuuccccagucucuuaguaaggaggguugaaauuaaauucaaaauuuuaauguuugcuguuuauugcuuucugaacacaauuauuuuuaaguuacuuauggccuauuaagcuguauagcauuuucacuucacaagacaguacaauuauuuuucauuauauucauaaauaccucucuuaaagaacucgaguccauucauugcaugaauauuauguacccguuaaaaagaacaaacuggaucuaugaaaaguaguuucaaagaguuaacuaggaagugcuuucagguaaaaaaaacaagauacaggagaguagaauaugauaacauuuuuguaaacugacuaauaggcucagaacucauuuauaaauguguauauaugcacacauuuuuaaaaaucuauauaaaauuauauaagcaugaagaaaauagagaaggguccauaguagguaguuaacagguuccuaagagaagcggaggugcagaaugguaguguuuugaagauaggaaaaaagauaagagaaaaacaaaguuaaaagagaaaauaaagaaaacguuccuuaaaaaaacaaaagcauugauuugaugacauuguuuauauauguaugcaucguuaucuauuugucuauguguaguaaggauuuuuuaauauuaaauaaagaagauucugguucaaagagugaugaaaauaguaaguggcacuccacacagauucuuucuuaguucuugaaguuugagcuucacuacaaaaagaaucuccauucaguugcuuuuaucuacccuacagcguuuguuaauagcaaauccaaauuuguaaauuuaauuuggaguuauuucugaaaauaaauuuugugggcaauaugaugauaagccacaggaaaaaaaauaugcagauaaauauuuauaaauaaauuccuuuaauauauucuaauugugauaguuucugcagcauaauuuaaaauuaugcuauuuucaguguccaaauaaggauguuaucaguguuaguauugaucaucuggcugcacauaguaacuuaaaauaauuuuguuuuagaauauacuaauaaaagacauauauaauacaguuuuucugcaguuugguuucugguuauaguuaaguaaagcaaagauucacuauuuuauauacagcacaagaaaacgccuuuuuaaaauaaugaauuauugaagaauaagaauacaguuaaguuuuuuuccuggauguuuuuagauauuuugcucuaauggaauaaaggggaugaaguauuuguaaugggcauauuauuuuagauaaauaaauuuuuaagaguuugaacaauuuuuuaacuccuggaacucuugugauaucuugaaugaguagcaaacuuuuuuuuuuccaguccuagaaagauauauuuuggcuaaagcccagcaauucugaaguuuuaaugaccaaauuaguugaguucaauuguuuuugccaacuuaggcuacuuuaagaguaaaaauugccuuucucuaauccugauauagucuagaaaaaaauagguauuuacacuaacaacaaaucauaaauuucaaauuuaggcaagcauauugcugaguauccccccaaaaaggaaauaugaauacuugauugucaaugguacuuuacaauuuuuaucagccuucauccaauuuuguuuuguuuuguuuuuuaauuuuagauucagggguauagguacagguuuguuacauggguauauuguguaaugcugagguuuaggcuuauuaucccuucacccaaguagcgaacaaaguaccggaugguuuuuucaaucccuaccccccuaucucccuccccacuuuuggaacccccagugucuauuguuaccaucuuuguguuugugcauacccaguguucagcucccacuuacaagugagaacauaggguauuugguuuucuguuucugcauuaauucgcauaggguaguggccuccagcagcauccauguuagugcaaaggacauaauuuuuuucuuucugugacugcgaacaagauuagucuucaguugauaauuguuuaagcuagauaauggguacaugagcguucaauauucucuuuuguuuguguuuuuaaauucccaugauaaaaagcuuuuuuuuuuuuuuuuuaaacucuuagauuucugguuuugguccugcaaauuucucuuaaguucaaauuuuuggaaaaagaauuuacuuuaaaacaagguuacuuacgcauucugauaugucuuaucuacuuuuuuuuuuuugagacgaagucuugcucugucauccaggcaagcccagacuggaguacaguggcgggaucucagcucacugcaacuccgccuccugaguucaagugauucuccugccucagccucccaagcagcuggauuacaggcaccugccaccaugccggacugauuuuuguauuuuuaguaaagacaggguuucaccaugguggccaggcuggucucgaacuccugaccucaagugaucugccugcgucagccucccaaagugcugagauuacagucaugagccacugcacccggacugucuuaauuuucagcuaaaugccucuuucuuaaauuuaguugguaaaaauuuauuuuugauaauacauuggauuuuaaauguuuaccuuuuauuaucauuuuuucuaaaccugcaagcuaaucaaacucuuguucaacuccuuugagaucuuaauuucuguaauaucuaugcuuuuuguuuccuggauaaaaauguguuuauagcuuuguaauccaauguauaaccaauauuaguuuucugaagaugaguauccugcuacuuaugaagcuuccuaacuguaaauacuaaguugacuuuuuugguuuaguuuuuuuauaacuuaacucuuaacuugccucauuggcuugaaugcauuuccaucacauggaaucacuuauauuuuuacuuuagguacuugcuacagccaagagacaauggaaacaagucauccaaaacugaugaccuggggucucuucgauuaaauauauguuauacagaagacuacgugcuuccuucagaguacuaugguccuuugaaaacuuugcugcuaaaaucaccagauguucaaguauguuaagaaucuuaaggauaugauuuaacacgaaacggcuaaaauaauucuauaaaugauaaggaaaagauuucaagaguaucaagucuuauuaaaacaguaaaaauuauauacauacauauauauacacacacacauuucuauuuaucugaaccagaguacuaugauuccuacaugugcucccacaaucaucucugauaaaaaauuucgaaaauuaaauguccuguauaacagcuuuagugacauuauuucaguuacuuuuacaggcuagugauugaacaguuaaucauguuuccuugauguuugugcuuguuuucuaccuuucuguauuuagccaauaucugccucagcugcuuacauuuugagugaaauaugucgagauaaaaaugaugcuguuuugccccuuguacgacugcugcugcaccaugauaaacuuguuccuuuugccacugcuguggcugaauuagacuugaaggauacacaguaagaguuauauuuuauuaaauguuaauuacauguuguugaaauuggaccuuaguuugacagauugauuuuguagucugaauuuuuuuguauugaucagccuuacuguauaguaggcugaaaagaaguacuuaacaaauaacaaaaggcaguuaagcuaucaaacaguauucaccuaccuuaaggacaacaauuaaugaaggauguuuuucuuuaacucaggaaauuucauuuguuacuaaucugcuucuuaguguaaugguucacgugucacaaguuaaaacaccagagcagaaguguuuuuuucuuuauucauuauguaucacccuuauaugcauauguaugacauucuaaaaagcagucaagugacuucucauucacgucauagucuaacacuguuguuuuuuuacacacagagacauacauauacuccacauuuuugguucauaaacaugauuugccuuuuuaaaaaaacauauauauauauauauauauauauauauauauacacacacacacacacauauguauugaguuuuuuguuuguuuguuuuuaagacagagucucgcuuuuucacccagguuggagugcaguggcaugaucuuggcucacugcagcuucugccuccuagguucaagcgauucucaugccucagccuccugaguagcugggauuacaggcacucgccaccacgcccagcuaauuuuuguauuuuugguagagaugggguuucaccauguuggccaggcuagucucacacuccugacuucaagcgauccaccugcuucggacccccaaagugaugggauaacaggcaugagccaucacaccuggccauuauuuuaauauauuuuugguaaguuugaaaaaccuaauggcagcaagcuuuuaaauaaaugguaaaaauuacuaaaauuguaggucacuuaugccuucuaguaugucuuaaucuauuucagcuaaaugcuucuuucuuaaauuggucaaguauguuauauuauugguuucaaaaccuuuguuuacuacauuugguuucaucuauuucuauuucagagaugcaaacacaauuuuuagaggaaauucccuggcuacccgaugucuggaugagaugaugaaaauagugggagggcacuaccugaaaguaacauuaaaaccuauucuugaugagguacagaauauaucuccaacaaugauaguuuguggccuuaugauaguuguucuuuuaucaagugaucuauugaugggaaggauuuauucauucauguguuacugaaaaaauagacugaacacuuuagaagcaaauuauuuacuucucugucaauggauuuuuacucaaaagguacaguauaguauaaucuacauuauuucuuuguuaugggauuucuauuuuagcuagaguuucaaauauaugacaaauacuuuuugauaucauguuuuaagaaaauuguauauguuaucccugcauaggacauuuuacgcuuugcuacaguuuaaauuucuauaauuaacuuuuauuaucagaaaaauaaguuauuuucauuuugucagacuacuuagaaaaaaaucauuaacugaaaaauuuauuuuucagauaugugacuccucaaaauccugugaaaucgauccuauuaaauugaaagagggagauaauguagaaaauaauaagguaaguccuuguuauauuauuuauaauugcauuaaaauuggucuuaaugguguaccuuucucccacuuacauuaugauaaagccauauagagggaagcagugcuguuuauucuucacauaagccuuuauuauuagcagcacuuccagcuccuaggauuaguuuuuagaauguuauuuccucagugguuucacuuuauuuuuguucuugauugucucuuuuuggcucuaguaacaauagugaacuuaagcuauagcuaguugcagcccccguucuagccauuccuuugggcucaaacugaucaggcuaagugacacagugacuuuaucagucaguaguuucaguggccucugaaaaaacaaugauuguguuagggucacaaauuuuuauugcaguggauaauagugucacaauguccuugugcuuguguauccgaguuauuuugugauuuccuuuuggaucauuuuauucccucuugcuucuugugagguuuauucauagauucaccucuuacgccuagcaaaucuaaauuuaauuuauuaaauuaagucaguauguaaauuguccuuaaacugaaugaguuuggaaaaggguaacaguacuuuaaaaaauguuagauagugacugucuaauaaaccucauuuucuuacauuuuucuuucaugaaggcuauugaagaugugugaacaucaaaaucuuaauguuuaccuuuuuaaauccugcaggagaaucugcgcuacuauguagacaaguuauucaauacaauuguaaaaucaaguaugagcugccccacuguaaugugugauaucuuuuauucucuaaggcagauggcuacucagagauuuccuaguaagugccuuguuuuacuaaaacaugccauuuauuuuucuuugacuuuuuuauagauauuaauuacauguuugguuugugagauauuuaagguuuuuauuuauuuauuuauuuuuauuuuauuuuauuuuauuuuuuuugagacggagucuugcucugucacccuggcuggagugcaguggcgcuaucuuggcucacugcaaccuccaucucccggguucaugccauucuccugccucagccucccgaguagcugggacuacaggcgcccgccaccaugcccagcuaauuuuuuauauuuuuaguagagacgggguuucaccauguuagccaggauagucucgaucuccugaacucgugauccgcccgccucggccucccaaaguuucugggauuacaggcgugagccaccacgcccagccuaagguuuuuaaguacaaccuucuuuaguuuuucaaaaugauucuaucuuucucauaagaaaucugauuuuucuugaaaucucaaaauacauauuccauuuuauuucaguauaaugcaacuuuauacaaagagcaaaucaaaaucaccauuaaagaaaggcaaaaauucagaacuguaacauuauauaaguaagcacuuauaccagaugcuuaugagaguuaaaaauaccuuuguuauuuauaccaacuaucuuuuccagcugcaugcauucagauagugagaaucuuuaguuccauaaaauugacuagauuugacaguuugagaaugcuaauaagguuuugguggugagagguuuuuacagaaauggucuuagacauuagaaaccuuucuguuguaacauacauagaguuuuaagguacauauaucaguaacuggcauguuuuaauuuugaaaaaguagcuaugucaagguuuugcuuagaaacuuuucauaaaauuaaguguuacugucgcugcuaauacuuagaauuauucacauuuuaauauauuucugauaaguaaauaaacuugcuauagguagcuuuccagaucugucuauaaugggaggugguggguaggaggguaaaauuaggcagguacuuaaauuaccagucuuaaccagcugugcaaaacuguaaguuuauuucuguaaccaucugaagagauuuugcaguuuuauguucuuuuaagcaugugcucacccuguacacacaugugugcaguuaacugcacuucuacuaaauugacccauuacuaaauuaguggggcugaguugucuaacauguagauaaauuuagaucuaaaugucuuugcuaauuauaguugcaaauaaguaacuaaaucuaaucuucauaacaaaaauaaggggagccagaggcacacggaaaggugaaaugcucauugaaauuauauuuuuaaauaguuaaaucaugauaaccacauugacuacuuaguaacacacacaguguuaguguguuagccuccauugucuccuguucucaucuucacaaaaccacaugagguagguacuacucccauuaggugagaaacuaagguuuagagaagcugaguaacuuuaccaaggucuguggcguggccaacaggcaagcagggccucaaaccugggccuagucuacuccaaacuacaugcugccauucacuauacucuauacuaacuggugaucuuggccuuaaaucuguuuuagcaguuuaauucuuguuuauauaaaugaucuuaaacacuuuaugggguuuuuuuggguuuuguuuuuguuuuuguuuuugagacugaguuucacucuuguugcccagacuggagugcaauggcacaaucucggcucacugcaacuccgccucccagguuuccagccucccgaguugcugggauuacagacaugugccuccacgccuggcuaauuuuguauuuuuaguauagaugggguuucuccauguuggucaggcuggucucaaacuccugaccucagaugauccaccugccucggccucccaaagugcuggaauuacgggcgugggccaccgcgcccggccaacacuuuauguuuuuauauacaugcagauguaucucuuuaguuauguuuuuguugacuuaacuauuaauaugguuaucauauccucaguagacuauaguagugacaguuuuguugccauaaguguuucauauucucucguuuuuguuguucuuacuacccuagaagaaugggggaaggagggcagagcagacagcagguagaaagcagauauuacuaaagaaugacaaauuaaacgacuuguuaaugguuaccuacugaaugacuuagaagaguuaaaacucgaaccaaaccuaaagauucuuucccucaccaucugcuucaccaccaucugucugauuguuggguaaauuguugacuccagucugaaacgaaaguuguaggugaaugaucaaagccaccaguagucuucaguucaucugcauuuuuauuuauggacuguugauagcuuuuuaaaguaaacauuucugccuaauuguuuuuguugcauaacuuuugauauuaucaagauuuuugggggggauauugaaacaagaaccuaaaacugaaaguagccuuguaucauacucuuaagggauucaguguuaccacuagguagugcuagauacuacuuuuauuucuguuguaauuuuagcagucucuucuugcaggugaggaaagagguauuuuucaaauuaaaauauuucugaaaaccuagcagcuuugucuuuuuucauauuauuucuuauuucuuuuggauuuuuuuaaucauagggguuuucuuuuaauugagucauaaauaucacuaucauuucaucaacucaguucuuacuagacaaauuauguugcucuccuaguuuacaugucuuuucuauauuuuuuaauuuaucaucuuuguuuuuuaauuguuuuugugcaugacauuucaccauuuuuuuccugcagaugacccucauguucaguauucugcagugagcagcuuuguauuucuucguuucuuugcuguagccguaguaucaccucauacuuuucauuugcgaccucaucauccaguaaguguucauucuucugaaagcuuuauuccauuuuuuuaauuuuuauuaaaaugaagaaaagauaaaauaaaccaauuucacuaggcuguauuuucuuauaacugauacuuaaauuuacucagcauuuuucuuggccauuucagucuuucaagugaggcuaauaauccuauuuuuuguuguuguuaaaagauguucuacaagaguaauaaaauguuguuaauuauugaagcuuggugaugaguacaaaggggauuuauuauauuuuuucaucugcuacuguguguguuuguaaauuuccauaaguuuuuuuucauuaguuacagguuucauuuugauagguuuuuuauuuaaacaaaaucuacuuuccugauuuauuaaaauagguuaauuuugcagauauuuuuaaauugcacagaaauuugaagaggcucuucucuaagaaagaaggcuacaagagaaauuccauuuaauuuagaaacagcaucuaagauagauuucaguagcaaugaaacugaaagcauauaauuagaaaauauuaaauggcaggugaacuggauaagcauuaacaguaaaaacagaaaaagaaaccaagaaugcaguauagugaaaggcguaggaacuuuuauuggaauauaacuuguuaaauauaucaguauuuucacuuuuuauuuaccugagguaauacuguaaacaugagauuuaaaaauuucuuaagcauauaaacuuuguucuggaguccuguuuaauuaccaaaaaucuaaaucuccacugcauagauuuacauguuuauuucuuaauuuuuaaaauucuuuauuuuugcuauacuucugauuccuucuuauaugguguaauuugguugauucuuuaagcuuuuauguuccaaauacuuuauaaucuuaccuaauugcuccuaguugcugauuuguauaacaaauaauaacaauaguccacauuuauuuagugcuuuguacuaggccuuguucuaacuacuuuauguguuaacuuauuugguccuccuagcaaccugguaagguaaauucuguuaucauccacaugugcagauaaggaaaucacaauacaguaacuuuuccaagcucacacaacugacaaauuaugauuugaucauacucgauuugaauuggauuuaacugggauucaaauucagucagucuuuaucaucugugagcuuaauccuaucccuuccaaccucuuagacagauguucaaguaccuauaauguaucauuccaugcucaguacuggagaugcagugaugaguaagauacucuuugcccuuaggaaacucacagccaagaggaguugcucaauaguguagggaaaacagaugaguuuuagaguuaaaccagguucugaauacccauuucuucucucaacggcuacaugacauugacacucacuuaacuuugugagaacugaauagaaccauguugcaguggcagcaccacgcccuuucuugccaaaggauaaauggucugugaguagccccagcagagagugggccaguguccuuuuguucacagggcuguccauucuguggcuuuguuacuaaagcugcacagaacucugaggcagugaaagcgugguagcaacauucuggacauaaacagaacaccuacuucugaacuugugagucugccuuguauucauacuugaauuugcauauuccuguaacagauguugguggauacuuagguugguucuaugacuuugcuauuguaaauagugcugcaggaaacaugagugcaggugccaggacaucuuuaagaauauuauuuucuucaaagacagagaauuguagggaccuuuuauagauguaaugaaaucccagauguuacagcuaaaauguuuucugaauagacuuaauuuagguguguaucuacuuuauaaguauauuauaaggaucauauuucggauauuccuuccuuuccagauuaccuuauauucuggucaucucuuccccuucacauucauugccuguuuucaauguggggguuggggggauacuaaaauaucaaggaaugggagccaaaaaucaaacuaaagcuuuucuguaucuaaauuuuucuggauauguuuuuagaugcaagauacuguuuacuugaauccguaaauaaaaauggucuguguuuugauagaaacuuacacaaauguauggauuggugaaaauucagcaggguauucauuuaauaccuauucauuuugucauauguaaauuauaucucaauuuuuaaaaaaaugaaggagcaaagauuccugagggaacaccguuuagucaauuuuauaugcuacuauauauuacuucuuucagauagacaggccugaaaaaccucuuggauaauagacccaaauaaucacccucugguaagauccaaaaauaacuaggugacuucacauuuccuaagcugaauuuaggucuuugcuuccauggugaaaagaguuaauugcaaaagccauuuaaaguauugaauauguuuagaggugagcugagcacagaaaauuuggaacaccuaaaacugccauuuuaaguuauaagguaguaaaguagaagugacuauuccagaagugacuauaauuugccagguaauccaaggugccauacuguacaaaacaacuuauauauaauauugauaaaauuauggcuuuuggcuggugccaaaaggcucaugccuguaaucccagcacuucgggaggccaaggcaggcagaucaccugaggucaagaguucgagaccagccuggccaacauggcaaaacucuguuucuacugaaaauacaaaaauuagccagguguggugucaggcaccugcaaucccagcuacuuaggagacugagacaggagaaucgcuugaacccagaagguggagguuacagugagcugcgguuaugccacuacacuccagccugggcaacagagugagacuccaucucaggaaaaaaaaaagaaaaaaaaaaaaaaaaauauauauauauauauauauauauauauauaugacuuuuaaaagcaccacaucuuuaauaauuacuuugggaagaauuguuaauuauauaugguuucuuuagucucuuaauuccuuaggcuggugaguuguacccagccuuagcuagauuuuaacuguguguguuuugaacguuuuugagucauuguuuuacagcaauguaguccauuuacucuauucuacuuuuuuauacaaacuauuuucuugaaaacuuaguaguuuuggucuuuuuuacauucuuuaggaugcacagacaauuagaacauuaacucucaucucaaaaacuauacaaacuuugggaagcugggggagucuguccaaaagcaagguaaguccuuacaucuuuuauuuuguuuuuacacuucuaaauguuguuacauccuaugaucccuuauccuugacuuaccuucuuccaaauuaaaaacaaaacauacacacacacacacacacacacagacacaauagcugucuuuuaaguagauacucucuuagucaccuguuaaagaggacaguuucagaagcugggcauagugacuugugucuuuaaucccaggaagccgaagcgggaagaugacuugaggccaggaguucaaggcuguggugcacaaugauggcaccuaugaauagccacugcacuccagucccagcaacauagcaagacccugucucuagaaguuuuaaaaagaaaaaaaguuuaaugagaacauuaaaaaaaaaaaaaagcagacaguuucaugaaaacugcuaaacaagacaagagagccuaguaaggaggugcaggacagucugucugucugccugcuucggccauaaucacaugacagcuuugaaagaagucuuccacuccaagcccugaacucucugaaaauauauaauugaguccuuuuaggccuuaauccucagcuuaaaaauacaguccauucuauucuuaauucucuauuuaacacauauaaacccuguguuuguuuuuucuuagucaaguuucaaagagacauucaugugugaauuuuucaaaauguuucaagaagaaggauauauuauagcaguuaaaaagguaugaugguuuuauucuggaauuguuaauauuuauuucauauaacauggggaaauaacauuuuauauauauuauuauuaucaauccccaguuuaaauaauaauguuuaaacuguucaucaaaaaggcuuccuuuuucuuuuuucuucuuccacaaagcugugcuuuucagcuuugaaaauaccuaaauaaguuuaacaacaacuacuuuugccagugcauuagaaacacaaauuacagaugucuaggguuaggauuucucaaagugacacuauuggcauuuggggccagauaauucuugauucugaggggcuggcuugugcguuucaggauauuuagcagcaugccuggccucuaccccuuagacgcaagaaguaugccccuguuuugacagccaaacaugccuccagguauugccaaauguuccuugagggacagaauugccucugguugagaaccucuggucucuggggguaaaggcuuuguauggugccugauguagagugggcacuuaauugccauaguaaaaaauauauacauuauugaacauuuaaugaacaauauaaauuuaugguaguaaccugaggaaaauuacuauaaauguacaaaaaccuguaguauauaauauccuaacacaaggccugcagcauacaaaaaucacuguacuuagaaguucagaauguuuugaaaggaucuuuaauuucuugagucuuuaguccugaaucaucuaaacaaaauauagcauuaucguaaaaugcugaaaauuuauaaagaaaaguuaccuuugaaguacucuaucccauauagucuagaaguuaagaauuaaaaaauaaggaaagaaaugaauuacaucuaaacugggccugaagaaaguacuguauuuuauguaucacagucuuaacuuaaugaauccaaauuagcaaagccaaauguuaaagacuucauucaauuucuguagcacaacuagcaguugguugccagaguauuuauuuuguugagauacauguuugagccuuuuuuuauacuuaggauucuuacagagacuuaguaagugaaaaaugaugauuuaaaaaauucaaguccguuggaauauuuuucaucuggaauagugccuguuuaaccaaaauuuuuuuaggcaaccauugaaggcuuuugaggagaaagucuuucaaaagaauaggcaaagaaaaagcugcccuuuuauuuuucagacauuguugaaacauuugugacacuguaggcagacuuuuauuggcaggauuaugauguacugucuuuuguuugaggguuguuuuuccauguuuugugacugaggcuacgguagcaucugaucuuuuuuccccugauauaaucagaauguuuagaguugauaaugucaguggagaaaggauuuaaggguuccaggaguuuagucuguuccugaucuacucugggucacccacucacauucuaauggacuaucgccauagugugccucugucucagauuugguucuagaucccuaagcugacauaggguauuuugcccuaauauccuaguuuccuuuauuauuuaguaguuacaacaagauaugugcagugcuauaaaguguaaaagcuugugaagcucaauuucucauuuuauauuggcacucugccuagugacauuuacuauugaugcagaagaaaauaagaguauaacugaaucauaugcuauucccugcagaguuuagaaaggauaaccuggauaguucuauaaacaaggugaccauauaauuugaugucuaaaccagaacacuuuuaagagugaaaaauacuauuagugauuauucugggaugauaggaaugguccugauagggaugguccugagcaaacugggaccuauagucacccugccuauaguccaucuuaauuacuggguuuucuuucacuuauaucucuguauuuaccccauaguuccuuaagaauuauaauaaauaaauuauuggcugggugcaguggcucaugccuguaaucccagcacuuugggaggccgaagcgggcagaucaccugaggucaggaguuggagaccagccuggcuaacauggugaaacccuguuucuacuaaaaauacaaaaaauuagccaggccugguggcacgugccuguaaucccagcuacuagggaggcugaggcgagagaaucgcuugaacccaggagguagagguugcagugagccgagaucaugccauugcacuccagcuugggcaacaagagcaaaacucugucucaaaaaaauaaaauaaauuauuauaaauaauaaauauuugcuaacaaaucagugacuucagguauauauuaagaaauaaaauauucacauaacucagacuccauuagugcaugguccaucugggagagucgaugcugugauagggcgcuucuucaguucccuuggauacuuguacccacauuacccacauauaaugcaaaaggaacucuguucuuguucuuucacuuaccaauauuuucucccagcaaacagaaguaaacauuccauuucaaaacuccuuaagucugagcucuggcaggcaauugucagccagucuuaggagaaaauggcugugccuacaaauuccacuuuagaauaggcacuggagccucaauacuauccuuauuggaaugugguuuguuuuuaaguccuaagcagaauaauguagagaaguauaaaggaaaaagcaaagaaaugcagacccucucugaguuucugaguuuguaauauccaucuaaugaacuaaauaaauggauagcucauuuagggggcaaaauaggauucuucuuuaagaacaagaauuguuccucaaaaucaaaguaaugguagauuaaaaaaaaagaagaagaaaagaaaagaauuguuccagccaggcacgguggcuuacgccuguaaucccagcacuuugggaggccgaggcagguggaucacaagaucaggaguucaagaccagccuggccaauaugguuaaacccugucucuacuaaaaauacaaaaauuagccgggcaugguggcaggcgccgguagucccaguuacucgggaggcugaggcaggagaaucacuugaaccugagagguggagguugaagugagccgagaucgcaccauugcgcuccagccugggcgacagaacaaaacuccaucccaaaaaaaaaaaaaaaaaaaaaaaaagaaaggaaaaaggaaucguuccuugaacugcugauuucccuuucccaugaagagacagccaaauacuaaaaagcccuugaccagucaggguagcauauuuaugaaguuaaauguuuuucacuagcugacuugguaaagauggauacuauaaauuuucuugaugggaaguuuauaaauggcgauuagauuucgauuaucccagauaaucuguuuacucuucagucaugacugugaaauaccaucucucagagcuaaagucaguuauauaugauagaaguuggcaaacucuuuucuguaaagggacagugagaaaauauuuuaggcuuugcugaucacauaaggucucugccacuuagucuuuguuuucacaacccuuucacaauccuaaauguaacccuaauuguuacauuuagaaauguaauaguuacagguugaguauccuuuaucaaaaugguugagaccagaaguguuuuggauuuuggauuuuuuucaaauuuugaaauacuuuuauucauucucucucucuccauauauauuuuuuuuaacugauugagcaucccuaaucugaaaauccaaaauucaaaauccagaaugcaccagcaagcauuuccuuugaauauccuguuggcacucaaaaaguuuuggguuuuggaacauuugggauuuuucagauuaaggauguucaaccuguauucuuaugggccuuacaaaaacaggcuacaggucaaacguggcccucugagccauacuuuggugauucuuaaccuauaauaaagguucacaaucuuauauguaaaaucauugggaccaaaaguauuucagaauucaguuuuucagaguuucaaaagguaaucaguauauacuauauuuaacaccccccaguggagccuaggguagcaccccacaaucaaauacauuaauucuuauagcacaguauaugaauacuuacaguaaguaauauaaguacagaguguaaauagccuuacaccaguucagguuaaguuauaccccuaaaugaguacuucaaaucaaagacaagauuuaaaaacuuuguauucagaauguuauguauuucagaauugcaguuaaggaauuauggauugaauuauuccuacaaggaaauauguucuggguuuuaaguaacuuaagaacaaaguuuuaggcugggcacgguggcucacaccuguaauuccagcacuuugguaggcugagucaggcagaucacuugaggccaggaguucaagaccagccuggccaacauagcguaacccugucucuacuaaaaauaaaaaaaaauagcugcccaugguggcacaugccuguaaucccagcuacuugggaagcugaggcaugagaaucacuugaacccaggaaggagagguugcagugagcugagauugcaccacugcacuccagccugggcaacagagugagccucugucuccacauaaauaaauaaauaaauaaauaauacuuuuauaauacuugucauuuguaaauuagggauuuccucucuaauuaaauauguguuuuguuuuauaaauuacuauuauguguauucauuaauaaugaagaacuucccauuauaauuaaugacauguaagauaaacugaauuuuuuauaauguaccuuaucacacaguguaauauuugcccauuuccccauuuaguucuuggaugaaauuucaucuacugaaacuaaagaguccagugguacgagugagccugugcaccugaaagaaggguaauuuaaucaaauuagacgugaaagucauauaucaguauagauauuaaguaaguacaaagagcgugggucuaagagugaggagaucuggcuuugugugcuguguuagaacugccaaaauuagcagucagguaagucgccuuuacuguccuacaaacuuuauggcaaaaaagcaugauuuccugugcauacaguccuagaguuguuuugcaauuauagugagaugauggguauuuagaguacuuuuaaaaaguaacagcacuauuagucuuaauguaaaguguuuauuauaaguuaagggggggaaccacucauuugacccuuuuuuguucuguauaguacaauuaaaaauauuaaauuaauuaaagaccuuauuccuuuaguguggccaaaauaaaugcaacagucauggauagcaaaaacauuuuuauauauuuaauauaaucuuacacuacuauucaugucauuuaaaguuaaaggauacuucuuuguuuuggauuaacuuuuaauuuuuauagcuaaauguuuacaucuguuauguuggcagugagauguauaaaagagcucaaggaagaacucggauuggaaaaaagaauuuuaagaaacgaugguucugcuuaacaagcagagagcucaccuaccacaaacagccagguaguuguguuuaugcuuuauugugggguuuuuccugguucucagugaagguuucuuugccgcuuauugugacucuagugaauccuuucaguaauauuacuguaguuuaugguuucucacacugauacauacguacuaagaaugaaaaaauauuugacaguaaccccauguauauuauguuuuucucacauuaaauuucuugaguuucugaaaaugguguuccuucagugugcucuguuuucuaaaaauccauaguaauccauacuguuauuuaucaaagaacaacagcuaaaccucuuagaacaugggaguuucuuuaacucucagaggcaaaauuagcaagauuccauaucgaauaaaugagacuauuucuguccuuugcugggaaauaucagccaaaaauucccacaguuauaccauagauugugaucccuauacaguugucaaauucauccuaggcucuuagcuaagcuaaccccaagguggaugacuuaauaauuugccuugugagaagacucuguugccuuuacaagugggcuauuuguguaaaugaagccaucuuccuacagugugauuugagagcugcagagaggcaaagcuuauccuucaguagacugacacaguccuuuaaauaaacuacuuuugaguuuauuccguuggguuaauuuuccacagaaggccaggugugguggcucaugccuguaauccuagcacuuugggaggccaaggugggaggauuacuugaggucaggaguuugagaccagccugaccaacauggcaaaaccccaucucuacuaaaaguacaaaaaaauuagcugggcaugguggcgcaugccuguagucccagcuacucuggaggcugaggcaggagaaucgcuugaacccaggaggcagaggcugcaguaagcugagaucuugccacugcacuguagccugggugacagagcaagacuccaucucaaaaaaaaaaaaaaaaaaaaggaauuauccacagaaggccauuagcuucugauauuuuagcaagaagaauuuaguaucuagaugacagaucacaucuauauaguagaaucccuucuguccaaaaugaucaggauccagagauguucacuuaaccaaaccaaaagguugguuaaaagugagaaucauuuuaaaauaaacaaaaagaugcauauagaucuuaauuuauguauuuguuuaccagcauuuugguagagaaccaagauuauuucuuugacuauggaccuauagaucagauuuccugucuuucuuguguaaauauacccauaaugcaucaguuuucaggaugauuucuccaaaguaaaucuagaacuuagauacuugaaaaguaauucaagcacaaaauccucuuagauuuucaggauaguuacauuagucuuuuacagcugucuuaccuccacauaaaucagccuuauuuguggagguaugcgucuccuuuuuagaggcuuuucaaagcauuuaccugauuuucaaauaaguaauaaaccucuugguagugggcacuuacuuugucucuuuacauaaaguaaauuauaauuacaacauagaaaacuagcauaaauaaguuuagcaacaaacccaauggauauaguaagcaaaacagccuaaccgauggaaguagaagggcgcaggcuuaacagaguaccugagcaaccacaagcguguagcaccccgugagcaacauucaguauguuuuacagaggaaauggagagucuguuaaucuaucaaaucuguuagguaaagaucuguuaagagagcuucugcuguaaauucuggaauaauacaucagacauagggugcuuuaaagaggauauaacacaguuaaguagagugcuucaguggagacucuugaauaguagagugauaagaaaaaauuuuuauuucauaauucuuccuuaggaauggcuuaaccagaaugacuacaugugucccaguauauuagaaagauauaagaaaccaaaugcauuauacuuuuggguauauuacucagauaauuuguuacaacauuuacauacucaaauaacuaaaagucaauaggcuacauacaugcccuuccagauagcuuuuuauuuuuauuuuuuuuuuuugagauggauucucacucugucacccagacuggagggcaguggcaugaucuuggcucacugcaaccucugccucccggauucaagcgauuguccugccucagccucccgaguagcugggauuacaggcgcccgccaccacacccagcgaauuuuuauauuuuuaguggagacaggguuucaccauguuggccaggcuggucuugaacuccugaccucgugaccugcccccucagccuccuaaagugcugagauuacaggcaugagccagcgcgcccggcccagauagcauuuuuuaagcuaagcauauuuugaauguuuuagaaauuauaacuuacugaauacuauauaaauguucucaccuaugcauagcacugggugcuaauuauguuuacauuaauaguacauuuaaauaaaaguuaagguaaauuagucauucucugugaauaaaugaguucuuuuuucuucauuuaaagcauuuucuaaucuaaaccaauauucugaaguauuuuucgguuuauaaucuucuuuaagaauuagauagcuauggaccccuuugucuagaaaacuguaccuacaaacauagacaaaaaauuuugcauuuaacuucagggaguucauagacacaaaauuuugcauauaauaucagggaguucauagaccuaaaguucaucugugauucucaaguuaagaaccucuguucuggccgggcgcgguggcucacacccgugaucccaacacuuugggaggcugaggcaggcggaucaugaggccaggagaucaagaccauccuggccaacgcggugaaaccccaugucuaccaaaaauacaaaaauuagccaggcgugguggugugcgucuguagucccagcuacuugggaggcugaggcaggagaauugcuugaaccugggaggcggaggcuacagugagccaagaucgcgccacugcauuccagccuggguaacagaaugaggcucugucuccaaaaaaaaaagaaaaaaaaaagaaucucuguucuguccacugauuuuaagaggacaaaauucucuagaaugaugaggcuacuagagguauaaaacagacgcauuagaagcuauguuguuguuaagcauuaagaaguuuaaaauuuuggaaugacauuggaggaaugagauaugaaguuucaagcuuauuuaccaaagccugcaguuuuaagcuuccaugcuuuuuguuuuaacuauuuugauggauuuuuccaaaauauauuacaugcuucccugccuucuaaaaaagaguucauugaacguaaguuaacaucuucuagaugacuuggggcuaccauugauaauauuaauuguuauauggauucugauuuagugauauuuucagggcugcuuaaaggugugugcaacuguuuacuccagcuaaaugcauuuacuccgcagcuaaaugccuuggacugcugugcuuuuuguguuccuauguucgcuuuauacaguuuuucuguauccuuugugguaaggcuguggccuuaaauuucuugugaugucugugaaccauaauauaacaccuuauucccaucccaucacccaccucuauuuuuuacaguaguguccuauaagugaggaugcaagugcuauguuuguuuaaauuaugccuaagauuaaaaggcuuugaaugaaaacgucaggacuuucuccuguaaauaaaauaccugggcuuugcauucucuguuugguuguugagcaaauguuuugcuuacuuccaauuucccugcuguuuucuagguagccaagacuugcuaguuaauuagucuuuugcuacacuuacuaugugacuuuggugucugaaagaauaccucccaaauuuccuguaacauagaccuaaaucauugagucuuucacucucucuuccuaauauacaguaguauugugaaucaaguauuucugucacuuagugucaaauaauaugcauagucuuuucccaauuuacuggaaaaugaauuaguagaauuuucucuguauuaaggauuuuucuucaauaaguuuuuaaauuuuugaggccccuuuaggcaagugcuaacaggcaauaguaagcaacuaaucaguagaguuaaauuaacauguagcaaaugaauauuaucagacacucagccaucagucaugauuaccuugagagauuuuuauggcccuguguacuuacaauuaugauuuuauauugcuauacuauaauuuagucaucuucuacaaguaaaaguucucuuaguuauaugcggagaucaaacuaguuauugauguucuagccucuuuaugucucauucagccucaucuuuugcaguauccauauguaguuucaccagacuacuuuuugcagugccuucuuuacaucuuuugcaugcuuuuacauucaugcuuuugcauauguacauaaaaauaucuaccuaaaaauuccuuuauuuucuccuuuaccuguguaaucuguuguccuuuaagucuuagaucaagugucagcucuuuauggaagccauuguaagccucauauggcuaccucaguguagccauucccuuacuguguaucuucagcuacguggcauuacuguguggucauuacuuuuguccaucucuuccccuagucuuuaagauccucagugguaaggaccauauuauuacuaguggcauaaaggcauauaguaaguauucuucaaagaacaccaugucuuccauauaugcugucaucugaauuacguuacgaacuacuugucuuucuaaaauuucugccaggcauacuaauucaucuuugaaauucuguucuguagaauuuaauuagauauugucuacuuuggggagaccuguuauacacauauacauacacacaacuuucaugugacauuaaaugcccuagcuuauauagccagcccuacccuagcucauauagccaguggacauuguaaaagaaauguccaugauauuuuaaacauaaauguucaauacacugaaguugacacgguuuucaccuaccuguauuuucacauacagggcucugcagcuuuuuuuuuuucugauagcuaaagaacaaaauacaucauugauucaaucaugcauuuauucaacagguauuuuauugagugccuacuauguaccagacacuguucuaggcucuggagagaaaaauaguaaacaaaacauaccaaaucccuguccuuauagaucuuuacuaagacaauaaacaguaaaaaaaagaaaauuauauuuauguuggauuauaauaaaucagaugaacaaaaaagaagcagggacaagguacagaaaaugauggguucagugaggugaguuaaaauauuaaaaggucuaaccagggaaggcuucacugagaaagugacauuugagcaaagaccuaaaucuaaagauggucggggagugaaccauguggauauuugggauaaaagugucacagaaauagcuaacagcacccagaacaaaugccuugaaauagaagcaugccuggaguguuaaagagauaagagaaagcucuuguggcuggaaaauugaagaagaggguaagucauaggaacuaagaucaaaaagaucauagaagugcuagauuuuauaggaccuugugggcuuuuacuuugaguaaaauggaaagacauuggagagguuuaagcagaagaauaacauuguuuaacuuaugucuuaauaggguaacuuaugucuguggaguguuacauggagaaugaaugaagggcacaaggagagcaguuaagagacuacuaaaauauucuagaggagaaaagagaauggcuuggaucuguugguagcaguagaaaugauaaaaauggaucacauucugaaucuauuugaaaaauaguacccagaggaguuagauacugggagugagagaaaaaggcaaguuaaggauaauuccaaggauuugggcaugaaguugccuuuuuaaaaauagauaaagaacucuuuuugaggaaaaaaaagaaguaaagaaggggaacagaaaaugauggagucaguauaaaacugaacuugaaaaaaaaaaagaagaguccugguaaugguagaaaaaaccaagaguccugguagugguagagaagcuuauauuagacuaacucuuauagauaacaauuauaaaccuuuagcagaauauauauauagcaauucucugaagaauuugacccuugaaagaaaggaaccaugcuggcuaagauugauugauugagauggaguuucacucuuguugcccaggcuggagugcaguggugcaaucucagcucacugcaaccuccaccucccagguuuaagugauucuucugccucagccuccccaguagcugagauuacaggcaugcaucgccaugcccggcuaauuuuguauuuuuaguagagacaggguuucuccauguuggucagucuggucuugaacucccaaccucaggugauucacccaccuuggccucccaaagugcugggauuacaggcaugagccacugcgcccggccuaagauuuauuuuuauacagcuuuuccccuugaaagcacucccagucuagccaguuugagguggugcuaaaaugcaagcagaaaacuaagcuuuauuggcuugagauaccaaaggauggaguuuagggcuaccagagaggcuggaaauugaggcauaaagaggaguucuucagucugcaugugaacuccucugaaauauuuaguugacucuuaaaccgcuaaugcaagagggaccuccaaaggggcuagugaaaagcaauaacugaaaacuugaaaaagaugagcagagacuucaguuucuguccgccucaaaggagacagaauuuggaauuuuacuuagagagcuuagcaaacacuuaaauauuuucaucaaaaucucaaaagagugguggcgcaguaguaaagacuauauucuaggauuaagaauaaacaaaguauaguauaaacaaaguauaaaaccaacccucacgauaaucaccaaugauguaacuucaagggaagguaacugaauccauaguuucuacaauguuuuauucaugaaggccaguauguaauggaacauuaacaacucaagaagaaacacagaauuauaaugcauaaucuggagaaaaggcgaucaguagaaguagaccccuagaugaucuacauguuggaauuagcagacgugaacguuaaagccucuauuauaaauauuucaaggacuuaguggaaaaguagucaucaugaguaaagaaauggggaaucucagccaaaaaagaaaauaaaaagggaaucaaauggaaauucuagaauugaaaagcacgauaccugacaucaaaaaucugaugggcuuaacaacagauugguucacugaacuugaagaucgaucaguagaaaugaaccaaucuagaacacagaaaagacuugggggaaaugaacaaaaccucagugacccuuuaguacaauaucagguagucuaacauaugcaugguugguguccuagaaggagaguagagaaagaauuggacaaaaaaaaaaauuuuuuuuugaagaaauaauggccuaaaauuucccaaauuuggugaaacaguaucuuauagaucugagaagcucaaugaacugcaagcaugauaaacgcaaaggaaaccgcacuuagacauaaaauagucaaaccagagauaaagagaaaaucuugcaagcagagaaacaaaagacaagauacauacacaggggaacaacaguacaguugacagccaacuccucauaaaaagcaacuaaaacuggaggacaguggaaugaccuguuuaaaaugcuaaaggaacaaaagucucaaccuaacauucuagagaaaauuuucuuugaaaaugaaaauauauuuuaaauaaaugaaagcugagagagacuccauugugagcaagccugcacuauaagaaaugcuaaaggaaauucuucaggcugaaaggaaauaauaccagauggaaacuuagaucuacaaggaguaaagagcacuggaaaugguaaauauguggguaaauguaagaaugccuguuuuuuuuuucuccauuucuuuaaaaagcaacuguucgaugcaaaauguauaacauuuaauuauaggguuuauaacauaucuggauaugaaauauaugacaguaacagcacaaaggaaggggguggaguaaauuauuccaagggucuuauauuuuaugugaagugaugcaagaauaauuuuaaguagacugugaugaguuaaggcuguauauuauaauaucuagaacaaaaauuuagggaaauacuugacauaacuaauccauccccucuccuccucccaaacaauaaauaaauuaaaaugugaggaagggaagaacagaggagcaaaaaucagaugagacagacagaaaacguauaacaaaaugauagcuuaaacccagccauaucaauaauuacaguaaauguaaaugaacuacaauacauugaaagagacuaucagacuauauuuuaaaaagcaagauccaauaauauacuuucuacaauauauccacguuaaauauauuauaaaagcacagauagguugaaaguaauuggguggagaaagaugauguaaacaguaagcaguaaucccagaccaaguagaugucaaaacaacuuuuaccaaauauguuugggcacauuuuauaauggcagaaggagcacauaauccuaaauguguacauaccuaauuacaacuucaauguaguuggagaaaaaaacagaauugaaauaggacaucuacaauucuaguugaauuuuuuuuucuuuuuuucuuuuuucuuuuucuuuuuucuuuuuuugagacagggucuugcucugucucccaagcuggagugcacagacauagcucacugcagccuugaccuccugggcucaagagauccuccugccucugccuucuguguaccugggaccacagguggacgccaccacaucuggcugauuuucugauuuuuuguagcugcaaggucucacuuuguugcccaggguggucucaaacuccuggacccaagugauccuccugccucggccuagaauuaacagguaugagccacugcaccuggccuguacuugaauauuuuaauagucuucucucagcaauuguuagaggagcugagcacaagaaccaguuuucuuacagaaguuugaaauaauacuaucagucaccuugaucuaauuuacauuuaugggacacuaggccaaacaggugcagaauacauauucuuuugaaaugugcauuggaacauucaguaaaauaggccgccauaugcugggccuggagucucaguaaauaucaaaagauugacuuuuuacaaaguauguucucugaucacaacagaauuaaugacaauaugauaccuggaagagccccaaauauuuggaaauuaaauaaaauacuucuaaguaaccuauagauugaagaauucacaaggaaacucaaaaauauuuuuaacuuaaaugauaaugaaaaugcaacaaauauaucaaaguuugugggauacagcuaaaacaguauguaaagggaaauugauuguuauuaacaaguaaagaaaaucuuugagccuuuauagguuaggcaaagauuucuuacauaacuaaauguauggucuauaaaagaaaauauuugauaaauuggaucucaucaaaauucaaaaacauuucaaaagaggaccauuaagaaaaugaaaagguaagcaacagacuggaagaauauauuugcaaaacgcuuaucuaauauacuuguaucuagaauuuucaaaaacccaauuuaaaaagaggacgauagauaugaacaaacauuuuaucaaagagauuauacaaguggauaauaagcauaugaaaagaugcucaacaucauuauuagggaaaugcaaauuaaaaccacaaugagauaccauuucacaccaacuagagugucuguaacaaauaagacagacaauaccaaauguuguugagaauguggagaaacagaaacccucauacauuuccagugggaauguaaaauaggggcuuugacagucagcaacugggcaguucucagaaaguuaaacauaaaacuacuauacauguaaccuagcaauuccacuguugguuaccuaccccaaaagaaaugaaaacauaugcccacacaaagaaucggagugaauguucagagcagcguuauucacaauagccaaaaacuagaagcaaccuaaaugucuaucagcuggugaauggguaaauaaaauaugauauauauaugcaauagaacacuauuagcaauacaggcugggcgugguggcucacaucugaaaucccagcacuuugggaggccaagguaggaggaugacuugagcucagggguuugagaccagccugggcaacauggugaaacccugucucuacaaaaaauaauaauaaagaauacuacuagcaguaaaaaagauugagcuacugacacaugcugcaucauggaugaaccucaaaaaauuacgcuaagugaaagaagucagagccaagaaauuacguacugcaugauuccauuuauacgaaguguccagaaaagacaaagguauaggaacagaaaguagguuaguggcugcuugggacagguugggaaccagucccaaguagccgauugggguauaaacaggcaugagggauuuuauugguagaaugaagcuguucuaaaauugauuuauggucaugguuauaccacucaguagaguuacaaacaaaccuucauuuguacacuuaaacuggaugaauugauaugucaaauaggcucaccuuaauaaagcuuuuauuuuuaaaaaaagaaaggauaaaaucaaauauauuuucaacuuaaacuagaaaaugagaaaauaaaccuaaaguuaauugaagaauggcaaaaauaaagaugagaguacaaucagugaaauaggaaacaaacuaauagugaagcauaacaaagccaaaagcuuuaauaaaauugaaaaaugccuagaaagacugauaaaagaaaaaaaaaucaaacacaaaauuaccaugauuaggaauaagacuacuacaaauuccaaugacauuaaaagacuaaccagaaacuaauaugagcaacuuuauaucaauaaauuugacaauucagaugaauggacaaauuucuuggaaaacaauuuacuaaaacagaugcaagaaaaaaguagaauaucuuaaaaacccuguaucucugcuugugaugaaauguguccuaaaaaagaaugccaggcuuaaauagcuuuacugguaaagucggccaaacacuuaaggaagaaauaacgucaaccuuacccacaaagucuuuuagaaaacagagggaaagaauacuugccaagucaucuucugaagccugcauaacucuaguacuaaaacuaaagauuuuucaagaaaaaauacauauaaugaauuaaauccagcaguauaugaaaaggacaauccauaaugaagugggguuugucccaaguauauaaaguugguuuaauaucugagaacuaaucaacauaauuuaucuuauuaacagacuaaauguauuugacaaaauuuaacaccucuuugugauuaaagaaaauaaaaacucuugaaugaagucuaaaagauaaucuccuaaaucugaucaaaaguguauguaagaaauuuguaguuaaaucaaggauuauccccuuuaauaaauucuguucaauacugaagauuuuagccaaugcaguaagacaagaaauaaaaggcauauaguguuauauugaaacuccugaagaauccucagaacagcuacuugaacaaauaacugaauuuaauuuagcaaggucuugggauaaaggauaaauauguacaaaucaauuauauuucuacaaguugcaaacuguuagaaaacaaaauuuuaaaaaucauacccuuuacaguaguucccccccaaaaaaacccuaaaauacuuaggaauaaauuuaaccaaagaaggcugggcacggugguucacgccuauaaucccagcacuuugggaggccaaggugggcagaucacuugaggucaggaguucaagaccagccuggccaacaugcugaaacuucgucucuacuaaaaaauaccaaaaaaucagcugggcgucguggugcaugccuguaaucccaguuacucgggaggcugagacaggagaaucacuugaacccaggagguggagguugcagugagccgagaucgcgccacugcacuccagccccggcgacagagcgagacucugucucaauaaauaaauuaauuaaaauaaauuuaaccaaagaaguacaacaccucuacacugaaacuacaaaacacuccggagauaagguaaagaaagucuaaauaaaaagagacaugucauguuuguggauugaagauugaguuucuuuguuuuuuggguuuuuuuuuuuuuuuuuugguuuauaaaguguaauuuuauuuuauguuacucugcuguuacauagggcauaacauuuucacaaggcuuuuuugggacuacagucaaugauuagcaacacacaauaguguuccaacucuaacaaucacuagacaaacaggacacccucucacgugcacagaucugcauagaaaaguacaaaaguuuuaaauuuagacuuguguacuuuaauuuguuuccccuuucuaguguauuaaaaaaugacaugcacuuuaauuugccaaaagcaauguuguauucuggcagcaacaugcuacuucuauuacauaguaaagugaauaccagaacuacaaagacaggagguauaagugaauuuuuauugggaagggagguugucaacuuaaacagcagcaaauaaagagugaauaaggaaacucccuguugccacagauauacaugaccuccuuaugugauaaaggaggcauuucaauuugugaaccauagccagagauggcaagugcguuuucauucagucuaauacuucuggauuccuacuaaaaaggaauacauuaagagcauggaaaaauugcuuauugaaaggaaacccucgaagaguaagggagggaauguagaaauuaaguuauguagaacacucuuuaaauuguaauuaacuacauuuuuauaucuucacaguaauacaaaacacagucacuugcagaacuguuucagauuacuuaaauaccagauacauuuuuaguccucuacauaaguguguggaaguuacuuacguuuauaugaaaugaagcuauuaauauuuuucuacagcaguaacugcacaccaggaaggccaagacaaacacaaaucagggaaugaaguuuucccaaagcugcagugugaaaagacuaaaaacaguugacuccaaacacaugaaucgguuucuuugcuauaggaaauccaaguggaauaaggaauggagauguguaaaaagguuucuugaaggaaagaaggaggacacccuguauguauuuaguuuucagccccuucuacugccucacauucuucuccugcacugucugauguccaaaguguuagguugucucuaagcaauugcaugaugaggguucuugucggaggugucagucuucugcucaauguucaagaugagccuccaggcggaccugcagcccccgaccacauucuaauaaggagcagguugcgcuccuuauuagacagcucggcgaccuacuuggucacagccuucaugcagguggccaugucaucguagugcucugccugcuuggccagcuuggccuucaggaucagcucccucuucuccuugacgggugcagggcagagggcaaagagagcaagggcaagcgccgacccggagcaggaggaguccuucagagcuucacaucuccguggccacaacuagagucccaccacuuugaucugccuuuuagauaaguauuuuuuaagaagccacaucucccugaauucaucucgauuuuaacacaaucccacuccaaaucccagccaguuuuuaaaauaaaaauggacaaguugauuccagaauuuacauggauggaaaaauaaaggucuuaaccauagccaaagcaauguugaaagguaaaacaaaguugagagcuaauuuaaagacuuacuguaaagcugcaguaaucaagauuguagguuuaggauaagagagaaagagaucaauggacagagcagaaagaaacacacacauaaauauggccaauuccguuuuaacaaagcugucaaggcaauucaguagggaaagaaaaggcuuuuuaacauauggugcaggaacgacccugauaaacauggaggggaaaugaacuuuaccccaccucacacaacacaaaauuuaauuuaagaugauggggccgggcacaguggcucacaccuguacccuagcacuuugagaggcugcggcagacagauugccugaucucaagaguucaagaccagccugggcaauauggugaaaccccguuuguauuaaaaauacaaaaauuagcugugcaugguggcccacggcuguaaucccagcuacucaggaagcugagguccgagaaucacuugaaugcuugaacucgggaggcagaaguugcugugagccgagauggcaucacugcgcuccagccugggcaacagagagagacugucuccacugucuccaaaaaaaaagaaaaaaaaaagaugauagaaucauagaccucaaagaaaauguggaaaaauaucuucgaaaccaugauaugcuaggauuucuugaagagaacauuaaaagcacugaacauuuuucuuaaaugaauuggacuucauugaaaagaaagauguauuuucuccauuauucauugugauuccuuuuucuuuuuuuaauaugaugaccauaaaauguauuacuuggugguugaaauuuuucaagagcuuguugggguuuguugaauuuuuugaaccauaagauaauguuuuucaccaaauuugggacuuuuuugacuuauuucuucaaauuucuccccuuuuucuucuagggauccuccaauuuaugcugauaaauugucucauggaucucacugagacucaguucauuuuucuuuuauucucuuuggucuccaaaucagaucauuuuuacuuaaguucacugauuuagcucaugugaauuuuucauucaucuguuguacuuuucagcuccagaauuuccauuuaguucucuuuguacuuuagauuuuucuguugagagccuauauauguucaguugcuauuaguauauuuuuauugaauuauuucagcauauuuagaguaacugcuuugaagucuuaggcugcuaaauucaguaucuggacccauucagaaucaguuuuaguuggcugccuucuuucccaaguuaugugucacacuuuccuguuuuuuuauaugucuuacuuucuuauuaaaagcuagacauuuuuaagaucagcaguccccaaccuuuuugucaccaaggaccaguuucauggaagacaauuuuuccacggacugguggggggucauguauuugggaugaaauuguuuuaccucagaucaucaggcauuagauucucauaaggagugcacaaccuagaucuguugcaugcucguuucacaauaggauuugcacucuugugaucucaugccacccuuaucugacaggaggcagaacucagguaguaaugcuugcuugcccacccacugcugcuccugcuggguggcccaguuccuaacaggccacugaccaguaccagucuaugguccagauuuuggggaccccucuuuuagauaguacacuguagugugucugcauuugguuuguucugaaugcuugccuagacuaaaacugcagucucucucucuuacuuacaguguaucucucuguucagauguuucccucuaacccuagcuagcucccuagggggccucaccugaacuugauuaguuuaguggucaacaaaugaauugagcaggcagcucaaauaccucaaaggcuuccacccucugucaucugagcuguguguggauuagagaauacauucagagucacagcaaauugacgucuccccaggcuuucaguuuuugccagacucugggauauuccacauacaugccuacguuagcagucaggcagggaucuggcaaguuuauuaucaggcuuucauagcccucuugcuuccagauuucauccuuaaauggaaucuguaaccuccagccaguaaaacuuguauuuucauugccuaacuuggggauaauggaaacacccccagguaggaagaccauaaauccacaguucuuacccuaugcgguuuuucaugaguaaacuuaucaccguugguuguuuucccgugcccugaaguuguuuuuaacaauuugcccaguuuuauacacccaucuuucuuaacacuauuaucaaaaauacagucaugguaacauuguuuuagcugugucccuuggggccaauauguaguuggacauucauuuuuauuguggugguaauuguauuuuuuuaaauuuaggccaggcacagugguucaggcccguaaucccacuacuuuaggaggccaaggcggguggaucaccugaggucaggaguucgagaccagccuggccaacauggugaaacuccaucucuacugaaaauacaaaaauuagccaagugugguagugggcgccuguaaucccagcuacucaggaggcugaggcaggagaaucguuugaucccaggagguggagauugcagugagccgagaucaugccauuguacuccagccugggugaugagagcaaaacucugucucaaaaaaaaauaaaaaauaaaauuuagauauaauucacauaccauaaaauucacccuuuuaagguauacaguugauugguuuucaagauauucauaguguugcgcaauugccacuaauuccaaagcauuuucaccacccaaaaagaaacccuauacccauuaacagucacuccccauuccucccuucucccagccucugacaaccacuaauauacuuucugucucuauagauuugcccauucuagacauuucauguacauggaaucauauguagccuuuugugacuaacaucuuucacucagcauaauguuuuggagguucauucauguuguagcaugaaucaguacuuuauuuucauggcugaaucauauucucuuuuacagauaauaccacauuuuguuuauucauucaccaguugauggacauuuagguuguuuuugguuuuuggcuauuaugaacaaugcaguugugaacauucauuuacaaguuuuuguguggaugugucuucagcucucaugguauauacguaggaguguaaucagugaguuaauaggguauuucuguuuaauuaggagguaaugacaacuuuaaaaccugauuucagccauuuaguaggaaauuuaaugcacucacauuuauugugauuaccauuacuacuacuuuguuuuguguuuucuauuuacuagucuuuucuguuucuuggguuuauuuuucccuuccuuuuuauuggaauaguugagcauauauggguguuugcacucuaucuuucugucucuaucuagugaggaaacuugacuauccuauuuuuacuuuuuaaauuguuaacaaauuaaaacuuaaauguuuauauuaaugucuacaguugauccaagucuccauucaagcugggaaagaacauuaucaugcuuucaauuauucuuuuccuagcaucucccuaaagaagucaucuggaauuuuaauacuuguuucucuuguuucuuuuaccuuuuuacauuauguuuuaaugauuuugcauccuugccuaucaauuuuacugauuucuuuggcccaacacuauuuuuuguauaacacaucuuuuuccuggauucauuauuauuuugugggaguacuuaaggaauucuuucagauaggcuuuauggcugauaaguuuucugaguccuuacauauacaaaaaugucuuuuaccugggguguggggaggggggagggauggcauuaggaaauauaccuaauguaaaugacgaguuaaugggugcagcacaccaacauggcacauguauacauauguaacaaaccugcacauugugcacauguacccuagaacuuaaaguauaacaaaaauauacauauauuaaauaaauaaauaaauaaauugaacaggaauaaaaaaaaaugucuuuuccccuuacucuugaaugauaguucaauggaguaaacauacuccauuguuuacuagcuuccauugcugcugaugaggauuuugaugucacucugauucucagucuuuugacucuucuaucuaaaaacucuuaggacucucuguagccuucaaguucuaauguuuuucugccuaguauuuaggagguuuucuuuuuucuuccauccugcuuaguacuugguggauaacuuucuauuugaagauuucugacuuuaucuuggggacauuuuuauguguaauuuucuccugaauacucuuauuugucagauauuaaaacuucuaaauccauccacgaugguacuuaacuauucuauuuuugcuucuuuuucuucuuguacuguauuuuuggaaagaccucaguaaaaucuuucauuuucacuaacucacauugcaguucacuccaguuaacacuguuaacugugaaauuaacccuaaugauaucaugacaguauaugugccugggagcaaugcccuuucuccacauaugcuguguuacaauuuguccagaaaugaauaaauauagcaauuuucaggguaugugcauucuuuguguauucaacaaaucuaaagauagaaacuccuugaaaaauuuuaaaauucucugacuauaaugcccccuguaaauuaguacccaaagacauaggucucuucccccccaauuucuuaaacuccugauuuccucagauguuauccuccuuuguugcacauaugucucuucuucagagugaugaguuuccuuaacuggugauuuuuuuuuuuuuugguguuuuacucaucuuuguguuuugcaguccauuuaccuacuugaguguugaguagcuuacugccaaugauuaugagggagggacaggacaagcugcugaggggcaggagugcuguugcuugucuucugguguggguauucucuccuucccuucugagaguuagcagcuaccugugacauugcacugcucugcagcccaguaugcauccuugcugcuuuagccugugaauauaugccucuguugacugcugcuuagcacaaaccugggaauggggagggccugauugacccagcuguuccacaugcaacucaccgauuaaucauccugauguaugucugagugcccccaaccuucagcugucuguguccacuggcucuggcuugaaacucuuccuuaaccacuccuacuuuugcagaugucuuauuguacaucuggcuuagacuauggcuuccuucaguuacugccucccugccccaccauucaauuccccacccccauaaauauaaucucgucugauucuaggagauugcugauagucuuuccuuauuaucucaugcauuuaugauuuauauuuguuaacuguaaaugucauuuccucagaaaguuuuuuccuagccacccaauuuaaaguaauuucucacuuucuaucacaucaccucaguuuauuuucauuguagcauucaucucuauuuaauauuuauggucuuuugucuuuccagaccuaaaugcauacuccuuuaggagccuuauaugaucuauuuacagcuauaucauaagugguuagaacagugccugauauauaauagacauucaguauaugauaguugaauuaagugacuuuaucuuuuuuaaaaacauuauaugucacauuugcuugaauuacauaaauuuuagauuuuauaccagaaaccaggcuuaucaaauauuccaucuuaacaucucugucaagacaaaaaaaaaagaaacauaccuuuauuaaccaaauaguuuucuuugcccaaaacuaugcaauuaauugguuaaauaauauaaaaugcaaaguuucuuaaccuccagcacuucaaucuauaugucauucaagcaaagcuugggggugaaauaaaagcaaagcuuugauuuuucuaagaacaauauuacaaaaugaccagaaguuagaauuauguuugcuuauaguuucuaugacuaugugagauauaauuuauucucagguaaaucguuaaguugaaaugcaucauauucuuaugccauguuauuauggagcuccuuuagcaaauucaaauuuccuuaauggaauuuccaaagucuuagguuaaggauucauucuaccagauaagauuuuuacuuuuuuucccuacaucucuuaaauuuuguagcuuuugaucagguggcugaucaacccauaugggacaauaaugaacaguuuuucaguuuagaaauauuauuuugaggguuaaucccuucauuaaauuuagguuagaaaaauauaaaaaugcacauagguagucauagucacugcuuacauaguaacuccuccaugaaagaaaaguccuugucuaggcaaguuuugaguuggccucuuuugcugagucuauuuuuucaguccccauauauaaaauuuuguaacuuucuuacguucuacacagagaucaaauuuagucccagauuuuuccuugaaaauguuuuaauauuauauggcaaagaaaagcaguggucacuuuagaagacaaucaaaauucaucuguuccaugaaacaaauauuuauauauaugccauuuguaagucuucuguagguuauuuacacuccuaccaucaagaggaugagcuuaaacccuacagaauuaaccucucaucuuuauaauucugauggaaauuacuuuaauuuuguuuuacuuuuuuuauuauuuaggcaaagaugcaaucuacacaaucccaguaaaaaacauucuugcuguggaaaaacuggaagagagcucuuucaacaagaaaaauguaaguuauguaaauaaauauuuaaagcuuucugaacugcauauauuacuuaaguauuuguauuucgagguauuuguuaauaccuuguauuuguaucaccuauuacuuagauauuuguauucaaauuuucaagaaguuguuuauuggauuguuuacuauuaaucauuaauaguucauaaauagcuagcugaaacucugucuuaaaauuguccuuuauuguugaugccucauauagcuugccuaguuuguuaaguuaaaaauacuuuucucaagauuucccuguuauacugcuguacaugauauucaaguuucuaaguaauacagucccaagcuaucuguccagcuuugucuucugcucccauucagugcauaccauacacuuaagccaaccaggaugauuuccuuguuccuaaauauuuuucuacugcuuuuucuuuauacuuuuucuuccauuaacaauucccucccuuuauucuuaucuauaugauaguccauuccuuuggauauguguggcuucuaaaacuuacauucuuuuguacugcuuaguaccaugugacucagauuaugcuugggacuaacuugcuugaaacauaauaauuucuaagacaucuuagcaccaguuaucuagccaagcaacuagauuccuuuagguacuuuucuucuguuuuguacuguguguugguuuuuggacucuugucacuaacuuuuuaucuuaauugccuaugaagauguuccaaguaauacauacggagaaaccacucuauguccaggcaaauaacuguguagaagcuaaugaauggauagacguacucugcagggugagccgaugcaaucaaaacaggcucaguuuuuaucaucccucuguguaucugaacggaaauuggcucugcugucaggagacuggugaaaacacucucggcugcaagccauguacugcguaaguuucuuucugauuauaaaagcagugugucaaaauuugauauauccaugcaauguuaauauuauuuguccaugaaaaggaaugacauacugauccaugcaacaacaaggaugggaccuugaaaaauuaugcuaagugaaagaagucaaucauaaaggccacguauuaucugauaacauugauauaaagugucuagaauagguaaauucauagaaacacaaaguagauuagugguuacaagggauaagaagggaggaauggggagugcuauuggaugcagagauucuuuuaggagugaagaaaauguuccaaaauuaauagugguugcacaaguuaaaaaauuuuaaggcaauguuuaaauagaagcaugagcuugaaccaagauaucaagaaagaaggauccuuagcauucucuuucuaauuguauggaacaaccauuguauuucuauagacuuaaguaauaauauauuguuuugugaugaagcauagguuguggaaaugauuuuacuuuaaaauuucccuccuucugauuagagucacauaacaaccaaaacucuccuuggccccacuuuauuuuaacugucaaaugaaacuaaauuuccagacuuccuucugcaaaagucugugguucuauuuuuagucucaaaccaucagaaguccuuggcauguuaacaaaauaaaauuuguauaauaucuuuauuuuuuuauuuuuaccauagaggugucccugcagacauccaaauagauauugaugaagacagagaaacagaaagaauuuauucccuuuuuacccucaguuuacuuaagcugcagaagauggaagguaaauacacaaucuauuuuuauauaaccauaaucuuucauuaccaauuccuaaaguauugcuuuagcauuauacaaaaguugaaaauacucauagauuuaccaaaauguuauuuauugaaaguugacaaacccacagagaggcauuuuucauugacauucaugaaguaaaaauacuguuuuugcaugaaugugaugauccuaauaaauaaaauguauauauuuuaguuaucucggcucugccaagggaaauccccucagcauaagacacuugaaaaauucuuauuuguacuacauauugcauuuauagaauuuaguugucugaucagagauuuauuuuccugcucuuuguagaggcuuguggaacuauugcagucuaucaaggaccacagaaagagccugaugauuauucuaacuuuguaaucgaggauucuguaacaaccuuuaagacaauucagcaaauaaaaagcauaauugagaagcuggaugaaccucaugaaaaauauaggaagaaaagauccaguagugcaaaauaugggagcaagugaguaauuuuuaagcuauuguaaacauauuuuuaaacggaguuugagauugccucuccugccccaaccucacaccuccugcucacccacaucugucaacaucccgcucagggccauucucuggugcaaguuucccuggccacuccaagugcucuuuguguuguucaguuuagccaucauuucacuguguuggugcuauacuuuaucgacuuuuuaauuucauauauauguauaugaaauuauauaugauauauguauauaaauauauauuuuauauauauuuauauuuauauauuauauauuuauauuuauauauuauauauuuauauuuauauauuauauauuuauauuuauauauuauauauuuauauuuauauauuauauauuuauauuuauauauuauauauauaaauauauauauauauauauuuaguuuuuguagagacagguucuugcccugucacacaggcuggagugcaguggugugaucauaauucacuguaaccuccaacuccugggcucaagcgauccucccaucucagcaucuugaguagcuaggacuacaaguguacaccacugugcccagcuauuuguuuuauuuuuuguaaaaacagggucucgcuauguugcccaggcugguuuugaauuccugaccuccagcgauccuccugccucgucucucaaagugcugagguuacagauaugagccaacaccaccaggcuguaaccaguuuuaauguuacauucaguuguaauucauuucuugaauacuuaguagcucuucguuuuguuuuuguuuuuacugauccuccuucuacaguacauaauaagaauucacaaaacucacccccaaaaaaauuaagcuguaaaagugcuagaauuauuuuauaguugauuuuuuggaccacuucagguguagauggauacugcaauggauaacaacagcaacaacucgcauuuauugggaacuuacuccagcaaggggcacugugcuuauaguacuuuacagcuuauguagauugcuuuuagaagcaaguuaaugaagucccaauugagguggcuuaaacaauaaaacuauuuacucuugcaaauuaaguaguuaacuucuacaguugguuaauucagcagcucagcacugucaucaaggaacaccugccacucagccaaccucaacaaggugauuucucuccuccucaagcuuguucccccauggucacagaugagcugcaauaauucagagccccacauuuuuauaugauagcauccagaggcagaaaaggcuguuuucuccguacuaggagaaaggaaccuucucuagaguuacccccagcuuucccugaaacacauggcuacccagugguagagcagaaucagggucuguuacaaagaaguggauagggcggggaugggucuugggccagcaaggaacaguguuugccacagugaacacucauugauccucaaaucagcccaacuugguuuuauccucauuuuacagcuagagaaacggaggcuuagggaagcuaagugccuugcccaaggucacacagcugacaagucacacugcugacuagggcucugaauccuggcccuaccacuuuaaauguucuuugaaaaauaugugaauuaauaauuauauuuuuuauucauguacaauaaaaaucaauuugacaaguauaaauauuuauauguucuuccuagauagaugccucaauuagaaagguuauuagaagcauccuaauccugucuuuucuguauuaauguaauugguucucuuccaacaguaguaauccaguuuccuuggagcccugggaaguuuccauaugagaucccagacauucuuucuuaaauaguaccucuccacucauacccauacacaccauaccacuucccagcuuuauuuuucucuauuaaaaaauaucaaccucuaccauacuaaauaucuuauuaauuuuauuuacccuauaccagaguguaaguuccaugauggcaaggguuuucuuggucuguuuuguuuacuacuuuaucuuuaaguucuacacuagggucuaagauugaauagguggucaguaaguacucauugaauuaaugaaacaacauuuggcaugagagauuauccagggaaaauucuaaauacuuaauggauuauauauuugucacccuuuaaauuuuuguauuucuuaaauuuugaaaaaugacuuuuuuucuucucuagggaaaauccaauuguugggaaagcaucuuagaguuuaacagauugguucagaagaacuggaaaauauuauuuuucuuggagcuuuucaauucaucauguauuuuguucaugguauuuaagaaugagcauccgcuucaaugucaucugccuccacauuguauuuaauauuuaauaauugaaauuaauuguuugggaauccugguauugauguauuacuagagaauuuaaagcccaagauucccuucauaccugugugaccaaauccauguuucugcaacuucuuuuuaaucgaaagaaucuuccuagaaaagcuuuguaacaaagggagaacuccuccguagcaagaaaccaucucuucuuguaacacucuguucuguggacuuguuuucacuaccaucagugccugcucuauacugccaacauuguguuuuacuagaaaauuccaauucaugacaguucagagcuuuucauuuaguucauguagacccucccacuuuaaaaaagaaaaaaaauaagaaguguuuuuccuuugguccaucagucauuacagguuccauucaagacagugauagaaacuuuagaaaacugccagagcauacuugaaaguugguagauccuuuugccuaaagauguaaacaaaacucaagacagaaggaaucagggaauaugugcuauugugugcaucuuguuuacauuugggaucagugauggcaaaagaaguaaugagaccacugaaauuguuuucauuguuuuaaauaccagguacucauuuucuugauuugaaaguuuaacaugacuucuaaggacaucucuucaaaaagaaaguaaacagggaaugaagguggugggaaaaucacuucacuucacccacuauuucauguuguaauaagggccaccauaaggaugcccuccucauaguguucgguucugaucuuccucgagaacagucacuuggcgcacuuuaauaaucuggacugcuccagauuugacuuuagauacuccaugguaucuagucuuuaugaucaguugaaugaucaguguuuaagucuaaaaauaaugcuuuccugaaaauguuuauauuucauugcuguuuccuuauugccugcuagccaaauggaauuugggcaagcaacucuuugaagacuuuuuuacccuagaaauuuacuuuuguccuaaaaacccuaacuguaaauaagcagucgaagcaaguugccaccuugaaguugagggauacacuuugcuucaucaguauuaaaaaccaugguacucuuauuuugucuuuuuuaauucaaaacauuuucuaaaugugguacuuugaaccuuggaguauuuacauguuucuguucaaaacugugacuuauuaauguaagucugcuaguaguacuuuuuuugucugagcauaagcuauauuucaagauauacuuugccaauuuuguuauugguggguaaucauuuuuaaauuauauuguuauuagguaauuauuuuuaaagacuacuggcauacaaucaaaguuguuccauaaaagaauauaacugagcaauguauuucucuaaaugacuuguaaaaaucaaugaauuauguuuaagucugcauuaugguagguuauuacucccagcucauuuuaaagacaaguuugaaagaguccuuuaaauuuuauaagcuuguagauuccauaaacuacacugauuuauacauuugaaagaauuuagccauuuaauaaauuucuuauucucaaauugcauuuagauuaaaauuccuuuuaagagugucugaaaugucugccugcgaagaacauguaaacauugccagauaccagucauuauucuuuaguggcuuuuuaguccucugcuuuuuuuuuuaaggcaaaagaaauaugcaucuagcauuucuaauaccaaauccccaauugugauuguuuuaaagaucaugguaugaucacagggaccaaggcugugugcauauauaacucuggauuugaaaggaggagaguucagccaucuaguucuuuucuucacaugacacuuuuaaacagccaguuugacuggaauuaaccaacuuggcacagccuaaaaaaggaguaaugugaaauuaaauuauuuuucuuugaaagucuuuugaaauaagagaccauguaaguaggacccuaagacaaccaaggaauuugcuuccagggcccucauuccucugcuguuacuuacaaauguuuuaauuuuuacuaccugauauucuuucucuaccuuuuccacauuugaaaauauacaaggcagcucacuucauccuaaaaaccuaaaaacuccaggaaggaaagaaaaggaugauauggggaaauuugccauaaaugccgguucugguucuuaguuuagccauuuccaucaguugaaauuguggugugaucuguugcuuguuucguuguuguuuuguuuuuguguagcuuuguuuuuuaauauucauuuaauaagaugaugggcaauagcaaacauuuuuacucccaggaauauaauuuaucaaauugaacuauuuuauuugccaaagaaacuuguuuuuaauaucacggguaauggguaagugugaaaacuaggcuuuuuuuuaugaaacaaaaaaaggugacgaauaauauggcuuuuguuucuguuucugaagccugauuucauuuaugccagguuuugaaaaacagaucuuuuucuuaagugaaagcaccuuuaauuugcucuaacgguacauccuguaaagacagaauucugcauagccuuuuagguguuuuuacaguaugugaaaaauacaagacucauucuagaguuaaauuaccaaucuugguugauauuaucugcuuccauuuuuauuaauuuggaaauuaauauguugcuaguaaauauugguuuuuacaguacccaguuugaaaauguaaguuaucaaaacuuaauguagugaauuuguguaaccauguuguauuguugagaauguauuuuuauuuaaauuuuauuuucuuaucaagaguauuauaaaaauuaacuuuuguaacugucgcuuggaaauaacucaaauaaauuacaagaagccuguc

SEQ ID NO: 16091 - RNA, 1213 nt, Homo sapiens
caaggccucgggcagcccuaccaaaugaauaugggcacuugaguuuucuaggagggcuuuccugcugcccugggucucauccaacugguauccaucuaaacauucccacccaggguuauucaugcuagaggaagaagaaugcccuuuccagagccaguucuuggggaaaagaggaacuguugauauagccagagcccgaaaagaagauuacucugcaacagcuaaagguuggugacauacuuuuucuccaacuuagugaaagcucucuauguuugcuuuccuucucaugaauuccauuaguguauuuucucuaaaugacccuuggaacagauaggaaagauuuuaaaucaauagaauaagcuucauggagaccaagaguuuaucuauuauugauuccccagcaucuagcguagugccuaacauguugaugcucaauaaaucauugaugaagaaagaaaagaaagacagguggaaaggagggcagaagagaaagaaaaaggguuuggagaauagguaugaauguaaaaaguguuaauguauuauucagaaaucaugugacgauaacagucuuguuuucaaaguaauuggguauauuaucccugcuaucuggagucaauaaagcaauugaaguuacuuuguaaaaugaagaguguauuuauaaagauaaaauaauagcagacaagcagaauaacaacaaaaaagguauucuuugaaacuuagguuuaaacaguagugaucauauauuaagauaaauucaaaacucuguaacauuaacagccguuuguucugugucuaugccaguuuucaaaagcaaacuaaaacagugaagaacuuuauuuugguguacaaacagaugucuuauggauaaaugcaagcugaucaugguggugauagaauugacugcaacugguccauuugauauuuagaaaaggucaacuaaucaggaaugauacacugaggaaauuuacaaauaucuaaccuuccugccauuuaguaaaauuaaccacacaguaauuuagcaaaggcucaaaaauauuuaauugugugucaaggaaaaacauuucagugcagggggaauaaauuaagaaaauuagcauuuuuuuaguaucagucuuucauuuauuugagaucauacauugacacacuucagguccagcaagccaacuuuaaaugacauacacuguucauugcaaaagaacccaccuaaagugga

SEQ ID NO: 16092 - RNA, 764 nt, Homo sapiens
uucuuuuuuuuuguuuguuauuuaguuuuuauuucauaaucauaaacuuaacucugcaauccagcuaggcaugggagggaacaaggaaaacauggaacccaaagggaacugcagcgagagcacaaagauucuaggauacugcgagcaaaugggguggaggggugcucuccugagcuacagaaggaaugaccuggugguuaagauaaaacacaagucaaacuuauucgaguuguccacagucagcaauggugaucuucuugcuggucuugccauuccuggacccaaagcgcuccauggccuccacaauauucaugccuucuuucacuuugccaaacaccacaugcuugccauccaaccacucagucuuggcagugcagaugaaaaacugggauccauuuguguuggguccagcauuugccauggacaagaugccaggaccuguaugcuuuaggaugaaguucucaucuucaaauuucuccccauagauggacuugccaccagugccauuauggcgugugaagucaccacccugacacauaaacccuggaauaauucugugaaagcaggaacccuuauaaccaaauccuuucucuccagugcucagagcacgaaaauuuucugcugucuuugggaccuugucugcaaacagcucaaaggagacgcggcccaagggcucgccgucgacggcaaugucgaagaacacggugggguugaccauggcuaauaguacacgguuuuccucggcggcggcgucugcaaagcca

SEQ ID NO: 16093 - RNA, 5672 nt, Homo sapiens
aguugaucuuuucuuaccacagauggucauguucacauaaaucaagaguacauacuauguacuuauauaguacauauauaggcagagacuucuggugaccuccaucuacggccugccacuccccugauuuucaugcccaagacccuucacuccuguaucaacagagaaaaaaccuuucuagagcauggaugugugacaacaggucgggcagcucaggggaaauuaaguaacuccuguauggugaguuguacuaggucuuuccccaaaagggcaaggaauucugcacuggccacuguggcuuggccacuuucugggauagaaaugaagcccuuccaaggacaguucuacguaaaugaugaggaaguuucaguuguaugaaaaacuaggaggaaaaguauucuaggcaggggaacagcaagugaaugagccuuuggaguguuggaguaaaaggaagaaggcuaggaggguggguagugggggagaggaaaauggugaggaagagguggagaagggcaguaccagaccugaggaccccugggaucaucuagauuuuacucuguggcagccuuaaggagguccugagcuagggagaaaugugaucuacauuuuuaaaagaugcuucugauaaaugguuaugacuacuugcuaauuugauacauuaaaaaaaaaucuuguaauuuuaacuugcauuuuucguauugagguaagguaucuugucauauguuuugguaucauuucuauuuuauuucgcauguaugaaucgugucuuugcccauuugaucuuuuguuuguugaccucaggaaucucuuacauauuuaaagagaugagccuguugugauaggagugguauaugucauaugugacaguuugucauauaucuuuugacuguuucuggugauuucuuuuccuugcagauuuuauuuuuauaucauuaaauauaucuuuaaaauaaacgagaaauacaaacuggagagauauuuggguagaagguccaguaaguugaauuuuguuugugauuugccaaagguggcuuaaauucuuuucauuaccauuuuuaaaaauggaauaaauuagaggguaugugucucagaggaauaugcccuuggguaaaggauguuuauaucaugcuuuuacacauuuuacgucuuccagacuuaagcucaucaaauugcgcggguggggggcagggggccagaaagggggugggaggauagagggcucagagucugagagaaaggaacuccuaucuucaucccccaaccccccaaggaggagaguggggcgcagaagaggaaaccaagcggggggagguuagagaacuugcccaaggucacaccgcgagcuggugguggagacagauucgaacccaagccugacuccagaacugagaacucuccaccuucucgcgacagcgguacagaaaagugcccuccucuccuuccugccggcagccgucugcgcuuggccaugggccggcgggagcagccacucccccgguucucccgccagucagaggucgggggcucggcguccccuucuggcuuggagccccuggcgcguacagagcgaccagggcggacacauuugccgcgcucaagucucugacccccucccuccuucccagagcccugcgccuaggguuuccugagcucccaacccccucccuucccgagcauagacaaguuuguauucaagcaaggccaggacuggucccugagucgcucucgggccaggcgaccagccucacugccccagagucaggaauaaacgguaacaacagccaccggugccuauugcgugacccgugcuuuacuuccaccucuccgaauaccccggacgaacagacccccaggaauuauuguccccauuacacggacgacggaacugcugcagcuucggaaaguuggauaacaagcuugggcucgcaaagcuaauaauaauacuagcuaacauaugauugaguguuuccugugugcccagcacaugucuaccuacgaacaccaucccauagaucuuuccaauaccccuauaaaaugugcacaauuaucauucccauccuacggaugaggaaacagguuuggcgcccuguccaaggucacucagccagugagugacggauccuggauccaaaccaaagcgggugaaucggauggcaguuuuuugugcguuguccgcuacgcagagaagcaaagggcuuagaacccaugauaccaaaggccgggccccaaacgccccagggcugcgcgcaaaucaaccaucucgaacugccacaaccugcagagaggaauucucagggacugggacgucaggagcgccagcugugucgagugcuggcccgcacaaaguccgugcagccggaucucggcucccggcccccgcgcgccccucaccaggagcuggagaguacuuaccauaaaagagagggcaagcgccuguucgggaagaauccccagcgcuggcagguccuggacucccuggagaggggucugcugccgccgccgcccacucaggggcgcccgagugacccgcaaaugccggcucucuccgcacggccaggggcgcguccucacggcugaugcccggcagcagcgcccccucugcgcugcaggauggccuggaguuaggagcguucuuggcgaaguuggcgcucaggcgccgggggucgggccuggaguggggaagcgccuuacugaagcgauccugggggcgcuccaaggcccgcgcucuagccgcuuggaagcuuggcgccugacccggagggcgacgagucccgcgcucagggcgcacgggccgcgccucggccgcuggcccccggcgcgccgggcgucuuccccagcgcccugagcgcacgcagcgguagcagcagcuggggcccgggcccgggaugugguguguucaucgcccuccccuggggcugggugcuuuugugcgcggggcgcgccggccgccacggccagcucuggaugcugcagccgccgccgccucccccuccuccgccgccgccgcccgcuccccgccuucccggccggcccggaggcugcagcugaaagccgaucuggcugagcucaucccugaaggccacuaauccaauagccgcggaaggcgcggucgccgggaacgccccuucccccaccaucccgcgccccggccgucccagcucgggccgcugccggcgccgccaccuucucgaggccaccagcuggcgggagagggaaguggagcccgcgcccgcgccccugugccaaggcggcggcgcggucgccauucacucacccgcccacucgcccgcucacucccuagcucucgcauucauuccugcgcgcggguccucccggauucauucaagcgcuccuggagcgccagggugggugccccugacggggaggagacacccagucacuaggcagcuuuggugccuuuacucaacgcacgugggaaauagcagccaggaggaaaaaagggugguuuauuaucccccuuccucagacacacacguccacacuuuauuuuugagaucaggcuccaacucaucucuuaaaguccaauuucauaccgcaccugcucaaggagcguuccccgcccacccgaggcgcaggaagucggucucuuugcucuaccagcgcugauggugggccgccucauugggagccugaacugagcgaugggguaaagggcguggccaaaacagaagccucgagggugcuucugguaucugcgcuuccuuggggaaauugaaaguucuugguuugguggcccucgucugugcucccagaauugacuuuagguccauuacgcagucauuugcuaacccaaucccucucugugccagguaccaggcagagucuagaugcagacagagucuagaugcagacagagucuagaugcagagugcgcauuucaucaaggacauggaaaacaaguaaagacaauccaacucuaugaaggaaacguuuugagagagguucuggggcgaauuugucagacuggaaagggcaacugggaauguuuccuaguaaaugugucuacaugaauuagcuccuggaggcagggguacaacauggucaccuggagagcuaccuaucacagcacagagccugugcuaugagcagaggggguaugacggaacuggagggauggacggugucuagggucuuggguggagacuguaucaagagcuugaccuuccccaucacuuugggaggccuuuaaccaggguagugaccuugucggauuugcauuccagaaagaccucuuagcagccaacuggauggauggauggaggaaaccagguuggcagcuacuguaauagucuaagcauaagaugaugcuuuaugaaccaagauaaccaugaugaggugacaaaaguguguauugacacguauuuauuguacuuauucuaacguuucaucacugucuguuugcaugucugccccuccuaaaacugugagcccccccuggagggcaaguauagguaccucacacaucucuggaugcccugcaccagcauaggauagaugcugaggacagugaaugugauuugaacugcccuaaguggcagugcugaccuacauucacacuuggugucuuuccuuccuaccuccuauugacaagcuccuggagcaccucuacugugagcuacuguggggguuauggaugugguuggggagcaagaaaagaaaauuuguggaaagaagcucagaagcaaaggaaaguuuaaagcagacguucaugcugaugguuucucuacccaucuggcugacaggcuggguguguguguggaggaugcccguugcuuccacucggugcugggaagcaucacaguagcuucaaggauaagggagggagggagcaguggccacaauuugagaaaacaacucccccccucccuugggggcuccaguuagguucaccacacuggccuuucccaaugagauuaugccccaggcacaaaggagugggccaaaacagggcccccuugugucccuguagacccccaaauccuccagccucuggauaacaagggaaacaacuugccauuuggggagaagccaggauagccuggcuacuaaaauucuuuagauugagaucagcagcuucuaaauggcccccagugaucccugacuccugguauauacucccuuguguaaacccuuucccuuaaagugugggcuagacuuacugacuugcuucucacuaacagaauacagcagagguaaugggauguuccuuccaauauuagguuauaagaagacuguggcuucuguuuugagcauacacucuugcucucuuuugggaucaccucucuggagaagccagcugcuauauccugcaguggcacuguggagagaggcccauauggugagugacugagaccuaccgauaaccacaugagugaacuugggagcagaucucugccccgccgagcugagcccuucauaggacaauacagcccugugugaugccuugacugcaaccucaugagagaucgugaaucaccgaaaccaacuaccugugcuuagauuucugaugcauggaaacuguaagauaauaaauguuuguuguuuuaaucagcuaaauguuggaguaauuuguuauucagcaguagguaacuaaugcaagauguucuuaacuguccaagagugagucuaaaaaugcaaccgugaaaaacuag

SEQ ID NO: 16094 - RNA, 793 nt, Homo sapiens
gugaugggcagccggcccugcagccccagcgccugccuugcgcccugguggggacagcagccaggaggaccaggcccugccaagcgcagccgauuggaggagcccgcgggccccgaaucccgagcggcgcccagcccggaagacccggcggggaccccggccguggacgcgcucaccuccauggugguccuggacgcgggcugugcccugcgugugccccuggaggacgucgaccuggugcuggagcucgcgccaaugucgguccugcgagugucucuugguggacacacccucaucgugauccccgagguccuccugagcuccgucgacgaaugcucaggagcgcagggcgacuggucugccggccuggaaguggacguuuuccugggcgcucacggggaagacgucgucgucgagcaggaagucugcgcaucugucccagagaucgcugccgaggaagaggccuacgaggaggacgcggacucugaguucccggagcucuggauggacuccgcagccggcucagccgcugggcucuaccccuccgcuagaaguauguucagccccuaccgggagggccccauccgagggcccugugcucuggcccccaaccccaguucagagagacgcucuccacgccccaucuucgaccuggaauuccaucuucuggagccuguccccagcucaccucuccaaccucuaccucccucuccgaguccagguccccacgcgcgcccggagcucccagagcgcccuccgugcaagguccgaagacgccuguuccaggaaugag

SEQ ID NO: 16095 - RNA, 10612 nt, Homo sapiens
caaagucacauagcaaauaaaucacagagccaggauuuaaguugagaccugcugaaaccugagcccaccuuuguucccacuccaccaucccacuuaugggcauggacucccugagguauaggcaucacucucuuuuucacagauguagaagaugaggcucugcucaacaguaacuggugaaguugaaaaucccugugaccuuucauccagcggccccacuucuugguaaacuguagcacaugagcacuagcagacaugccuaagaauauccauagcaagacuauugguaauaguaaagaauaggaaauaacccgaugucucuuaacaggaacauggauaaauaaaccacgauguauucauacaauggaauggugcaacacagggaaaaugaauggagcuuguguuuguguggcaaccaggaacuuuuucacaaacauagguugaaugaaaaagcaagcacgugucuuucugcaacagcaggauaccauuuauauaaaguuaggaaauacaaaacuauaugaaguauugccuaagaauggguacacacacauaguacaagugcaaaaacagguaugggaaucuuaagcaccaaauuuaccauggugaucaccucaagagggaaaaggacagagaggaaucgaagaagccaggguccucaauuauaucuguaagauuucuuucuuucuuuuuuuuuuuuuuuuuugagauggagucucgcucugucgcccaggcuggagugcauuguaagucagccaagcgcacuggcucaugccuguaaucccagcacuuugggaggcugaggugggcggaucaugaggucaggagaucaagaccauccuggcuaacauggugaaaccccgucucuacuaaaaaaauacaaaaaauuagccgggcugguggugggcgccuguagucccagcuacucgggaggcugaggcaggagaauggcgugaaccugagaggcggagcuuccagugagccgagauugaacuucagccugggccacagaccgagacuccgucucaaaaaaaaaaaaaaaauuagcuggguaugguggcauguggcuguaaucccagcuacucgggaagcugaggcaggagaaucauuugaacuagggagucagagguuguagugagccaagaucgcaccacuacacuccagcuuggugacagagugagacuccaucucaaaaaaaaaaaaaaaaaagauuuguguuaguguggcuaugaggaaacaggaaugccacacacuguuggcaagaguguauucuggcucaaucuauaaggaauuuggcauaaucuaucaaaguuauaggugcauauauccauuacccaaucuuacacuuucagaaaucuuuuuauaaauauauauauacauaccuacaaaaugagauauaugcaaguuuauacaguacuguauugcuuguaaaagcaaaggaucagaaacaacauagauagcaugcagcucuaaaaagagaaugcauugauguggaaagaucuaaggugcagaacacugugcauucaaugcugccauaggcaaaaauugagggagugcagaagaauguauguggguaugcuuguaugugcauaaacuaugucuggaaggauauaugugaaaccagggucacuggcugccugugagaagggugacuugggggacagaagugggagagaaacuuuucacugcaagccuucuauauuuuuaaauuuugguccaugugaauacauugccuacucaaaaaaugauuuuaaaaaauuuaaaacucugaagcaaggcgagcguccaucauuuccaaggcugauaucaguaggaauuggaacagaggucuguuagccacccaacggcagugccucucagccugucagcggugugcauagaugacagugccaggcaucaggaccucugcugcagcugcacuaccuccuuccgugugccucuggaucugaguucccagcaccugcacgaggaggucccuuccuguucagauaugcuaugagucccugguccucaggaguacugccuccaagcaaacggccagggacaagagcuuccuggaauagggaacaucgggauccuggacuguccccacccaaagcccccaaauccugacuacugcuuccccaacaaaaaccugcuuguaccaccccaacagccugucagcaauuacccccaauuacaaacccagagcccagcaagaccucaauuagucuagaaaggggccugaggaggggccaccugcaaagcauagaaaacccacauauggccucuacccacagaguagcaacacuccucucagucaagcuuaggggcuuggagacuuggaaauuugguaaccuauggccccgaggaggaggcugcugguucucccuccugcagugcccacuccaugcagggccuagucaagcacugugccuagaggggcaguuccccagacuuccugcucucucccugcucagaccacacucauccuccccacucaccaccuuccaaggcaaacugcaacaucugucgacaaaccuugcagagggaugcccuaggcaucagccucugaagcccaccaugggcuuggcucagcaugcugggaggaggaccaaauucccaucucuuuccagggaaggaaagccucugaauuauccucuguagcauccagaaacaggcuggucccuaguccaaucuuaguccaaucuucugcaaauuccgagagggaucccauuagguugcugagcccgggacuuggcaagcucugaagucuucacuaaauuggcccccauccucuucuucuucacagugagugugcguggcugugggagagaaacugugugcauauggguguguacacagaucucaaaucuaggugugagaagguaugcagagaggacuacagguugauaggaaaugagucucuuacccggcagcuagauuugcucagauggaagggagaacuuccugaccucacgggaacaaacagagguacauguacggaagugaaauucagagcccacagucaaguggucacuuaucagccaggggccuuuggcaaguuacucacccucucugagccucagguuccucaaguguaaaaugggaauaguaccaaucccuuagguuucucauaaaaaugaaaugagauaaugcauguaauguuccuggcacaaaauaacugcuuaauaaaggauggcuauuuuuuuggccaggugugguagcucaugccuguaaucccaguauuuugggaggcugagaugggaggacugucugaacccaggaguucgagaccagccugggcaacacagcgaaacccuaucucuacaaaaaauacauaaauuaguuggguacggcagugagcaccuguagucccagcuauucaggaggcggagcccaggaggucaaggcugcagugagccacgaucacgccacugcacuccagccugggugacagagugagaccuugugcaacaaaaaccaaaaaacaaaaaagcuguuuuuuccauuuauaacaacaguaauaacaagugcagcuaaauagugguuuuuagagaaugcuaucuauaagggaaaggcccuguuaaaguaugucugucuaucuguauaucacuguauuugguuuuaucacuuuggaaacuguuugacugaaucuauugaaacuaaauauaugccuacuccuacaguucacucaagaguaguaaaauacccuucacaaaaagacauguacaacaaugugcacagcagcuuuauuuaugauauccaaaaacuggaaacaaaugucccucaacauauggauggauaagcaaauacuagaauauuacacagcaauaaaaagaaauaaaugucugacacaugcaacaagaccagugaauauuaaaaauauguugcacagaaaaaacuagacauaaaggcauacaugcuauaugcuccauuuauacgaggcucaaggcaggcaaagguuauuuauggugauagaaauccaaauaugguuucccuuuugaggcaauauugauuggaaaaagauaugaaggaaccuucugaagugccagaaaugcuccauaucuugauccagguggugguuacauacugcauuacaugucagaauacaucaagcuguauauuguuuaccaucuguaaguuauacugcauacaaaaauauggaacaaggcuaaaugcccaucaaccaaugaguggauaaagaaaaugugauauauauacaccauggaauacuacucagccauaaaaaggaacaaaauaauggcauucacagcaaccuggauggagcuggagaccauuauacuaagugaaguaacucaaguauggaaaaccaaauauccuguguuuucauuuauaagugggagcuaagcuaugaagaugcaaaggcauaagaaugacauaauggaccaggcgcaguggcgcacgccuguaaucccaacacuuugggaggccaaaauaggcagaucacuugagguuaggaguucaagacuagccuggccaacauggugaaaccccaucucuacaaaaaauacaaaaauuagcugggcaugguggugcaugccuguagucccagcuacacaggagguucaggcaggagaaucacuugaacucaggaggcugcaguaagccaaguucaugccacugcacuccagccugggcaacagagugagacucugucucaaaaagaagaaaaaaagaauuauauaauggggacucggggggggaagcguaggagggggaugagggauaaaagauuacacacuggguaccguguacaaugcucgggugacaagugcaccaaaaucucagaaauuaccauuaaagaacuuauccauguaagcaaaaaccaccuguucccccaaaacuguuuaaauaaaaaauaaaaaacugacugggcaugguggcucacaccuguaaucccaacacuuugggaaguugaagcaggcaaaucacccugagcucaggagcucaagaccaguugggcccacaugguaaaacccugucucuaccaaaaauaccaaaaaaaaaaaaaaaaaauuagcugaguguguuggcucacacccauagucccagcuacuugggaggcugaggcugagaugggaggaucacuugagccugggagguggagacugcgguaagccaagauugcaccacugcacuccagcuugggcaacagagugagacccugucucaaaaaaaaaaaaaguguuucauaaaguuauagugcacacauacacacacacauacacacacacacacacacacacccuaucuuggcaugaggaaaaucuccaaagguagaacaguaauacaaaacucagcccuucucccucccuuccucuggacuuugugccagcuaggcaucuaaaacugccuuccuccauggcaguugccuaucaucuuuagaaagugcccgcuuugugggagaaaauugagccaggaaugaggaccaagggggaagggcucucucuggcauccccucauggguuagcgugcggguggagacugcaggccuuaccuugcaagccagcugcccugaaugcagagacuucucuguuuccaguaaagucuaguuugaauguuucagacagguccucaccaugacugggaacuagggagguguccuugcccuugccuaagguucagcaccauggccaugcagcuauaauaaccccaaauggcaaagaacucucagauccugagcuggcugucaaugaucaaaccgcuuuuccucagcuacagucccuuucuuggaaauucuaacuucauuauaacuucauuauaaggaaaguggcauuucccaauucuguccagcagaaccauuuucuaauucuauuaaaaggcauuaagcccauccugguggggagcacugagugagaaguggagggcagagucucugcccaucagcgcuuacagucuggguguggagaaaggcaacaaggcaacuuuuaagaacacaucauguuccccagcaagccugaggccuacuggcaaggcacucacuguucagagcugaacaaaauggcuuugggccauagaugucaugagggauaucagaggaaacuugucagcagcucccaccacccuagaauccgccucugagagcaucccacgggucuuuggagggaagagggccucacuuggcccaggacccagacccuucugccuuuuucccaguuggccuccaccaugaaaaaggccgacaacugcccugcauucugccugauugacgauggggcacauacuccuugggacaaaaugguguuggaggacucauaccccaacaucagcaagguaaagaggagcccagagcucuggucuacugccucucaagcccuuccugggggagaaagaggggagcucagugagacacuuaacaacaggaaacagcucucaugugugaguucuucccagaguaggaggucgcuucucuuuccucuuccucaauaucucucucucucucuccacuccccuauucucucccaagcacauaugugaguaacugacuuugcuaaucccaaccaggcagacuaauacccacuggcuucagaccuggugcuaugugggugucugcugcugcaccuuguuggucugagcagcaaacucagcagaguuucgagacagagauaaagccugugugaguggccugugcauguuaaaguguaucuggaacgugcucaguaccugagcuucucuguggucugugcggcagucccaucaugaaaacacccagguggcagcccagucacccgaaucacaggccaaggacaucagagaaucaacaggcuucucggagucaggcuuguaaaccuggagcccauugguccuucugcaccgugagaugcgaaagugagcagcgugugaaaagccuuagggucugcacauuggcuugacauguuuuccaccaacaugugcaaaaucugaauuaguacguguagcuggugagugugagagaaguaggaggggagggagaacuagaggggauuuggaguugacagagggagaaggagagagaaguggauggaguaacgugaccugaguggagggacaccgagucccugaggugugggugcaaagggcccugugaggggccgggagggagugagugcugacaguuguugaggcguggaguguauggggauguacuaauagacacagugaagcuucccuuugcuagccaagcaccgcagaggccaucccuccaagcagaggguugcagcaagcucuauucucucccgcucaggagcgggaagccgccggguguuucggggucccgcuaggaaaggggacagcggaaccugguucaggcagccggcggcggcgcgggacgagcugagugguucuagcgaagcgcugccugccucagagcagccgcgacgcuucccuaguagagcugggccgccggaagcccgaggcgcgggcggcuucugccgcuguugcaggauucccggcccuggggagaaaagcgucuguaucagagccguguagauugcucgcgccggcugucgggaccuccgaggcgcggggccaggcugcgaggaggcgcgggagcugagacugcgcucaaucggcgguucacuggaaccguauccgcaggcggcgcuacggugggaccacggucaggaggcgccgguggcugcugaauugcagcugcgggacccuggaaaacuggggcaaagaggcagugaguucugcccagcccaccacccuggccuuuggaggugagcgccgccccaaggucacuaagccgggggcccugcgucgccccaaugccgcggggagaaaaggaaccggcccuggcguccacaaaaccuaggcacaguaugcccuguucagagaggaucccgaccucgccagcaaccagccuaccuccgaagguugagaaguaaaucagggcgccccgcaccguuuccuggagcgcccgguucacccaccucuggcugggccggcaaggagaggauucuguucucucccuagauuccucuaucuccagcccgaagccccuggcuuuuccgcagaagccuggaggggaccugaaaguaaucauucugccagcuuucccgcccgcauuuucuugccuguuuucugagccuucgaaugccggacagccaugugaaggcacaucuuggggagaccgauuccagcccuucccagggugcacgcaucaggcauccucuucuucaccagggcuggggauucuguuccucuacgggacagucagaaaucaguauuuucagagcagaacuccuuucuauucugaaaauccuucagaggaacuccuucauuugcccccaaccccuacacacacacacacacacacacacacgcacaugcauacacacacaggcucuuuaaaggcugaaaagggagccgaguguggaauucagggaagugaugacacacacaacaaugcuguuacaccuggcugcugcagggcugagcagcggaaaugccugugagaagaagaaagaaagacagagagacgcagagagccagccuggguggucaagaaaaaaaaaaaggagagaaaaggagagaggagcccccaccaggauggggccagacccagcuguuuuucccccugcccaggcccuggcugggggaggauaggcacugaggccaaucugcagcagccccaaaccggacucaccacucccacccaaagcuugggcaaggauggggguaaggaagaagaaaaacaucugcacuccugcucagaaagcagcagcagggauucugcggaagugcugcuucccccaugucuguugggugcagugggagaccgcccauaaaaaaaaccaagcuacuuuggggauagccuugcucccucucauccuugugaccaggcaagggcugcccugcugaccucucuggugucaucuucaagaugcugaauuccaaagagcccuaccacccuuguccucccucccuuucaucucagaaugcagaucagaggccugagugagcagcagacaacacuuguagauggccuguggaugcuggaaccacaggccgcugaaggcuccuugggcuucaggagaacccucagagucuaaacagccugggaggaagaggcagugacaggcauugagucagccacuccagacaugccaaucacuaaugcacagcuauaugacauccauucaguccaccuuccuccauaagguggccuugccccccuccucagcaccaaggaguuuggggcuugaggauucaaaacacuggccaucucucucauacuuuaugacugcagacuuuuuguuuaggccaaguuaaaaggcacuguuaaggagcacacuguuaaaaggcacaccugauuuucccugaaacaaucucuguacaugcugaaauaauuggauucccaucagaauucugcuuaagguaggugacaacuaacuccugauucuuuggagaaagaucagaacaaaugucucaucaggagagagauuugaacaagucccucccucagccugauguuugucuucccagucuguggcaaaauacauacacugggagggaaagaggcaucgaagaauugugaaagaaaggaagaaaggggggaaggaaagaaguaagaaaggagaaaaagagaagaugcuauauccaccagcuacauuuacucuaauacuugaugaacauauuacauaacuaucaguauaaguguguuuuaccucguaaauacaaaucucacaccuuguacaugugcauaccuguguuucugagcagcacacaugcaccugguaucucacccaucucaaggacagcuccucuccaugacuuccauaugugaccccugugcacacacauacacagucccgcaaagucccgggcaacagccccgccuguguuagugcaauagcugaggggcaucuacuuggugcuguuaaagcacacauccaaccuucacuccaaccccguaggauuaguacacggauuccugguuccuagauccacugguaacgcagggagaggcagaggugauucaggcggcgccccugacgacuauuuccagagauccucuccccugccccauuccagcccagucacucugagagcgcgagggacaggccaggccgaggcuucuucguacagucacacccguuucugggcugacuuucccaaagccucagagcagcucuccccacccuaccccguccagcccccucgccgucucgccccuccccagccccgagcuagaaguucagccucaagacggcagcaaacggcagagcaaaggagucguuuucuuucaccugaaagccgcgaggaggcuuggagcgccuuuccucgcuggggcccgagcuuccugggcuuuggccgggugcgggcagaccccaccgggguccucgucaucucccagcccagcccgcagagcgaguaccggcagauuucaagggcgcgugagccuggcugucggcugggccccugaggcucgcugggcgggggcaggccgguccaggcugugcggggcguuuacaaaaagugacuuggagaugaacucgcccgugcgcggcuggccgccccgcuauaggggcgaaggcgccugacgcaagcggaacucgguggagcccauacgaaucagaacagagcgaggcuccuggcgcacuagggacuccaggaggcagcuccgcca

SEQ ID NO: 16096 - RNA, 1869 nt, Homo sapiens
agccgcgaggaggcuuggagcgccuuuccucgcuggggcccgagcuuccugggcuuuggccgggugcgggcagaccccaccgggguccucgucaucucccagcccagcccgcagagcgaguaccggcagauuucaagggcgcgugagccuggcugucggcugggccccugaggcucgcugggcgggggcaggccgguccaggcugugcggggcguuuacaaaaagugacuuggagaugaacucgcccgugcgcggcuggccgccccgcuauaggggcgaaggcgccugacgcaagcggaacucgguggagcccauacgaaucagaacagagcgaggcuccuggcgcacuagggacuccaggaggcagcuccgccagagacgcgggucgugcuucgggaaaccggggggcggggggaggggaagagcgcagaaaagaaaacccaccaaggcggggacuggccugagcggggaggggcggcgaggccggagccccucucuguugggcggacuccccauggccagaggcugagcuccacucccgccggccgcucccuaggggaaggggaaggagaggggagagcagcgacaggccuccagcaagcaagcgcgggcggcauccgcagucuccagaaguuugagacuuggccguaagcggacucgugcgccccaacucuuugccgcgccagcgccuggagcggagagcagaggcggcccggccgcggcgcgccggcuuugucaugauggccagcuaccccgagcccgaggacgcggcgggggcccugcuggccccagagaccggucgcacagucaaggagccagaagggccgccgccgagcccaggcaagggcgguggggguggcggcgggacagccccggagaagccggacccggcgcagaagcccccguacucguacguggcgcucaucgccauggcgauccgcgagagcgcggagaagaggcucacgcuguccggcaucuaccaguacaucaucgcgaaguucccguucuacgagaagaauaagaagggcuggcaaaauagcauccgccacaaccucagccucaacgagugcuucaucaaggugccgcgcgagggcggcggcgagcgcaagggcaacuacuggacgcuggacccggccugcgaagacauguucgagaagggcaacuaccggcgccgccgccgcaugaagaggcccuuccggccgccgcccgcgcacuuccagcccggcaaggggcucuucggggccggaggcgccgcaggcgggugcggcguggcgggcgccggggccgacggcuacggcuaccuggcgccccccaaguaccugcagucuggcuuccucaacaacucguggccgcuaccgcagccucccucacccaugcccuaugccuccugccagauggcggcagccgcagcggcugcagcagcugcggcugcagccgcgggccccgguagcccuggcgcggccgcuguggucaaggggcuggcgggcccggccgccucguacgggccguacacacgcgugcagagcauggcgcugccccccggcguagugaacucguacaauggccugggaggcccgccggccgcacccccgccuccgccgcacccccacccgcauccgcacgcacaccaucugcacgcggccgccgcaccgccgccugccccaccgcaccacggggccgccgcgccgccgccgggccagcucagcccugccagcccagccaccgccgcgcccccggcgcccgcgcccaccagugcgccgggccugcaguucgcuugugcccggcagcccgagcucgccaugaugcauugcucuuacugggaccacgacagcaagaccggcgcgcugcauucgcgccucgaucucugag

SEQ ID NO: 16097 - RNA, 5335 nt, Homo sapiens
guuacuuuuuuacaaugacagauugucuuuauucaaaacgucuuuguucaacaaaugaacagagcaacgagguaaaauccuucuagguacauuuccaagacaucgucaaaacauuuaugaccauuuagguuguuuuuguucuuuuaauuuuuuguucaccuucuacuuccugacuucauaacccgacauucugucuaaaaguaaacuuagaucucuagaagcacugcuuuacacaaaguaaauaaccauguagguccuuuuuguuuucccuuuaaagaagcaaacacuaucauagcaugguuuuaaauagaaauguuucccuuucuguaauuuaaaacuuugaagccuuucccccccauacaugaagagcaaauggcuccuaguugugucugauggcaaaacacagagacacagcuaacucuuuucuucaggggacaaaaggaaaaaauauaugcauauuguagauauaauaucagaaucugggaguucagaguccaaagccuauccgaggagagugaaggggauauaaauaaagcaaaacugccuacuuuuuuguccaaaggggguacagucggagauuuguuuugggagagucgggauaggggcagcuguguagcugacauaacguuugcaaguuuccgguaccugucugcgccuuggguccgggaggacgccccacccuucccccuggaagagagaggaaaagucugggugguguaagggacagcggcagggcugaccccggaggcgucugcaggccggggcuaggcucagaggacagggugcagacccggcuuucagaccacgccucagguccgggccgggcuggggguuacauggccguagcgugggcugacgaauaagggucuaugccagucuuggucaugccugggaagaggauguaggcgacggggggcugcaggguggaggcagaccaggcgguacaguuacagggcaccacguagccaggguuggugggggacgggugcgugugcgugugcuggcuggggcagcugaggcugccgaaggcgccguucugguagcccaggguggacgcguagggcagagcgccgguagccaagguguggggcacuucgcccaucuucuggauggcgcucgagcuaaacugcgcgggguccagcagggaguagggcgccgaggccggcggcaagaaggcccgggcuuucucgggcgcgcucaggaggccgucggaggcccccacgggcaggccagccgccuugagcggguccgugucgcccagguagggcaaggggaagacauaccuguccuucuugagcagguucuugggcuugcgccgaggucgguacuuguagucagggugcuccuucaugugcugggcgcguagccgcuuggcuucaucgauguauggccgcuucucugccucggacagaagcuuccauucggcaccuaggcguuugcugaucuccgaguugugcaucuugggguuuuccugggccaucuugcgccgcuggccccgggaccauaccaugaaggcguucaugggccgcuugauguggucugaagguuuggacauggucccggcggcuagguggguggggguagggagugcaaggguucugcagacgagccugggcgcggcuggccgucugucuguccguccugagccgggguucugcgcuccccucgccuuggcgccgcugaggggaagccagagagaagcgcugaccccacaaaguucagcugaucaugccagucccagcgcccaggcagccccgggggagcgagugggggcagaaagggcgggggaggagagggcgaucggccggggggcuucaggcaccaggggcugggacccaaguaucggagucuccgggauuaaguggccagguaauuuuuuagccagggcaagaagcuccuccuucucccccucuccaccuuugccuucucuaguucccuucucuccucuugcguuuccagucguggcucccccuucccguggcuuucccggagcugccgcgccuagcgcugcaccuggcugagaaugcggggaggcuggugaacgagagccaaaagcggcgaaguucaaaggcgaggugggccgggacugcacgcacucugacauaagcgcggggcggcgacuccccaaccugggcgccaaucagcagcagagaagccgagggggcgcaccugccaacacgccggugcaagaaacagagagcgcgacuggugggggcggggagaggugugagggacagaggcagagagagggcuagagcagagaggcuagcucuagacuggggacuucgguuccacauugucucgggcacugucaacaaauaaaacucuuccgcgucuccuguuuccuuucccgguugugaaagagaauuagggcuugaaauacaaaggccggggaagggacagcaaagggagcgaggcgagagcuuguguugauaaauaggacagcuuugccgcgaaaugcaaggacagcacuuugcccucuugucaaauauccuuggaagagaaaaauaacauauagcaggcucaggguaaaagcgaaauaaacuuuucgcgccccacccucggcggugcuuuggcaguguucucccgggaagccccugcaacuaggcauccaccccugccccaggaugcggcgcccgggcguagcgcugggacccuggguggcugagcaauguugucugaccugcuccuggaaggccucgcgucaggcaaugcagagauuucgaacccuaguuggugagcccuuaaaagcacuacgaccuguucuucacuuuuggggcagggauggggcugagauuucuauugcaguucccauuuauguuauuauuauuuagugucuuuaaaccuccaacuuuuacuccacaaauguucauaccguaagaagagccuagaggcuggguauggggcucuucccggugccccuucugcagcggcccuacagcggagucucacgguguaucgcaaccagggucgguuugucccugggcgccucuucccacccagggaggcugcgagacucguuucuugcgucaaaugagcauucuucggguaaagaggacgaaauaacccgcagagccaaccugcgcgccuguuuccuuugaauaauugccugcccgaugugaaaugcccuugggggaaauauuuauuaaauggaaaccauugucccaggcccggcgggaccugcguguguuccaggcuuauuggcuuuugcaccauucucucuugggaggaccggccagaaacgcgcaaggcuccguuggcuccgaggggcuaggagugggggagggugacagggaaugaggaggccggaagggaggaucuuucucuagcauguaguguaucaaguuugaggagaagacuuugcuuccccuuccuaaaauuagaaagacgcguggaacuucucacccuuggcgcacuuuucagagaggugggcaauauccccauuuuacagauuaggaaacuaagguugagaaaaacuaggugauuugucaaaagugacucugggagugaugcuugauguauaggauuugaaaaucccuauuuucacccccauuccacuagacgucacgccuagggauuucauggcucugcagcccaauguggaacaccugaugagacuauuggggcaaucgacaccugccaugcagauaaaccacgcuggaaagacugauccugcgcuugauuugcuuagccaugggcuccaccuccgagggcuggcaaacaggugcacagccuuuacauuccuucccaaccccagcucuggccuuucuccagagccuccauccagcccuguaacccugcuuucucugcaggaaguuucauuuagcuuagggucucaggaagcaaacgcacuuuucagcccagucuggaaaggguuuccgagcgucgcuggcaaccccuacucaggucugaccagcggugcgcuauauucagagccagccagggauaggagauucaggaaucacccaauucuaauucuacugggcgaucccgacggcuuugggaaggaaugagagaaauacugauaucugcagcgagauccagcguucggaggggacccgccaaucucucacucuagaaccccccaggggacaccaaacgcacacccaaaguucuggguuaaugcaaaccaagcucuuggaaauuacucagcaaggggaucuggcacaagguccuacguccuuucucuccucucaguuuccaggacaauccuuuccaguugcccggaggcaguucgggcaggcgagcgccuuccugcaauuccucauauuuccuucuccucaaacgcccgagcuccucuccaagcuucuuguguucagccuugggucgcagccaaugcgcaguccaauucgcaaugaggagcggagugauacgaagggcguucgauggugggcagggcgccagcugaccccccgacguuucggagaccccgauugccugguccagcugcacugaccuaggaaggggccagcaucagcgcugcgcgucuuggccuugagacaggaacuccgcgcggggagggaacgcagggaugagggcugcaccuuccaggccgugcaucagcuugucuccuaggcgaacugcaaagccacgcacaccccuuacgcaguaccggugaccaccgguuuauucaacacucuuuagagcuguggcgggagcaggaguucccgugauccuggggucuggccuggugcugucuccagcaggugccucuacugcgcugcgcugucccuucacgcugugccucccugacgggucuaaaccaccggguagcacguccuggagacgugaccccugaggagagucagcaacuucggucacaaccagaacaagcauuaggacagagguugccuaaauacuccuccugcuuuguccacggccugaaguuuggccccaggcuaccaguucauucuccuccagggcuggagauaacgcuuggaugaggucuuuccgcuugcacauuugccuggagaagcugugcacacguucaguacacagcgcagcuacucaagguccgcugcgugccagccuuagcaaggcguccgaacccccgagcaacagggauuuugucagggaaccgccgcuguuucccggaagugaaggaagaggccucuaagggcaccgaccuaaucugcuucucuccgggccuuucgucucccuccagggcgcagagcguccaggaugcgccuuccucuuuucuggcucugggccucuccuuucacgcagcuccugcgcguaccucagguaucaguacaagccucucacugucuauggggagacuuuucuguuuccugggcugggcuaggaccccuucuaugcucucacucucacacuu

SEQ ID NO: 16098 - RNA, 4660 nt, Homo sapiens
cuaacucagcgcgagaagaggaagcgacgcagcgaguaacaggcuguauggacggacagcggacugaaggggggugugugugugucugccugccaacaaggccgucucaccuucccgcugccgagccgggcagcuccagcucaccugaggagggcuccaggacgccacugcggccgccgugauggccguaacggcacgaggccugcgcuccgccgccgccgcguagcucuugggagagaggcggggcacgcgcggugggcaggcggauccgcgcgggcaggaaacccacucuggacccaaucugauagguucagucgcccccuuccccggucccugacgcgacaacggucucugccgcacugggauugggcgggcccucaugucaaucaagcgccgugccugauguggagggagcggaggcugcgcggcggagaguagagagcuagagggugagaagcgcugggccggaccagaacugucuuagcuuuucccucugcggcugcucugguugguuacuuugagccugccuccucagcgccgcaggagagacuuaacagcaaaaaugacuguguccugaguucagcccccacugcucugggagcuucccccugguuucugcaccugaagaaugucaucccagccgaagguucuuaggagcggggagcgacaaagaaaaacaaagaaaagcagaccugaaaauugggaccugggagaaauguaagacaugugcuuaauuugaggcacagaccaaaagaagcugagucugagggcccucuaaaaguguccucgugcuugggcagcuuacauucuuggcggcaguaguguuaugaagaggaccuucggagccaggucuguccauucuuagggcuccagccacuggcugaggcaucaguaaguugguucuuccccucgccggugcugcaggcccccuuccccgcccccgcgccguaaccugccucuuuuuuuuuuuuuuuugaaacgaguuucgcucugucgccaggguggagugcaguggcacgaucucggcucacugcaaccuccgccuccggguucaagcuauucuccugccucagccucccgaguagcugggauuacaggcauguaccaccacgcccagcuaauguuuuuguauuuuuagcagugacgggguuucaccaggauggucucgaucucuugaccucgugauucgccagccucggccucccaaagugcugggauuacaggcgugagccaccacgcccagccgccucaucucuucuuaaccaucuuuguggcacaguuuaggaucgcuccucagggaagcuugcucaguuagguaccuuccuuggagcacagguguuuucuccauccgagcuauugaaaugguuugccuguaugucuaccuagauuguaaacuccguugaaucaguaaccaugucuguucaguuucucccuagggccuugcaguaggguagauggucaguaaauacuguuuaaggcauuaauacuuuuuauuuuaauccuggcccuggauaucagccucaaaaguuugcaguuuucugcauuuaacuucaaaauuauuuacgugauugguaaugcaugcaugugguuggccugugcuguaauuuagauguuuguuccccuaaaccuccuguugaaauuugauccccaauguuggagguggggacuaaugggcaguguugggucauggaggugguuccuucaggaauagauuaauguccucccuggggagaggguaaaugaguucucuuuauuuccaccagagcugguuaaaaagaacgucgcacuuccuuucuucuuuugcguccucucuggccauguaaucucugcacacaccagcucuccuuugccuucuggcaugaguagaagcagucuuaggcuaccaucagaugcagaugcucagucuugaacuuuuccagacaucagaaccauaagccgaaaaaccuuuucuauuucuaaauuauccagcuuuggguauuccuuucuagcaacacuaaagggacuaagacagccugccauauguaggaucacaaggucaagcacaaauuuaccuauuuaugcuguacuauccucagguugacugggacaaguagaccaugaaacugggcaacagcuacucuaugucuacauucuguuauuagcauccaaagugaauaauggcggugaauuuugaguuuauucuaaggguuuaaauaacugcauauuuuaucaugacugguauggacugaauugcaucccccccaaaaauucauacugaagcccucacuccuaaugugacuauauaaauguuccuuaacuuacaaagggguuauguuccaauaaacccaccauaaacugaaaauaccuuaaguugaaaagaucuuaagucagaaaugcauuuaaugcuucuaaccuaccaaacaucauagcuuagaguagccuaccuaaaacaugcucagaauacuuacauuagcuuucaguuaggcaaaaucaucuaauacaaagcuuauuuuuuaauaaaguauugaguauuucauguaaucuacuaaauacugaaugaaaaacuggaugguuuuauggguacucaaaguacagauucuagagugcauauggcuuuuggaccaucauaaagucaaaaaaaucuuaagucagggaccaucucuaguuggagcuaggccuuuagggagguaauaaaaauuaaauuaggucauaaggguggggcccuaaucccauaagauuaaugucuuuauagaaaguggcaccagagagcucucuccauuugagaacacagcaagcagacagacaucugcaagccagagagagagcccucacccaaaacugaccaugcuggcacccucuuuuggaccucccaaccuacauaacuuugaaaaaauaaacuucuguuguguaagccacccaaucuaguauuuuauuauggcagcccaagcuaauacaaugguuuuauuuguugauacauuuuauaaaguuuacagacugagauauuauauucauuuuugaagaaacuuguccagaguuaaaacuguugcugcaaaaucacccaucaaacuguuagcacagcgugacucaauuuuaauucuaauuacauauuuaacauacgauggaggcagaaggugugaauauaaauacaacagguaaaauacagaaauacaguucuugccuucauguagcuuaccaccaccuuaaguggggaaaauuaacccagcaaaaaguaugcugaagucauacauuuaggguuuuuguuuguuuguuuguuuuuugagauggagucucgcuuuuuugcccagguuggagugcaguggcaccaccucagcuuauugcaaccuccaccucccggguucaagcaauucuccugccucagccucccaaguugcugggacuacaggcacacaccaccacaccuggcuaauuuuuuguauuuuuaguagagacgggguuucacaauguuggccaggcuugucucaaaccccugaccucaggugauccacccaccucagccucccaaaguguugggauuacaggcgugagccacagcacccagcuaguuuauccucuuaauuuuccuucuuuaaucuuucucaucacucauucuuaacaggaacucuuuaaaaaaauuuaagaaaccuccaaaaauauaugcaaaagaggagucaaagaagaaaaauaagcaaacagcaaugaaaaaggaaagcauagacuggaagggcagauaggcagaaaggcauguauguaauugcacuuagaagggaugcaguacauguuuuaauggggugggagcugucccagagacuuccuuucacacagucugucuccccagcuuccaaauauaaacaugcacauggcugcugcuuccucucuuucaggggaacucaaaccaaaaacaggaaucauccuugcuaauuagugcugaguggaucagggacuaaccagaaucaggcaacaagaaaauguaagucaaaacuuaugaucagcccuggcaacagagcuagacccugucucuacaaaacaaaauuuuuuuuaaucagcugggcauaguggcaugugccuguagucccagccacucuggaggcugaggugggaggauggcuugagcccaggaauuugaggcugcaaugagcuaugaucacaccacaucucaaaacaaaaacaaaacuuaucuagggacuacacguggagcuuuggauaugggcagcuaaucugucuaugauuaaaaacacgcagguggcuuacuuuauuaauccaaaauaaaagaauuugggaacacaagaaagggaaaaaugagccuccaugucaagaccuuucccagaaaccugauagcuuauaguuagaaauuguuauagacaguccagugcaaggaggacauuaagccacaggggaaaggaguuguguggccagguuagucaggcaauuaacuagaaaaaaucuguccacauagaggagccugcauaauaaaaagguauuaaacgauaguagaauauugcuagagcagaagauagcuagaaauauaaucaauaaccagguuauggaagucaggcaccuuagaguuuauccuauaggcaaugagaagccauucaaaggguuuuuguuuuuguuuucagcacuuuaaagaugucauucucguuuuccagccuccauuauaucugugagaaacuaguuguaauuc

SEQ ID NO: 16099 - RNA, 13977 nt, Homo sapiens
cauggcaguucccgagacccgcccuaaccacacuauuuauaucaacaaccucaaugagaagaucaagaaggauggugaguucucgggauaguccggaguccagacugucccgcacgggcuggccccucuuccguccccugcacccgccucucuuucuaaguguuuguccagccaaacuucgaguuaacuccuuggccuuuacacaaacuacuuccugucuucaacacuccauuaguucaucuuacacucugcccuuuaacguggucacugcugcucaucuuacaagguuugaggucacaggacccuuccuccaggaagccuugccuugucccuucacguggcugccgcugacuugccguacgcugagaccaucucccaucaagcccugauuccucugagcugucguggggcucucucuccucccaguggccuuugaacuccgugagggcaaggacuggggcuuucuuggucaccggcuuuuucagugaucagcccacaaugaacauguaccauaaugguggcuaacgcucuguaucaugggcuggucugugugcuuucauauaaaucuugauaacauuuaauucucacaacaaucuuguaggaagaaggcuauuguuauucccauucgucaacuaagaaacuggggccgggcgcgguggcucaccccuguaaucaaucccagcacuuugggaggccgaggcgggcggaucaccugaggucgggaguucgagaccagccugaccgacauggagaaacccuuucucuacugaaaauacaaaauuagccgggcaugguggcgcaugccuauaaucccagcuacucgggaggcugaggcaggagaauugcuugaacccaggagacggagguugcagugagccgagauugcgccauugaacuacagccugggcaacaagagcgaaacuccgucucaaaaaaaaaagaaagaaaagaaaaagaaacugagacaggggugaugugacuugcccagggucacauagcaaguaaagugguugaggccacccguauagaauucugcuuaggaacccaauuuuuggccgggcguggugguucaggccuguaagcccaacacuuugggaggcugaggcaggaggaucacugaaacacaggaguucaagaucagccuaggcgacaaagccagaccuuuucucuacaaaaaaaaaaaaaaaaaaaaaaaaggcugggcguggguggggugcgucuguggucccagcuacuugggaggcugaagugggaggaucgcuugagcuagagagguugaggcugcagugagcuaugauugcaccacugcacugcugccugggcugagcaagaaccuaucugaaaaaaggaaaaaaaaaaagaacucaauuauugaaaucggaaagacucucucacauucucaaguaaauuaucaccuuuauugaaccucauuuuccagaucuaaaaacugagcaaaaucauaauaccuuuuuugcauggauguugggggagauuaaauuagcuaaaccuugcaguauuucuuuuuuaugguaacuggcagcuaguaaagggcuggauaaauguuagcucuuaucacuucaagaaaauuaucgggagaaccgaaggagcuuguugggauucaguuugagguuaccagugaaguugcuguugaagaaagcaaaaccagcagccgggcacuggcucacgccuguaaucucagcacuuugggaggcugaggugggcagaucauuugaggucaggaguucaagaccagucuggccaagauggugaaaccccgucucuacugaaaauacaaaaaucagcuggauguggcggugcgcaccuacagucccagcuacucgggaggcugagcaggagaaucacuugaacccugggaagcagaggucgcagugagcugagaccgcaccacuguacuccagccugggugauagagacugucucaaaaaaaaaaaaucaggaguguaaauuuugcauauguuuuuuuuuuuuuuuuuuuuuuuuuuuuuugaggcagaguuucacucugucacccaggcuggagugcaguggcacgaucuuggcucacuacaaccucugccucccagguucaagcgauucuccugccucagccucccgaguagcuggaauuacaggcacccgccaccacgccuggcuaauuuuuauauuuuuaguagagacgggguuucaccauguuggccaggcuuuucucgaacuccugaccuuaggugauccgcccaccucggccucccaaagugcugggauuacaggugugagccaccacacccggccugcauauguuuuuagaguguggugcccaaccauuaucgggcagugcuggggacacauuggugacauagaacccugguuuuuuguuuuuaaaucuuauuuuauuuauuuauuuauuuuugagacggagucuuccucugucgcccaggcuggagugcaguggcaccaucucugcucacugcaagcucugccuugccuccuggguucacgccauucuccugccucagccucccgaguagcugggacuacaggcgcccaccagcacacccggcuaauuuuuuguauauuuaguagagaagggguuuaaccauguuagccaggaugguguugauuuccugaccucgugaucugcccaccuuggccuccaaaagugcugggauuacaggcgucagccccagcgcccggcguuuuuuuuuuuuuuuugagaugagacggagugucgcucuguugcccaggcuggaaugcaguggugcgaucucagcucacugcaaccuccgccucccgaauucaagugauucucugccucagccuccugaguagcugggauuccaagcaccugcuaccacgcuuggcuaauuuuuguauuuuuaguagagacgggguuucaccaucuuggcuaugcuggucucgaacuccugaacugugauccacccgccucggccucccaaagugcugggauuacaggugugaaccaccgcacccggccagaacccugguucuuuaggacagugacagcccagaguagucagggccaucaggcaggaagcuuaggcagaguguugagggcugggauugggaacuuagaaagacagagagauccauucagcuuccaggaaaaggagacauuuuggagagccugccagguacaguaagcaguauuuauguuacacugagggagaagagcauucuuaacuugguccagcuuguucagauguuuagggucaaaagagccuggcguauucugaguauuacaaguaguuuugaggcuuguaaaucauggggaaacuuccagugagcugugcacugguggcucauggcugugagguguuggacuuugcccugaggguguuggggagccagacugcuucccuguccuggcugccucccugguggaauauccucccagcuguggaggguaaaugcgaaugggcgaggggaggcuggagaguagagagaggcccagagucccguggaaugagugaagucugagcaagauucauggggauggaguacggagaggaaaaccagaaaugucaccaccaggagaauuuuugacuaauugcuuaaaaacaaccuugacugcugucccugcccccacccagccuacacauuuucuugcuucuuuccuagccugguaucuauuuuacaaguggcuucugcuucagcuuagcuuuuuuuuuugagauggaguuucgauuugucacccaggcuggagugcaguggcgcaaucucugcucacuguaacuuuugccucucugguucaagcuauucucaugccucagccuccccaguagcugggauuacaagcgcccuccaccacgccuagcuaauuuuuuuucuuuucuuuuuuuuuuuuuuuuuuuuuuuuggcauuuuuagucaagacgggguuucaccgucuuggccaggcuggucuugaacuccugaccucacgugaucugccucagccucccaaagugcuggaauuauaggcaugagccaccaugccuggccaguuuuuaugaagguuggaguccaguggugaggucauggcucacugcaaccucugccucccaggcuagagugauccucccacuucagccucccaaguagcuaugaccacaaggcaugcaccacuaugccuggcuaauuuuuguaucuuuuguagagacaggguuucacccuauugcccagacuggucuugaacucuugagugcaaaggaucugcccaccucggccucccagagugcugggauuacaggugugagccaccaugcuuggccaucucagccaucuucuuugcauaagacauuggugcccuuugcagaccuggguggugagagggaguccauccuuguugagcuugaaucucacuugcugucaagugaugcccuuugcuggugagauguggugguaccggguucagauggaauacguggacugggcucugccauacgcuuccuuaugcccuccagauugaugcccugggccagugaggaauccucugagaaccuguuuccaguaaaauugggacagucauaguugccaccuaauggguuuguugugaggaagugaaguuaccuccauaaagcauuugaugggggugcgaugacucaugccuguaaucccagcacuuuggggaagccaaggcaggaggaucacuggagcccaggaguucaagaccaaccuggccaacauaggagacugugucuacaaaaaauaaaaaauuagccgugcgucgugcugcgugccuauggucccagcuccuugggaggcuguggugggaagauugcuugagccugggaggucaggccuguaguaagcuaccaucaugccacugaacuccacccugagcaguagaaggagauucugucuuuaaaaaaaaaaaaaggcacuugaugguaucuagucaaauguuugcagccaggugugguggcacacuccuguaaucccagcacuuucggaggccaaggugggcuaauugcugaagcucaggaguucaagaccagccugggcaacauagcaagacccugucucugcacaaaauccagaaauuagcugggcaugguggcauacaccuguggucccagcuacuccauaggcugaagugggaggaccgcuugaguccgggagguugaggcuacggugagccaugaucaugccacugcacuccagccugggugacaaagugagaccuugucaccaaaaaaaaaaaaaaaaaauugugguggagucugugcuaggcuuggcauacugcaguaaacaaaugggacaggcuuauagcuccucaggcaagauagacaaguuaacguaccaugacaggaggugggaaauagucaugaaagaaaaggaaguagaguaagaaugacaugggaagaaauuuagacgucguggucagagguggcaacauuuccucugagacugggugacuagaaggaggccaccauguaaaccucaggggagggauguuccagguaaagagagcagccaguucaaaggcccuggggcaaaauuggugugucagaccugggggccagugugguugggaacucaggagggcgguggaaugugggcagggaugaggugggggaaaucugccagggccacgucaugcaggcccaugucagggugcugguggcagugaaaagaaucacucauuuaucgaguguuuacuacgugccggaugcuguccugagcacuuugcauguaugugcacauguucauuauauagcagcucucuguaagcacaucuuacagaagaguagaagaguguacuuggccacuugagugguuccuggcugcuucugugauuguuaggucuugagagauuauggacccgaggcauucuggguaccccaucaauuggcugauggucuucuauuugggcugcgcuucuucuaaaaaggggagcucaaaggucuuuuuuucccccacugcagagcuaaaaaagucccuguacgccaucuucucccaguuuggccagauccuggauauccugguaucacggagccugaagaugaggggccaggccuuugucaucuucaaggaggucagcagcgccaccaacgcccugcgcuccaugcaggguuucccuuucuaugacaaaccuauggugagcauugcggguacggaggcuguguggguguguaaaauguuauaggagacugggcgggccuggauuagaggaggggauauuacgguucauuugccaaggugaggcuggaccaggcucccacugcaccuugccucauuuaaaaaucuuuucuuuggccgagggcgguggcucacgucuguaauccuggcacuuugggaggccgaggcagguggauuaccugagcucaggaguuugcagccagccugggcaacaccgugaaacccugucucuacuaaaauacaaaaauuagcucgguguggcagcaugcaccuguagucccagcuacuccuguggcugaggaaggagaauugcuugaacccgggaggcagagauugcagugagccgagauccugccacugcacuccagccuaggcaacagagugagacucugucucagaaaaaauaaauaaauaaauaaauaaauaaauaaauuauuuugagacagaaucuuccucuguugcccaggcuggagugcaguggugcaaucuuggcucacugcaaccuccaccucccggguucaagugauucuccugccucagccuccugaguagcugggauuacaggcacgugccaccauaccuggcugauuuuuuuauuuuuaguagagacgggguuucgccauguugcccaggcuggucucaaacuccugagcucaagugaucugccugccucagccucccaaagugcuaggauuacaggcgugagcuacugugccacacuaagaaucuuuaacauaccuuccccuacugaauaagcaccaugaaagagggguuuuugucuauuuuguucauugcuuuauucccagagccuugaauggcgccuggcaucuggcagguucuccuuaaacagcuaagugagugagauugaaccuggaagacugaaguauucuugugugacaggaaaucccccugcacugcacuccucuccuagcauugucuccucgguccuuuggccugauguuuauugcuguuccagcuucccuuaaaaauaccaacagccuuucuacugaacacuugcuuacugugugucagguacuguuccaagcacuuuaacucauuuaguccucacaacaguccuuugaagugggaaguaucauaauccccauuuuucagacaaggaaguuaaggccaagauauuucuguguuucucaguaagcuccugauaaggucugaauuuuuuuuuguuuguuuguuuuuuguuuuuuguuuuuugcucuguugccugggcuggagugcaguggugccaucucagcugacugcaaccuucgccuccuggguucaagcgauucuucugccucagccucuugaguagcugggacuacaggugcgcaccaccaugcccagcuaauuuuuguauuuuugguagaaaugggguuuccuggccaggcgcaguggcucaugccuguaaucccagcacuuucggaggccgagguggguggaucaccugaggucaggaguucgagaccagccuggccaacauggugaaacccugucucuacuaaaagcacaaaaauuagccaggcgugguggugggcgccuguaaucccagcuaguagggaggcugaggcagaauugcuugaacccgggaggcagagguugcagucagcugagaucucaucacugcacucuagccugggugacagagcaagacaaugucucaaaaaaaaaaaaaaaagaaaagaaacaaagaaaugggguuuugccauguuggccaagcuggucuccaccuccuggccucaagugaucugcucgcuuuagccucccaaagggcugggauuacaggcaugagccgcagcaccuggccccugauaaagguccaauuuugaaucuuggcaauugggcucugaauccacgcucuuaacccguucugcucucuguuugguagcguauccaguaugccaagaccgacucagauaucauugccaagaugaaaggcaccuucguggagcgggaccgcaagcgggagaagaggaagcccaagagccaggagaccccggccaccaagaaggcugugcaaggcgggggagccacccccguggugggggcuguccaggggccugucccgguaagccaggucccggagaccaacccucccacugccagaccuuccucagccacauggacuggcuuugggacaggguggggagaguucuccccuuggggcuucagaccccuccuuuccauuucuuuauagagauguguuucucucucucuuuugggggguauugagcaccuagaugaugcuaucuccuuucgaaacucuuguucccuccuugugacuguuucucaaggucuuucuucauggcuaugacuugguuucgcucucuccguggccuugauuuugucgccugugucuuguaacucauugugcauguagaaaauccaagugucuacuaagcaacuguuaggauuaauaagugaacuuaaauuuagaaagaucgcuggauauaaaggcaauauggaaaaaaauuaguuuuauuuauuuauucauauuauguuuugagacagggucucacugucacccagguuggagugcaguggcgccaucacagcucacuacaaccuccgccucccaggcucaagugauacgccucagccucccuagcagcuggaacugucaguccgugccacuccacccagcuaacuuuugcauuuuuuguagagacggggcuuagccauaucacccaggcuagucucaaacucacugucucagccucccaaagugcuaggauuacaugcaugagccaccauggcuggcccccaguuuuauuuuuauaugccaguaacagaccaguagacuucacauugaaaaguagcacugagggguaaauccaacaaaagguuugcagaacgacuacacugaaaucacagaauguagcugggagaaaucagagacucagcaauggauaggaagacucaguauugucaagaggucaguuccauccaaauuaauugaagauucaacgugauugcaaucaaaaucccaccaggaauuucgguaaacacuggacacugauuggcucuuucuaaauguguggaaagacaaggccaagccaggcgaggagaauaaagcaccaggaccugcaugaccaggggaagcuccagcaaccaggccaggcccaauggcucaugccuguaaucccagcacuuugggaggccaagauaggaggauugcuuuaggucaggaguucaagaccagccucuauaaaauagcaagaccucaucucuacaaaaaauaaaauagaaaacugggcguggugacucauuccuguagucccagcugcucaggaggcugagcugggaggaucgcuugagaacuggaggucaaggcugcagugaacagugguuuugucacugcacuccagccuggguaacagagugagaccuugucucuuuuuuguuuuguuuuguuuucuuuuguuuuuuuucgggagggagucucagucaaucugucuccccaggcuggaaugcagucgugcaaucucggcucacugcaaccucugccucucaaguucaagugaucuucugccucagccucccaaguagcuggaucacaggcacaugccaccacguccaugugcaaaaaaaaaaaaaaaaccugcagcaaccaaccaggaugauauacaguuggcagaaggguaggaagacagaccaaggggacaggaugaagagucuagguacagcuacacuuguauaauuacuugaugugugaucgagguaccacugcacuucacugaggaaaggacuuuuuuuccccuaguucaugaugcggggcaguuggguaucugcaaggggaaaaaauuagcccuaccucauacuauaugcaaaauauaacuugaagugaauugcagauccaaaugugacaacucacaaaauauaguuucuuuucucuuuucuuuucuuuuucuuuuucuuuuuuuuuuuuuuuuuuuuuuuuuugagacagagccucgcucuguaguccaggcuggagugcaguggugugaucucagcucucugcaaccugcgcuuccuggguucaagcgagucuccugccccugccucccgaggaucugggacuacaggcaugugccaccacacccagcuaauuuuuguauuuuuaguagagaugggguuucaccauguuggccaggcuggucucgaacuccugaccucaagugauccgcccuccucacccucccgaagugcugggauuacaagcgugagccacugcacccggcccucacacaauaaaguuucuagaagaaaacaggaaaaugucuaaaugaccuuggugagggcaugaaaaguggaaacauccuguuuuccaaacaggauacaaaaagcaccgaguacaaaagaaaagauggaugaaccaggcccacuccuuaggucucugagccuccgugucucucuggcuuucaugagucucauggcucugacugggucaugcucuauucggugccacucacacuuucuccaaguuggugauggugucuggauuacugugggcuccuguuaaccucucuccucuucccugcaccuaguuuucuguccacuuuggacuucagauugugauuccagccccugagugugcugccugccaucuguugucuucccucuuccccuugcugccacgcguuuuguucugcaccugcccugagugucccuuuccaucacugcccuccuuuguuuuuguuuuuguuuuuugagacagagacuuacucuguugcccaggcuggagugcaguggugugaucucggcucacuccaaccuucuguugccggguucaagugauucuccugccucagccacucuaguagccgggauuacaggugcccaccaccacgccuggcuaauauuuguauuuuugguaggggcgggguuucaccauguugcccaggcuggucucaaacuccuaaccucaggcgauccgccugccucggccucccaaaguguuaggauuauaggcgugagccaucgugcccggccuaccacacauuucuuucugcaccugcccugacugucccuuuccaucucuuccucuccuuugauuuuguuuaagagacagggucuugcucugccucccaggcuggagugcuguggcacaaucagagcucacugcaugcagucuugaccuccugugcucaagugauccuccuaccucagccucacaaauagcauuuaacucuuucugauuuaaugucccacuagacccuggguuuguuuugcucugucgggcccucuuugggugccuuuugcgccucuuucuggguguuuuuccuuacaucucucacccgcuagguuuccuuucauggccucuucucugccuccuggggcugcuguaaccacgcacucuccucccucucuccacagggcaugccgccgaugacucaggcgccccgcauuaugcaccacaugccgggccagccgcccuacaugccgcccccugguaugauccccccgccaggccuugcaccuggccagaucccaccaggggccaugcccccgcagcagcuuaugccaggacagaugcccccugcccagccugugaguaucuagucccacccaccaggucucauauaaauagugagaauacaggacuagaaagggaccaguuggggggcugcuguagguuggguggucugggcaggcccccugaggaggugguacugaaugaggaaguagcagugggggugggcccugggcagaggaauuggcaugcugguuggaggguacggaagguuaggguaggcuggaguggugccagcaccuagauugauuccaugagcuauugagcgccuccuuacgugccaggccccguucugcacuguagggcugcagcagggacugagauagaaaccucugcuguccuguggccuauagucuguaggggcaaagaggugggaggcagacaggcaacagacaacaauaugugguauguuggguggaaguaccagagugaauucaagcagggugagggauggaggaaguggcaguacuaugggucucccacuggacucagggcucuugugcucaccgacuccccuauacccccgcagcuuucugagaauccaccgaaucacaucuuguuccucaccaaccugccagaggagaccaacgagcucaugcuguccaugcuuuucaaucaguaaguggggccuguggcuggguggucccuggagggugauggccaggaggcaucuccauggaaacaggccucagaacucugccagcagagcucugagccaaguagggcuuugcagaagggacagcgaccaaagaugugaaaggaggaggcuguggcugggcccacggccugugggggacaugggggugaggcuggaaaggucuccauggccagggcuugccggcuuuuuucagccuuguuugagggcugagggaguccaggcucugggccucauuuucccagccccuaaaaugggggcaugcaaggcaagguauguguaaaacugcauugagauguccuugaacauuggcuaagacuggcagaagucagcgugcucagaaacagcaagugugggagauggggaugcgugaaacucuugugccuggcgucaggguggaggccggugcagccgauguguagaggggcuguucaccauuguugagugaagucgugggugugggugaguucaucuggugguucuguuucaggggcugugaguggggcauucgucaguguuugugguggggaguuggagggugucugggagaagggauggcuacaugcagcaucucaccaugcugcacugcguggcacuuagaagaacagaaagcgcaacuuuauaauagugccgagagaagauugugagaaccugaaaaauacagaaaaacaauaccacaugugcagccuguccacaaagcuguauauuuugugagaaugccgauggaaaaaaggauaccuaguaaacaugaggauggcugcuuaauggagaaagaaguauggaaugagaagagggaaauuagagaaacagcauaucagaaaagugaggguaaggccgggugcgguggcucacgccuaaaaucccaguauguugggaggcugaggcagguggaucacuugaggucaggaguucgaggccaaugugggcaacuuggugaaaccccuucucuccuaaaaauacaagaauaaaaauggaaaaagugaggguauugguuauuuuuuugguguggcggguggguuaugauuuaggaagggcccaggagacugcgguguacuguuucuugauuuagguugcaguugcauggguguuuguguuuaaauuuuucauuaaaugcuauguuuacauuagaguuuuucaacuuaguacuaucugcauuuugggcuggauaauucugaguaauggggcccugcccugugcauuggaggcuauuuggcaucauuucuggccucuguccacuugaugccguuacguuagggggaaaugcugagucccugaggucugucguucucuuucagguucccuggcuucaaggagguccgucugguacccgggcggcaugacaucgccuucguggaguuugacaaugagguacaggcaggggcagcucgcgaugcccugcagggcuuuaagaucacgcagaacaacgccaugaagaucuccuuugccaagaaguagcaccuuuuccccccaugccugccccuuccccuguucuggggccaccccuuucccccuuggcucagcccccugaagguaaguccccccuugggggccuucuuggagccgugugugagugaguggucgccacacagcauuguacccagagucuguccccagacauugcaccuggcgcuguuaggccggaauuaaaguggcuuuuugagguuugguuuuu

SEQ ID NO: 16100 - RNA, 7322 nt, Homo sapiens
caaugucugauagugcagagaccccaaguuguguguugccauuagggaaggugcuguugucacaccucgagauggccugggcucccccagaaaagaggggcuuugguuuucucaaaauaccuggguuaagugagguaggagagaauuggaguuuaauuaguauacugugugugugugugagagagagagagagacagagacagagaaccagauugugugugagaauguaucaaucugugugugagagugggagacagagaaaacuuggcaguguaggucucugaguaaaagagaguuagggcuugcuuaucuuuuguguguguuugugucagagagaggaggggagaugacaguguggcucuucugaauuucaaagaggugauuugggagucugagaguguccuccucugccaagucuggagcaaaccccaggggcugucagugacagcuguggagccgcucccuccugccuggaaaguggcagugccuggcccacggcaaggagccuacagcccuccugccaccuugcacuguugggccucacugaacacugagcuugggcugucaccgccgccccccuccaucccagcagguggcugagccuuugagaagagccccuggacaggcaggugacagcuugucauggcaggcucuccugcucagcugaagagaagggggacacugacuugggaggcagaacaaaaggaaaugcaaagucaggggagcacaagagugggcacuuuguuuccuaggaauuuuaaaccuuccuuccaucuuuucaaacaucauugucaauguugccuucuggugcucagagguaaucauggugaugauuauugauauaaucaauaucaauaucaauuauugacauaauuaauaucaucaagugaugauuauaacuugucuucaauuaugugaaaggaaaucuauuaauuuagaggauggugaccagcccuguggagggaagcagaagaaaaggaaguggaacccugcugcagcaggcaggguucugccagccaggcgguccugcugcugcugcaugaggagcuuggaccagacaccagggccaacacagccaugugacuuuaaagugcccuaagagcccccagcuccccagugcagguaugaggaaggggcauagaggagugcuugcuccauuggguggugaggaauaucagggaaaaauucucagggcagugaagaaugcauggggcucacuggaaaggaaucugcauucauacggacacagaagugcugacacugggcuuggggagagcacugucccuggcagggguuucuacaagguaccagaugacuugcuucccugggggaugcuaaggguaugggucugcuuucugcagggacuggguuucccuagagcugccgcaggggucacuguuggagcaugggggagggagaagagaagaagaggaagaggcagcucacugucauuaggggucugaguucccuucaagacuucauacacaccuuccacacagagcuuugcauugaauaguuguguugccaagaauucuucaaauguuugaaaaccacugcuucagaaaaauuaugucuuaacucagauauacgauaaauuuaagauuuugugucugucuguguguguguguguguguguguguguguguguguagaauuuggugaacuacgagaagauaucuggcagcgaauuaauccuaacccugucauccucaaggucaucugcugacccacauccacaccugccagcaggugugaugccaacagguagaagcucuugguguagaggcacuuuagucccucagcuucagacagucugcagcaagcaucuaugcagcacccauucuguccucaguacccugcuggggacaugguaaugaugagccucagcccuacucucaaugggcaauggaugucccuaacaccauccagccagcacacugucuugccacggugagguuacagaaguacaacacauagcuuugguucuagagcccacccaaguaugaaguuuuccaggccaaaguccaggcauaugacugauuccuuuugcuaauugcuuauuguugagaagcccagaggguagcacuucuaugugucugggcauugcuacagcacuuuucuccaccaucuugugugagacaaaaucucaaugggauuauggcagaaauccagccacucaugaauacugaguauuguguucauggacuuguucaccaaauauuucuguugugcagcaugagaggauccccuugaaguuuggaagugauagguucauggccgaguguaucaugaaauggcucugaauuucguaaugccugcuauuccaaaagguuuauaauacauaaaguauauugagguuguugugaaaguccaacacgauagaaauuuaaaccacacaauauauucuuauuaucauuaaacaauaaauuauugaauguuguguauugaguuauauccccacaaaagacauguugaaguccuaacugugagaccugugaaugugaucuucuuuggaaacagggccuuugcaaauauaaucaaguuaaaaugacaucauacuggauuaggaugagcccuacauuucaugcuggcauccuuauaagaaggccgaaugaaaauacagcaacacaccagggagaauaccaugugaagauggaggcagagauuggggugaugcaucuacaaaccaaguuauaucaagaauugauggcaacuaggagagaggcauaggauagauccucccuagagccuucaaagggagaacgacccugccaacaccuugaucucagacuuucagccuccagaacugugauagaauaaauuucuguuuaaagcuguuuaguuugugauacuuuguuauagaagccaugagaaacuaauacauugaguauauacaauuuuaucagauacuaguuuaacaauaccacuguuaaguuccuagguggcagaaccaucacgggcuacuauuagggggcaagaggacuugggagugagggauagcuccaacacuuuauaucaaagccccucgauuaaccacagggccccucuaacauuucaucacugcuguugaucagaccucggccacaguucauaccuugaagcacugcccuuugucauccugccugagggagaauucuauccucacucuaccaucaguguccccagacucagauggccacuccaggccuagguaaaugcacaacaacaccggcugaaagcuaggccaauacacauuuucuuugauuacucagaaggccuagcccagugguucccaagcuugguuaccuacuggaaucaccuggggaaaguuuauuuguuugcuuguuuuuaaagccaugaauauuuuaauuuauucgaauuucucggaguggugcccaagcauugguagguuuuuggugaugcuucaggugauuugaaugucaggccauuagucacagcuacuggcuggagaagugguucucaaauuugaauguguaucagaaccuacuggagggcucauaaaacugguucuaacccagacuuuaaaauuuacuaguucugggguagggccugagaauuugcauuccuaacaaauucccagugugguucucccacuuugagaacugcuggcauagaucaauccgacauaagucauggauugcuuuaggaauugucuuaaauacaaacucugauaauuguuagugccugguuuaagaaggauucugaggcuucaugacugggcucaacaagagguuuugacuaaugacuacauguaagaaucaccugaagcacauucaaaucaucaaugcucgggcaccacucccagagauucuaaauuagaauacucaaggcacuaacaaaaaauaaaacuuuccccaggugacuccaaugagcaaccaagccugagaaccacugggcuagaccuuccagguauggagagaagagggguauuuguguugaugagcaaugucuuccuugggugaggaaguaggcagcuguuugcauggcaagugauaugguuuggcuguguuacuacccaaaucucaucuugaauuguaguuccccuaauccccacuuauuguaugaaggacccagugggagguaauuuaaucaugagggugauuacucucaugcuguucucaugauagugagugaguucucacaagaucugaugguucuauaaggggcuuuuuccccuuuugcucagcacuucuccuuccugccaccacgugaagaaggacaaguuugcuuccccuuccaccaugauuguaaguuuccugaggucuccucagccaugcugaacugugagucaauuaaaccucuuuccuuuauaaauuacccugucuuggguaugucuuuauuagcagugugagaacagacuaauacaguaaauugguaccaguagaaugaggugcugcuauaaggauaccugaaaaugugguagugacuuuggaacugaguaacaggcagagguuggaacaguuuagaggacucaggagaagauacaaaaaugugggcaaguuuggaacuuccuagagacuuguugaauggcuuugaccaaaaugcugauaggaauauggacagcgaaguccaggcuaagguggucucagauggagaagaagaacuuguugggaacuagagcaaaggugacuuuugcugugcuuuagcaaggagacuggcagcuuuuugccccugcccuagaggucuguggaaauuugaacuugagagagauuauuuggggaaucuggcagaagaaauuucuaagcggcaaaguauucaagaggaagagaacauaaaaguuuggaaaauuugcagccugacaaugagauaggaaagaaaaacccaucuucuggggagaaauuuaagcggcuguagaaauuuucauaacuaauaaggagcugagucuccagggcaugucagagaccuucaccacagucccucccaucacagaccuggaggccuaggagggaaaaaugguuuccugggccagguccagguucccccuacuguguggagccuuggaacugcagaacuguaucucagcugcuccagcuauggccaaaaggggucaagguacagcucaggccauugcuucagagggugcaagucccaagccuuggcagcuuccacaugauguugguccugugagugugcggaagacaagaauugagguuuggggaucucugccuagauuucagaggauguauggaaaugccugcauguccaggcagaaguuugcugcagggguagagcccucaugaagaaccucugcuagggcaguguggaagggaaacguuagguuggaagccccacacagaguccccauuggggcauugccugguggagcugugagaagagggccaucauccuccagacccuagaaugguagauccgccaacagcuugcacuguacaccuggaagagcugcagacacucaaggccagccuguggaaguagccaggaggggagcuguacccugcaaagcuucagaggcagacuugcccaaggcugugggagcccaccucuuguaucagcaugaccuggaugugagacauggaaucaaaggauaucauuuuggaacuuuaagguuuaauaacugcccauuggauuuuggacuugcauggggccuguagccccuuuguuuggcccauuucuucccuuuggaauggguguauuuacccaaugccuguacccccauuguaacuaggaaguaacuaauuugcuuuugauuuuacaggcucauagguggaagagaccugccuugucacagaugagacuuuggacuuggauuuuuggguuaaugcuggaacgaguuaagauuuugggggacugccggaauggcaugacuauguuuugaaaugugaggacaugagauuugggaggagucagaaguggaaugguaugauuuggcuaucuccccacccgaaucucaccuugaauuguaguucccaugaucccuguguguuguaauagagacccagugggagguaauuuaaucauggaggcaguuacccuucuguucuacuguacuagugagugaguucucauaagaucugauuguuuuauaaggaguuuuccccccuuuugcuuggcacuucuugcugccgccaugugaagaaagacauguuugcuuccccuuccaccaugauuguaaguuuccugaagccuccccagccaugcugaacugugagucaauuaaaccucuuucuuuauaaauuacccagccuugaguaugucuucauuagcagcaugagaacagacuaauacagcaaauauuuuucaacauuguacuaagccucaaaagaucuuaaaaugaugaaaaaggaaaaaaagcagcaaauuggccucauuaauguuucugucaaguauaucuguggcccaaaggaaauggagggcaaauugagauaaaguuuacauuguaugucaagagucacccuggaguuggcagguuggacacucugccuucgagcagugacccuccugacugugugguugaccagccuggguauagcaccugcuugcgagugagggucugugcaauccauuguagacaaguucacacacagaugggccugcccucagggggcauccauguggcacaccccugcuccuguuccacagucacugucuacugcacugcucuaaagugagcugcaaguguuucugugucaaauuagaaagguauuuuagaauaaaugucucaacuuaaaagcucucugaaaguacacugacccauuuuccucaaucuaaugaguaaagugauauuuuuccagacaagacucauaacaacuaagaaggaaaagaaguuuuugccuaaaagguuaucuugcucugagugucaccagcuucuaacagcuaguggaaauggcuucuggcugcugaauugcaacugagucuauauaauaaagaggcuguucccaguuccccaggaugccaggaauuugcaugaaaacagucucucaucuucugaaagaguucaucuggcccugcugcuuauuucuuuccagaagccacaaucuugauggugacacuguaauuuauuaccgugcuaaggauuaugaugcaacauacagagaaugaaaacuugaggugggaagcaggcugcaggaacaggugagcuuuuggagaggauggucucguuugucaugcaaauggcacacauaacagagaagagagcugggagaaaagacaacccaaaaagacacauagcauuagcugcugacaaaauuguuucuaaauagaauguuuuucaaagcuuuucuugaagcauuagcugcuccuccaaaaugaauggcagaauguauuucguacuaguaauaaaauaugugauuugaauaacuaca

SEQ ID NO: 16101 - RNA, 16818 nt, Homo sapiens
ugaggcucugcuccccgcgccugcgcagagugcagggccacgucgcuuuugcuguaccggggaccacgcgucucauccauggcuuccgcggacucgcgccggguggcagauggcggcggugccgggggcaccuuccagcccuaccuagacaccuugcggcaggagcugcagcagacggacccaacgcuguugucaguagugguggcgguucuugcggugcugcugacgcuagguaaaaggcggccgguggucauggcggguuuggggcgggcagagguccgggcuuuggcugcaccgcugcaggccggggacgcggggcugagagggcgccuugagggcaucaggagggugagacccacccagucuacaccccacccucucuccugaagcagcggcagcagcugggcguuaagggggaugccgggcaacccccggaguuaacguccugguccuuggggcgcagauugcucuucgucaucugcccuguuacgcuugagcgcgcuguuccucgccuuccgcuguucucacugcaaagacucagggucuugacaccaacuuucagccucccguguuugcgugcgggcgcugggauaccaagguagugagauagcaccugagucccagucagaguaaggacugcaaagaaaaguugacaguugacagugccuggcucucaguggaucccuaacaacagcaauaguaaccauuaugauaaaagucaguuccaggugaaugagguguuucgucacagacuucugugaauuuccccaccccagccaugcacauauacugauucccaaggcguaauuuuuguuguuuuucucugucuauuccacagucuucuggaaguuaauccggagcagaaggagcagucagagagcuguucuucuuguuggccuuugugauuccgggaaaacguugcucuuugucaggguaaaugauuucauugacaccccuguuaagcuuaauagaaaauuuuauagaucccaguauuccugucaucucacgguuuauuuuguaaaagaagcugaugcuguuaaauuuggaaguuaauucuugacuuacuugggagaacaaaaagacucguagaaacccauaauugagaaauauuggucauuucuccuuuuuuuuuucuguuugcccuugccagaugcugauauuuagucuuuaucacauucaaggauuuuauuuaauuaguuucauuccagaauagcagaaggcauagaagcuaguguccuacaguuuauaauuccuucguuaacaaauucuuaggacaguuuaucgaagacacuuuuucacagggugauccuucuuugacauagugggcuaguuaggcuucuuuuuacuaauauuuauuuuuaauacauuuaguauuuuuaacaguguauuuuaauguggugaauaggagagguuuucugcuuuuuaacucuucuuuuugagaguauaaauuauuucccuuccauuaaagaaauaccuccauuuuuuuuuuuuuuuuuuuuuugagggagugucucacuccaaugcccaggcuggagugcaguggcgagaucucugcucauugcagccuugaccucugggacucagaugauucucccaccucagccuccgaguagcugggacuacaggcgugcaacacuacgcccggcugauuuuuuauauuuuuuguagagaugagauuuugccauguugcccaggcuucaaaucauuuuuguugguuaaaaaucuuuacagaagcuuggcaaauuuggccacuaacugucuuuugagaauaauguuguuuuuauuccacugaggaguaaaauaugcaauuaauuagauuuuuuucuacagguaaaaaaaaucaauaucgucuuuuucaccugucggaagcagcauucauuuacuuaaccuuacaccugggagacuuagaauaauauaacucaauuuaggugugcuauuaaaauguugaauaucacccaucuuguuuuuuuuacaguuguuaacaggccuuuauagagacacucagacguccauuacugacagcugugcuguauacagagucaacaauaacaggguaagauguuuguggaguuuuggagucugacagucuuacuuuacuguggugugucaguuaaggacauuuuuaggaugaguucaucugaggauguaaguaccauuuguagcuuauuuuuauggagaaacauauucuuugugacaaauucucuugacaaucuguacaguagauuuaaucaugcccuccucugcauuguuguaccuuaauguacaguaauguuauaucacauuuuauucuuauuuuuuguuucugugucuucuuuccaacuuuacaaugaguucuuaagagugggcauuaaaccuuuuaaguuuugaauagguaauacaugcacaugggacaaaaauucaaaagguuagaaaagauauuuggugaaaaguaauuuuuccuuuccuuuccccacuaccuaguuuucuccucagaagcagugacuuacuuuuuuuuguauguagucuuccggauguucugugcauauacaaacaugucuguauauccuuuauuguuguuuuuuuuuaaaugcuguucugcccauuauuuuucucauacggcugauacaacuugggcuuuucuuauuguccuacauuuguauacauaguaccaucugguugguuuaugagcugcauaguacuccacucuguugcuauaccauaaaauuaaauucuuacuuaaucuggaccguguuaauagacauuuaguuuuguuauuauaaccuuugcuuuuacaaacagugcugcaauggauaucuuacagaguauauaugaguguauuucaaauauaaggaaucauggggccuggcuugguggcucacgccuguaaucccagcacuuugggagaccaagguaggccgaucacuugaggucaggaguucaagaccagccuggccaacaugaugaaauccugucucuacuaaaaauacaaaaauuagccgggugugguggugggcgccuguaacccagcuacucgggaggcugaggcaugagaaucauuuuaacccgggagguggagguggcagugagccaagauugcgccacugcacuccagccugggcaauagagcgagacuaagucucaaaaaaaaaaaaaaaauauaaggaaucaugggaaagacauuuuacauaccucuguaacuucagaauguagacagugacuaccaaaccgauuguaaugcauaaguuuguuuguuuguuuuugagacaggagucucacucuguugcccaggcuggagugcaguggcaugaucuuggcucacugcaaccucugccucccgaguugaagcgauucuccugccucagccuccugaguagcugggauuacaggcgcccaccaccaugccuggcuaauuuuuguauuuuuaguagagaugggguuucaccauguuggccaggcuggucuugaacuccugaccucaagugauccgcccaccucagcuucccaaauugcugggauuacaggcgugagccacugcacccagccauguaauaaguuucggugagugaguggagugagggcucguuggaggauguggauggauagauggaugaauuagaauugugguuugagaccuuuucuucuucucuuugucuucuuuccccuuucucaugccuccagaauuaaagauuguaaagaaaaauaaagggacauguuuuuaaauaucuuagcgauaucuuuguuuuuuuuuucaaugaugacacucuuuguggcccagaccuuuuuaaacucccaaggauucagauuuugaaauuccagguuugcaagaucaucuaguaccugcacuagauuuuuaacuuaggauacuccaggauaugcuuuaaaucuguaccuucuaauauguagccacuggccacaugugacuguugagcaccuaaacuaggacuaguccaaauugaggcaugcuguaagugugaaguacacaccagaucuugaagacuuaguauggaaaaaaagaacguaaaguaucauuaauaauuucuuuuuuuauuacauuuuaaaagauaauauuuuggauauauuagauuaaauaacuuaaaauuaauuuuaccaauuucuuuuuacuuuuuuauuaugguuacuggaauauuuaaaauuacauauguggcuucuguuauucuauauuucuacuauauuucuauucuaucaauauuucuacugaauauauagagcauuuuucccuucccucuucacucuuucuccuacccccuuacguuuucgaucuaaucucuuuagauaguaauauaccuaguaauguaucuuccaaauugcuuagggugugugguauagugcugcuuuugaaauggagcaguuaagucccaaccugggaucuccagacucuuaacaguacuuaaaaaaaaaagagagggacuaauaaaaaacauauuugucuauaaagaaaugcacaggcuaugugaaagguaaggucauaauaaacccagcuggaauuguguuaaaucugugcaggauacugauugccugcuucugaacuguggguaugguuggcuguggauaauguagaacauguaagaaaugauggucugcugcauguaccaggccacaucuaagagucuuauuguugagcacagccacguuuacacugaauauaaacuuuauucaccauuccaggccuugaccuuauauucaggaauggcagccuggcauggugaauagaacuuauuagggugcaucguagauuugcucaguaggggcucaggaauugacacaaaugcugacggaguuggaacaaguaaauuauaugucuggaagauaaauauuuaaauaauuagauuaaggguggaaaugauaaaaguguacuuuguuauaaagauuggagaucccaguaagaguaauaugcucuaugaaaaauuguaaguucuuauauuacauuauuaguuuaugaguacuuguuacuguuuucacauuuuugcuuauacucauacaguacuccuacuuugcuauacucacacugguuuaucucccaagccucagguagaucaugcuucccugacucccccagacagguuuuuccuguacccucaaaacauuuaucaguguucucauuuuauauuuauguguaauuuuacauuauguucaccuuucucauaaauuuugccagaucaggaaccgugucuuuggccacuguuacauccccagaacguugacuaguguuuuaugaguagaagaugcuuugugaacauuuguuugguuaauuagguaccaguuugguagccaauauaugauacuaaagguuuauauugugaacguggaacuguauugaaacguuaauguuauugcugccauccccagggcaauagucugaccuugauugaccuucccggccaugagaguuugaggcuucaguucuuagagcgguuuaagucuucagccagguaagaaggaaagaagugaagugggcuugucuaggucuguaucuguauaucaaagccacucaugugauuugcucuggugguguuugggaggcagcaugguauccugugguagaccuugaggugaccuuggggucagccaguucuggguugcaaguccaccuucaccuggaugaugaggauuuuaugggauuaaaaugcuuaaaaaguguuuuuuaguguuuaggaaauguuaacccuucuugucauuguuacuaaauguuugcauuuauucugaaggugaauuuaauaauguauaugacuauuaaaaucugaaaaaagaauuuuaaagcugggaugaauccuagcaguuuuuaaaugccaacaucauuuauauauauaguguuuuuuuguuuuuuuuuuuugagauggagucucacucuguuguccuggcuggagugcaguggugugaucucggcucacugcaaccuccaccuccuggguucaagugauucuccugccucagccuccugaguagcugggauuacaggcacgcaccaccacacccugcuaauuuuucauaauuuuaguagagaugggguuucaccauguuggccaggcuugucucgaacuccugaccucaugauccgcuggccucagccucccaaagugcuggaauuacaggcgugagccacugcaccuggcccauauauauucucaaauuacguaaaauugauguuucaagaaguacagaacaauauuuccauauuucuuuuagugugugcucugguguuacugacucuuaaguucuucccuaaaaagucuuaugcugcaguuucagaugcuucuuuuuuggucucuaacauuaauaagaacugaagaggaaaaucaguaugccacauuucacugauuugaagacacauuuuaauaucucugaauuuagaauauaucuuauaguugauggugucauaguuuaauuggcaguauuuucucuuagcggucccuaaaauaaugucuuuaauuggcagcauuuuaguuuugauggaaugaaguaguagauucuuugccuuuuauugaagaugucuagacugaaauuucauuauugcaucuuugcccacaagaugguggugaugaacaauuugucacagauaagaaaauuccuuggacaauugagacaaaucuagagcugguaaauuuugccauaauuggguuuuuauuuccaauuaaauguuuuuucuuuuucuauugccaguucuaaauauuuuaugauuugcaguauaacuacucugugauucauguauuuuggguaaauaaaacaugcaaaauaugaagauaaaacuuaguucaaauaaauuauaaucaugauaacaugcaaguugaaaagacauuuacuauauugguaugugacuuuuuuuuaauccuacuuucuggcuucgccaaguuucccuaguggcuauuuucccucuccugauuugaacauaugcuguugcuguucuuaucaugguuccccucccccaucuuuuaaacauugccuauuugauugucugaauccaauaauaucaguuuccuuuuccugaaccuuaaacacuuuaacuuucaucuuccucacaucuuccuuuuauuuaugcuccuuuuuaacccccauccauacuuuuuuuuccucuuacauucagugaugagaauuaccaggaugcuuauggucuuuugcuccccauugcuucuugaauuuuacuucuucccuuuagauucaguuuucccucacugaguauaucuuuuagaaguguuuccagagagggugaugaguagucaaauguuuucagucuuuguucauuuguaacucuauuuggccagcauuuuggaaugucucuuuuagcugagugcagaguccuggguggcagccgcaucacuccugaccucauccaucuguugcagaugagaauguuuuugccagucagucuaauugucauuucacuguaguaagucugccugauuugaccuucuauccagggauagauuuucuucuguucaaggauggauuuagcuuuaucauucuuggaauucaguugugcuauuccaaaccaaagauucuccucaguuuuggaaaauucucaccaucguuucuccagguagugcuguuuccccaugaucauuucucacacucuggaauucuuaugaauguuauugaaccuuauuauuuuugccuuucuuguuuccucucuaucguaucuuccagaucuuucuacuucgcauauuguaagauucccucagauuuguuuucuaguuuauuacauuauuuucagcugagcaugaucucugcuuaacuuuuccauugauuuauuaauaucauuuacuauauuugucuaaaauacuuaccuuuucaaaccagccuguuucuuuuuauacuauucuauuuuuuauuguaguuuguaguauuuucuuaaauaauuuuaaacauuuacuuuauagauagcuuuauuaucuuaguuuuggggugcugauuauucucuuugggguaccaguuauucucccucauaauuauuuuauucugugccuuguaauuuuugcuccagaaccuuucuucaagagugacacaucauugauauuguggugguucuuuaaucccguaggauaugaaagccuugcuccauaagcgguucauaguuccuucuguuggggccauagggcuucaauaagucuggcccaauuuuuauguaagccuuuccccuugggggucuuacaccuggagagaguauaaauucauacccuauaucugugugaggcaguggaggcccgcuguuucuaagggaacuuuuuuugcaagccccgaccucccugagacuauuuuaaguuguaggcuuugugcagggcauucaguucuagcuccccagcugcauguuggccauugcaugucucuuaucuccaccugggcauucaaacccuuguccauaaggcuuguauuuuuuuuuuuuuuuuugagacggagucucgcucuguugcccaggcuggagugcaguggcgcgaucuuggcucgcugcaagcucugccucccagguuuacgccauucuccugccucaguccccugaguagcugggacaacaggcacccgccaucacaccaagcuaauuuuuuguauuuuuaggagagacaggguuucgccguguuagccaggauggucucgaucuccugaccucgugauccgcccgccucggcuucccaaagugcugggauuacaggcgugagccaccgcgccuggccgguuuuuuuguuuuuuuguuuucuuugagauggaguuucgcuuugucacccaggcuggagugcaguggcaugaucucaguucacugcaaccuucgccuucuggguucaaguaacucuucugccucagacucucaaguagcugggauuacaggcucccgccaccauaucuggcuaauuguuauauuuuuaguagagauuggguuucaucauguugcccagacuugucucgaacuccugaccucaagugaucugccugucucggccccccaaagugcugggauuacaggcgugagccaccgcacccggcccccuaagaccuguugucugcaguuucccugggcugcugcacuuuagcuuugauaucucuuuguuucugucacaugaggagucccacuauggcugccuuaguucaggcccuaccuggucacugugcuucuaguucaagcgcccucuaagauugcuuugucuuccauuuaggcaccaauauucuucauaagacagaaaagcaugaacuccacaggucauugugucacgccucacugucugacuugguucuccuucauuuccccaucucccuguguaccagcuuaccuugacuuccccagggaauguguuucacguauuuguggcuugaacauacuguaggcugaguaucccuuauccaaaaugcuuggaaccagaaguguuuuggauuuuagacuuuggauuuuuggauuggggauacucaaccuguacuuuccagacagccugugccccaauuuuuggucuagcuaagauucaacucaacuguuacauucuccuuaaaguugccuuugaccuggucucauuuaaaugaucuuucucuuuauuccuguuacacaugugcauaguuuugucuuggcauuuaucauaugguucucuauaugaugauuugucuuggaggacaggcaucauuucuuacugucuuuuuucagcuucagucauugauacacaguagcacucaauaguuccuuguuaaaugaggauuuauguuauaugauaacauaugcacagaccugcaugugugucugcugaguguuaaucaccaagauugacuuugaagaaguucaggauaguuuuucaagauaaugauguccuguuacacguucacaugccaguuuuucuuguuuucucccuccagggcuauuguguuuguuguggauagugcagcauuccagcgagaggugaaagauguggcugaguuucuguaucaaguccucauugacaguaugggucugaagaauacaccaucauucuuaauagccugcaauaagcaaggugccaucauguuuucuugcaauaauaauugaguuuuuuggggauugcugcuacuaagaauuauuuccauuauuuacaguuguuauuauugaggaugagauacaauugcuguaaagaacuauaaauugaaggauuuuuaaucuuaaaauuuauuucuacuccuaccuuuucaccagucuucuaaccagaagaccaaggaaugauaaccaagugacugcuaacugauuuuucuuugauacaguguuuuuucugauuauaaauuauuuuacuuuaccaaguuaaguucaucagauugacaauaugugauaucagaugcacaguuuugcaggguggaguuucugcuuucaaacaaguuuacuguacagcacauuuuaucaagggaaguuugcugaaguuguuuucuuuuaaccugauaaccauugaaaacuuuucuaguaauccccaauaaaacugggcuucaguuccguuaccuguacaauaagacagacuaguggaucucuucaggucucuuccagaucugaaauucugauucuaugaagaguucaaggcauuucucagaagugaccagauaauauugauaaugccuuauugggaaugcaauuagcgucauuaccugaccucuuuauuucccugauugaauauaaggaagggaguuauuguuuauuugccaugggcuuugugccaaaccagagcuuguuucuuaccuuuaguacacuuaaugcuuuaaacauaccgucuuaggaucaauuggaaacaugcuaaguuuacuuuaaaaugacagauagggcacugucuuuuggcaugugaaggcacuucucauaaucacagcacugguagguuuucuuucuguuaaacugaguaaacuuauauguuuugaauugaaaggucuauaagguguggagaacuuuagggaaagcuaaagucaguuuuagggucaccagcauaauauguuuauaagcauuaucuugggaaagccccuagugcaaguauaaagcuuacuuugauagagaaggaacuagugauaaaaggucuuuuuuuaaaaaaagagaaaaacuuacugguuuaaauaggaauuuuccuucuguguaagaagucuuggggaaaaaacucauucucguuuaaacuacaacagugucuuuauuucuuuacagauauugcaauggcaaaaucagcaaaguuaauucaacagcagcuggagaaagaacuguaagugugaaagaggccuguugguuaauuauauaucuuaacacuuagacuguaagcagcauauucauguuucuuuuguuugguuuuaugugauuaucacaauuauagacugaagauuagugugauaaauauuuguuaaauaauuuacaaaauaauggaaucacaaaaacuuacuagggugcuuauagauauuuuaaaauuucauggaaagaagauuuuuuugaaaccauaaacuuaauuuauuuuaccauuguuacuaaaucauuuauaguugaaagguuuuagaagcuaaaaaaguuuacaugccaacuugagaacgguguuauuucagugaguggaaguguuuguucaccacucaauaaugccugugaagugguauuuaaggaugcauguaaauaauaaaaaauaaaaacugagaaucaggaaaaaagaaauuaaaacauuuaaaagccacuuuggaaauuauuguugacagaauaagaacagaacacugaggaagacuacaagucuuugauacuacauuauagcuucuuagauuguuaaaauacuuggcaauauuauauauccugcuuugaguguuucaagguuuguaaauugagcuauaagcuuuugaauuuuaaggcaucuagcaugucuucugcguuaugccaauuuguaagagcuagccaaaagcugguguagaagaaaugaucaacauuuauaguaaagcaaguuauguuuucuuauugcuuuuguguaaggccuugaaaaggaucugaugaggaaaaacuguauaaauucaacuuuuagaaacuuuucuccccacuaugacuuacugacucccuuauucauuuaagaagcaccuguagugcaucuaguggaugccaagacugcaguugggagcagcuguaggaggaaauguguuccuguacucaggagcuuagagucugguagaaucuagucagcuucgggcauuggcaaacuccugccugggccugcaagccaagaguaaaucgacauuuuuaaagggcagguaaaaaacagaagaaaaauaugcgacaaaauauuuaauuucuggcucuuugcagaacaauuuugccagcccugccuaugccauuuucagugguuccuuucccgucuggagcugcgaguuuaucacccuguccuccugugcucuugaugcucacucucuuggauuguaucuguugcugccauuagguuaauaaggacauuggaacaauuggaugguuggguuuuucuaaaaauucucuugaaauuguugggaauuguuuuggggaagccaaaacugucauaauguuauuugugaaucagucuuggguuauuuuuaacaguacaguccaagucucccgugguuaaaacacauguuuuccauaggcuguuugcuuuucacucuauagacuuagagaaaaacaauacagaagccaauccuuuuuuaaaagcauugaaaggcaaugcuuucuuaaaaggcagugaaacaaaauguugacaaauuguaaagguuaacaucaguuaaaauucggaaucugacuaauuuuaaucucagauuuaugagaauuaggcccuguuagcuuagaggcauuucauagucucucaauaacacgguauauuauauuuacauggccuuguggcaaaagcugaauacauguuuuacuuuuuuccuuaaaaaauuuuuauuguaaaauaucuuacuuauaauaguauauaugucacaugcauuaagcuuaaaaaauauuaaaaugaauaccuauguacucaccaccaugccuagaaggccccuguuucuccccaaaagcuuuucccucaagaggucagcaauauccaguuuuguauuguuuuuuaaaaauacuuuuacaguguguguguguguguguguguguguguguguguguguuccuuccuaaacaagguauugcuuaguuuugccuguggauucuucacuaauuuugaagcaacuuuacagaacaagaaaugcuuuauuuuguaagaaagaagauuggcagcauguauuccucugcuucuggauagcagaaaggggaaggggaggccgacaaaugaguguugcuuaugcacccuuuauuagggccagcagguggcaguaaggggacuuacauugggaagguuuuggugguuaaagagguuggauaauaguaauucugcccuaguuagauaugagaaucuggaguugguggauuucuaaacuccauauccaaauagacucaagauaaaaauacauacccuaucuacccacacuuaacuuucagaaacuuauguuuuuauaacacuuaaagcauguauuuuaaaaauauauuuuuagacggcuucauucaguagauccucuuagaagggggccuugggcugaaagaaaguuggugugaccuggucuacugcugaccugccuucuagcccugugaggucugacccccccagcccgccccaccuaccucaccucucuguccaagagagggacuuauaaaugcaaaggauuauucaacaaucuuaauagcauaauuggcaauucuauaguuaaguuuuaaaugagugcugaaauguuuagaaacuaauaugauuuaauugcuguauaaaaauuuugccuccugacuucuuuccuuuugccccacagcaacaccuuacgaguuacccguucugcugcccccagcacacuggacaguuccagcacugccccugcucagcuggggaagaaaggcaaagaguuugaauucucacaguugccccucaaaguggaguuccuggagugcagugccaaggguggaagaggggacgugggcucugcugacauccaggacuuggagaaauggcuggcuaaaauugccugagaggcagcucuaaagcacaagaccuggaugugugacacacaguuuuggaaaaaggucugugguagucuggaguugaugaggaagggguacaagaugugguuagaaacauuucuuuguucuggaaacaaaguacuguugaaaccagcuuggaauuuuuuuuuuuuuuuuuuuuaaguucaguucucccuuauggcugccuuucaaacaaguaccuuuuaucugaugccuguaucuucccuuuguuaagguguaacuugauguagggucaagguuuuugugacaacaggcagacuccacacagagaggauaugaugagaauauggccaucaccugaaaaguuuucuuaucuucugugcuuuuggucccuggaaacaaauccgccuauguaugaagcuaguugauuuccaguugcacuauuuccaguugccucugaaguucacaggcaauacauugucuaguccuuugcgaauuucucugauuugugggcacaguuaugaaguuuccccacaugugaagacagguacaaaauagcagagccaagcagacagugggucuauucuucauuagcucagugacuuguccacacucgucuuagcacuuacguuucaaaagcuugucacaaacccuuggagucauucccagauaauagaacuggaaaugauaaauccccuaaugccaagggucuaguguguucuuagugguuauacugggaaguguguggagauuuaggugcugcucugcugcucuggauggcugaaggcuccugggccaucuucaugugcugcuugaagagcuccuauuuuguacuccuggcuagaaugcuguggaacaaauacaaagugaaaaaaguucucuguagauuucugaagugcauauucauugaugccaagaaaaaaaaaaaguugccuuuuugaagugauguuuuuugcugucuucuuaaacacaaggcuuuuuugaaugauuaguauauuucaugguaaagaaaacagccugucuggcucaaagcaauuaaauagaauguaauggugaguacaaaugagugcacaugucaggacucaggucuaacuccuugucuccugagccuaaagauugcaacauacacaagaacacacuccuauuccuaccccacacacucagggacaagcccaacuaaagcuuacaaggagaccaggguggcucuguccaggggagaagccaguuauggaacagugcauugagagccaugguaggagaggcccacaguucucuggagcaugcagcaggggcaccccaccuggccuugaggaucagggggagucaaaggauaaagcauggggcugaugacgucugagggagugugauccuccauguauggccucugccugcugucucacaugucccuucugguggucacuugggcucuaggaguauacgucaccucagaccaucuggcagaaauacuccaggcuccuaccccaaagcacaugucagccuugcugcuggagcacgaagacaauguaaaugaaacaugaaauggaggaguugugagacccugacccugaguccuuacuugaaagcugcugcugguguucugagugucuuuuggacucuuauuucuugcccuuuuccuuauuaggcaagcaguaacuuaggaaguagguaagagcaauaaaugugacauguuaugucaucauaguaggagcucaugggaauaaaagucaguggcuugaugcuucuguuagaggcaugugucccucucagccucuuuuauuuuuuucugguuaauaucuuacuuuauuggaggaagcagcacaccagaaaaagugacugaagaagggcugcaaguuugaguuugauucaaggccuaaagaaggucuuccaaaaaaggauaauucuaucuggaacacuggucucaaauguuagugggcaucagaauuaccugcgaugcuuguuaaacugauuugaggacccuacucucagacaauuugauucaauagcaagucugguauugccucaggaaucugcaugcuuaauaagucuuuugucagucgcauggcaccccuagagaugaucuggccuggagugucacgugugccuuuacuuuguuuuuaaagucucuuggggcacacacccugcugaguuuuucugacagggucaagucagcaggcaugggaacucugaccuugcuucuuacuccuguacuaguagcaggcauuccguucuuguggcuuugggccaggaugaggucauggugacuagucuuugggaacugggaaggguuuugaugggaggucaaaugugcucucuccacucagguggugcccuuuuguggcccugagggcauuugacuaaaguaggcccauuucaugagaugggcagguguggccagaguagaaggauggaugucaggucuuggagacgggccaacuaggcacgacuguaugacauagaugagacuuuugagcuugaaacaccuugggaacauggcaguguauggacaccgagaccuccuaggacagcagcugccuaaugcaaaugacccuguucccugcuaaggcugcagugagaugcccucauggaggggcagcugugaugagugagccccaggcacucuguuggugaauauguccacuucuggaauggaaucucccuaguggguauggacacgggcagacccagaggggucuaagcacugcacuguuucuuccuuuggcuccucuccaguccgggccuugguagccucuccacuaccaggugccugacagucuacuggggguuccuaaucaacagcagcugcuguugguggggagucccuggggucugucacuucuucccacugccuc

SEQ ID NO: 16102 - RNA, 16781 nt, Homo sapiens
aguccaaaauccauauauuuacuuuuuauugaauuuguuaauguuacagaauucuugcacugccaaaccaugccugagaauucaaacaaaugguacaauggacagccucauccacccaucauacaguauauuaaaacuugauucauuuauauuuugauauuuucacaaucuuuuaaaaaguuauaacaagaguuguaauuuaaaucugcugcaggucuucagauuucgaguacaauaugccuuuacauaacaccuccacuuacucaucuguucauucuucaguaacauaacccccaacaaaauuuuguugggaaaaaaugcagggaaaaugcacaguucaacgaugaagagauuuuuuuaagguuuuucauucccaaauaaaagucuucaguuuaccaagaaucccauuucugauuuaaucauucaaccuucccuuggcuggcucaguuacucacccaaauauauuagaaggcaggcauccugccugccaccucaaaugucaacauugcccagaugcgaguggcaggucccgucaggagauacuguaacccuccucggaguccaauuccugcacggacacuuucgucaagacuaaacuccuaucugaaaacgcucccacgucaaaauaguuuuacucacccacuugcuucacucuugccaguagcaagucugcaacucaugcauuuggcaaagggauuuauuauagagaaacccggacucugcaucaaaugaugacauuaccacuuucacauauuucuauugaaccagauacaaaacuaggaaacugccagaccaucuuguuagguggacacucuucuguaauccuggguagcuuccucaagucccuuuaaaugacccaaaacuauuaauagguauuuuaagcaauaauuauuaaaaacagaagugcuacaucaccugucuuucgcccugacucuccaaaugaacauaaagacacaccaaaaggcugguaacagagcuagcugggacaaucacugcaucuauagaacagccaauaccuugaaaaacuaggcacaaguacaugaggaauucuuaucaaagaucaugcacaauccaugccacuuaaauggguuuuagcugagguuuugcucauguuacucugaauuucuaaggacagaucagugacccucuuagccugagcagaaagcauauucuucccacugcaguuuccuacacaauuuaguccugauuagaugaggcauuauagcagcaccugaaguagagccuccagaauccacugcccuuuucaucaaaggcuauuugguuccacccucaggauuggcauacucacgagacauuucacaauccuaaugcauacuuuagguuacuuaauuaaccaagcaauaugcucugucaaagaacuuauuucaagucaaagcaaaaaaggccuuaaugcagaacaaaaacaaaacaaaaaagcacuauccaaauaaaaaaauuaccaaaaaaaaaaaacccccaagauuauucucucccuuccccuucccccacuugguggaccccaguuugguugaauuuauuuugugguuaccucagaauacaauuaguuuaaauuacaaaucacagcccuacacagaugaucugaacacaucaguucuuuucagcaguguguuccaggaagucuaauauaacaacagccuacuacagagaguauuccuuaaggguagggcacaggacagguuaauuaaggucacuuaaaucuucaucuuuuacagcagaucagaacccagauggcugacuuuuuaugcaggauuucugauaagaauccaguagagcugguugcaagguucacaucgacacuuaauaguuguaaucuucuuauccagaaguugugauccacaugaaguccacaaugagugcagcaaaucugagguagucaacccuuaugaaggcucaguaucugaacauaaaaagauuuugaaaugaccacuggcugcagguuuugguuuuuuguauuugcagaguaaauaugaaagaacacuguugaaacuaguucacacauuuauguaacaaugaaaauuccccuaaauccaauaugcauagagcagucgugacacuuuaacuuccauagugcaauagggccggucaugaaaucgaguggucugcaucggugucuguagauccagcagagaucagaugaugaauggcuguugguggugguuagcugcagucuaguuaccucagaaggguuagcaaagcccauuccuuaauuguauugugaguggcugcuuuucugauuuucaagcacagcauauugguugucuagcugaaguuuaagggccugguuuuuugaaaccucaucccuaccucuauuuuugugucuuacuacuucaaagcucuucuccauuucuuuaucccuaagggaaaagaaauguaaucaguaaauauuucuucuucacuaggguuuuugaaaauauucguccuugaauuuaaaaaaaagccaccccuuagaagaauccuggggagggguaggaguggaggcauauagaaaauccuuaucaaaccauuuuaaggcuucaauucaaacagaaaacacagaacgcuguauugaagcucuaggguccuaucuucuacugaacaguauuaacugugacccuauuucaggacaaacuugaagaaaacuguuaaaagcuguguaaugacauuccuccuaagacucuuacuuuuagcaaguaauagauaauacaucucucucuuuaugcacaaggguaacaauuuucucauucaaguaaauucuacucauuagucaaugauuucuccucacaucgauuuugugggaguggaucugauuagaucagguaaagaaacucgaguguggugaaucacugcccucccaaggucccuuacacauuuuuuaagacagagcagaggagcaaguccacguggagguuuaaauucaagccagcugugcucucaaaguggugaaaaggcugggauuuauucuaaaagccaccccaaaaaacacauuuccaucugaugucauuuacauuucuucccauuuuauuuauuuuaaaaaauucaugucccuaaaguaagauguagaugugccauauguagucauuuaauuccagguagcauucauuuuaaguaccugcugaaauaagauuauuuuaauauuagauuuauaaaugccaacaucuucugucuauagucacauuaacugggaauacaauuaaacagcgcuuuuauauuucuaguuuccauauuauaaggagcaaaagccacuuaauuauaaaagaauuuuaacuacauuaaaacuugucauugcuauaaaacaacauaaaccagggcuaagauaaacuuuugcagacagaagacaaagugucuccaaugcucuuugcccucccccuuuccucccuucuggacauaugaagucccacccugauucucaccugccugucagcugaagcucaggcuuuauuaguuaaggaguagucucucccuuggguggguaugcacauccccuauaucccacucccuggccuaggaacagaagucccaaacaaaaugcaauuaauuauaguacuuacuuccggcuuucuacaugcuuggcaguugacugcagggaugggaacuguguaucacuguagauuucuggugguccuugugguguuuuccuuguugugguuaaccuggccccaggaggccuauacacaccacuagucaucgcugguucugggguuucuguaacuaauauuuuauaacaauuuuuagauaaacuauuuaaaugcucagcauuuuaauaagcuauucuugcauucccaaucauuuaacaauuauagaaaaaacaauaccagggucucugggucagaccacagaagggaauucauuucagaaaaugucugaaagugaaaacaggcugggcgugguggcucacgccuguaaucccagcacuuugggaggccgagguggguggaucaccuggggucaggaguucaagaccagcugggccaacaugaugaaacccugucucuacuaaaaauacaaaacuuagcugggcaugauggcaggcaccuguaaucccagcuacucagggggcugaggcaggagaauggcuugaaccuaggaggcagagguugcagugagccgauauugagccacugcacuccagccugggcaacagaaggagacuccggcucucaaaaaagaaaaaagaaaagugaaaacauuguauuuuucuaggguaguauucuaacuccuccuccacguacaacuuuaguaaucuacguaaaugaugaguuccacaagccaaauuacuggaaguagaaaaggaaucugcugggcuuggaugacuggucucaucagggacugccucucagaauaggacuuuaguccuguuucccuaccaguaaauaugaauuacuucuuuaccugauugguggacugauuaagaugccauauguaaagaauuuuuuaaugaaaugccagugugguuauuuuuuaagauucuagccagggcugggugcaguggcucaagccuguaauccuagcacuucgggaagcccgaggcaggcagaucaccugaggucagcaguucaaaaccagccuggccaaaauggugaaaccccgucucuacuaaaaauacaaagauguagcggggcaugguggugcacgccuguaaucccagcuacuugggaggcugaggcaggagaauagcuugaacccgggaggcggagguugcagugacccaagauugugccacugcacuccagccugggcaagagagugagacuuugucuuaaaaaaaaaaaagaaaaagaaaaaaagauucuagccaggcacaauggcucacgccuguaaucccagcacuuugggaggccgaggcgggcagaucacuugaagucaggagccagacucugucucaaacaaaacaaacaaaacaaaaagauucuaaagaugauuuaaaaacauaagaccggguguggugacucacaccugcaaucccagcacuuugggaagcuaaggugggaggauugcuugaacccaggaguugaagacuagccugggcaacauaguuaagaucucaucucuacaauaaaauaaacagguggcaugccccgguagucuacuuggaaggcuggggugggaggaucacuugagcccaagcaguugaggggcugcaaugagccaugauugcaugacugcucuccagccugggccagagugaaacccugucucuaaaaaauauaaaaauaaaaauuuaacauagaguaguuaucugugauuucugcauaacaagauuuggagugauauguuauucuuuauaacauucuaaauaaaauaaugaguauacacuucuuuaaaguagugcucuuaaacuuucauuauugcccuaaggagaccuuucagacaucuguuuccuaacugccccccacuccaugaaauuuuaauacugcgauauacuauacaucuguuuaugcauucuagucuuuucgugggccacaaaugacuguuaagguauaagauuccuucauuccauaagaagcaacuuuuaccaccuugagaaugauaaaauuggcccugcugagaauucaugcuucaaagaacaggaaaguuaaauagggaaugaaaaagacaaagcacaagugaaagacaagggccccuugucuuucugucuuuacucagcugucaaaaauauuuuaaaugauaaaagcuuuaggaauuuucucucucaugaaaacuuuuggaguuaaacccaacccuaggguaguuaccacuaaaaauccuaaaugaagcugaccuuggauucuaguaaauuaaagucuuuuccuuaccuuuuccuccauuagcaaguaguuaauauuuaacgagaauauuagaagaaaugcucaauuccaauaaaugaaacuggaaucgacuagucuauaucuauauaaauuuuacagcaacauacaggacaaaagcaugucuuuuaacuuccagauuccuuuuauuuaggauuuuaaagucuuuaacaagauauauacacaucccacucuaccaggaauggaaaggagccucuccuccucacccuaccacaaucaugcacuuaguugaaaguggaccauauauaaaaucauauauaaauuagacaucuuucugaaacugaaauaguaaaauuaccaauuacuggagcaggaggugcuuguacuggagcuguuuuauuccagggaccugaagauuuuuccauaccuccaccaccaccuccaccuucuucccaguuaucaccuggaucuugucucuuuucauuaucgucuucuuccuuuucacugcuggaaaagcaaagauguaaauucauuaaggaaucaccaagaaaauuuucaguccaaaucguuaguuuuauccaugauuaucuguacgacccugaagaagucaaucucuuucgagacugaacgucuuauuuaaaaagugaggccagguacaguggcucacaccuguaaucccaggacuuugggaggccaagaugggugcaccaccugaggucagguguucaagaccaggcugggcaacauggcgaaacccaucuguacuaaaaauacaaaaaugagccaggcaugggggcacacaccuacaaugccagcuacuggggaagcugaggcaggagaaucccuugaacccggaaggcagaggcugcagugagcugagaucgugccacugcacucccuccugggcgacagagcgugacugucucaaaaaaauaaaaauaaaaaaaaccugaugugccucugugacaauaugccugaucauuuauagcagccccacauaagagcaagaccccaguuaccaccucaagcgacuaagggagggaagagaggaugauacaaccugaaaugcagagaagaaggugagcugaaggauuaagagcacaauuacaaaauuuuccuugcaccaaaguguacaaacaggcauuuaagguaagcauauuuuuagugagcaaaugaagaguuuugaaaguuguauaauuuuauuugccaauccuuucgcacauaaaauacucucagaauuagaauucacauuccagcagaugaaaacaagucuguguccaguguuuacagaggauagaauuagccccuaacaccagacauguauuuaucaccuguuuaaaaaaaauauauaagaucucagucuuuggcuuuccagauguuauaaauggaaaagauacccucagugguaacauaccaucuuaagacugcuugcaguauuuucucaaugcuaauuaauuuauucuugaauugacuugagucauaaucuauuucuccaaggcaucuuugauuauuucucuuuuugcuggauuacuuuuuauuauuuuguguaacuuuacauguccuaaauuaccaaguguauuuaucuuuugucucuugacaaaagggauacugacaacagggauauuaaagcacaauaauggcuaaaucgaacguccuuuuugcaacucuucaccucgaagauacaccuggcagaaacuaccaacauuuucauaaaauuauuuuucaugacaaugguggcuuuuccuaggucuucaagcuucucaacuccuucaccauucuaccuuuuccccaccuuccuauaaaaaaaaggcugguucccaaaacucugucccuugccuucuacucaucacccugacucucuuaacuguauaaccuuaggaacaucacagccucucuuggcuucugcaaaaggauaucuaaggaugcuuuccuuccauuucuauuaaaacaagacacaugcuggcuauaagacaaaguucuugacuagcuugacagucuccuuuaaagauacuuaggaaaaaaguaaguggcaaaaugccauucaaaaauaauggcacuggccaggcgcaguggcucacaacuguaaucccagcacuuugggagcugaggcaggccgaugaccugaggucaggaguuggagaccagccuggccaacauggcaaaaccccaucuccacuaaaaacacaaaaauuagccagguguggugacacaugccgguuagcuacuugggaggcugaggcaggagaaucaggugaaccugggaggcagagguuguagugggccaagacugugccacugcacuccagccugggugacagagcgagacuccgugucaaaaauaaaaaauaaaaaauaauggcagcauuguaugaauuaccuaccaaccagaagugacugcagaauuuggaggcuagagugacaaugaggaagaguggaaagaagaacagauuuaucucgucuacauuuacagcaagauuuuacuuacaacuuuaucugagaggaaaaaggauagagaauauggcaauucaucccuaagaggucugagaaagaaaaaaaugcaauuuaaaauaaaaauauagccaagccaucucucaguuuuccuuuucguuaacauguaagagaauucuaugcagccauuuaaaauguaaacccuaugcugacauggagguaguauucaugucauauaaaccaaaauucacuaaaacaacaucuauauaccuaauauaaauacaaaaacaucuacaacaauuuuaaaaaguuuuauagaguagcucugggugcuagaauguaugacuuuaucuucuucaugcagcaagcaauuaggagcagauucuaaagucaggcuuccugguucaaauccaggcucugccacuuaccagccaggaaacuuugaacauggcacuucauuucuuuauaccucaauuuccucuuauguaaaauggaggugacaaccccauaauaaucagcacuauuuacugauuaucccuaaauagaagagacuacagauaauucuuacauauuucuuuaugcuucuacauuuuucucaaaaaaauuucuaaaaacaagcauauuauuuuuauaaccuacauaaaaaaucauuuuuuauuuuuaaaaauuaauuuuuagagacagggucuugcucugucacccaggcuggaguacagaggcccaaucuuagcucacugcaaucuucaacuccagggcucaagagauacucccaccucagccucccaaguaagcuagaacuaaaggugcagaccaccacaauuggcuaauuuuacuuuuuuacauuuuuuuguagagacagggucuugcccaggcuggucuugaacuccuggccucaagugauccuccuaccucugccucccaaagugcugggauuacaggagugagccaccacgcccagccucacagaaagcuuuuaaauaaaaacuccuauuuggucugauggaauagugacaguaucucaacuggaaguuuuuuuuuuacugucuagugucuaacaucuccuugcccuuaggaaaaaaauuaaaaaauaaaauaaucucaaauuuaaaauacaccuaguuuacaaacuauuaccaaaaaauaagcauaaucuguuuaauuagagggauuguacaucaauaauaaaaggcacaaggagacaauuuaguauuuuggauucuuggccaggugcaguggcucaugcccuaaucccagcacuuuggaaggccaaggugggaggaucacuugaggccaggaguucaaaaccagcuugagcaauauagcaacacagugagacucugucucuauuuuuuuuuuuugagauggaguuucacuccuguugcccagacuggagugcaauggccugaucuuggcucacugcaaccucugccucccggguucaagcaauucuucuaucucagcccaccaaguaacugggauuacaggcaugcgccaucaugcccagcuaauuuuuuguauuuaguagagacgggguuucaccauguuggccaggcuggucucgaacuccugaccucaaguaauccaccugccucagccucccagaguacugagauuacaggcgugagccacugugcccggccaaaagaaauuuuuuuaaauaaauauuuuggguuuuuccaaauguacauuaauaauagacuggauaaagaaaacguugcacauauaccccaaggaauacuaugcagccauaaaaauggaugagcucauguccuuugcagggacauggauaaagcuggaaaccaucauucucagcaaaauaucacaaggacagaaaaccaaacacugcauguucucacucacaagugggaguugaacaaugagaacaaauggacacagggaggggaacaucacacaccagggccuguuggggggugggggacugggggagggauagcguuaggagaaauaccuaauguaaaugacaaguugaugggugcagcaaaccaccauggcacauauauaccuauguaacaaaccugcacguuguguacauguacccuagaacuuaaaguauaauaauaauaaaaauaaauaaguauuuuggguuaagauucugaaauacuagcuaaacuaaacauguggaaauugucuagucaagacucuuuaucagccgggcgcaguggcucaugccuguaaucccagcaucuugggaggcagaggcgggcagaucacuggaggucaggaguucgagaccacccugaccaacauggucaaacacugucucuacuaaaaauacaaaaauuagcuaggcgugguggcacaugccucuaaucccagcuacuugggaggcugaggcaggagaaucgcuugaacuugggagguggagguugcagugagcggagauugcgccauugcaccccagccuggguaacaaaagcaaaaacucuaucaaaaaaaaaaaagaacgaacaaaccaaaaacacucuucauccaacaauugaaggaauugaagcccagagaugcuuagaggcuugccuaaaugccaguuagcaggguagaaaugauuuacauauuuuauuacuuuuucaucuuuacauauuucagaaaguaucaacucuccaaaugucauagcagaacaagaaacacguuccaaacgguuauuuccaugggagacaggcugaaauucaguguuugacccaaauauaauauauagcuucccaucagcuaaauuuuauaaacaaacacuacaauacugcuguaaauucaucacaauuccacauauacggucuuaaauauguguaagucuguaaggcacuacugguaaggugaggagaauaaugaugcuacaaaagggagacuuacugaauaucuacuacagcaggcagcauuccaccccacuguacaaaguuaaaccucacaguaacacuaaggcagccaagagacccacuguauguauguaugaggaaacauaaguaccuuccccagggcuacaaaguagcagagccaaaauagugugggauucuagaggcucuauuauuucacauuaccuuuuaauucauuuuauccccuuuauagcucuaagguaugaugcaaaaauauucucuaagauuugagaaaugcauuuucuuuaguaaggcugauaggaucacacauccugcagcaguauauuuauaaagaauagaacagccuuaucucuuuaccucaagagacaugagaauuuauacauccuaacuccccuuccccaacacuagggggaagcagcuaaaacaaaaaucagacuggauugagcugcuggaauaccgggcaucuccacagguuugucccuauuauaccuagcauugcugcaacaguaaaauggggagauacacauggccugaucagcuaugccuggccuggaggcuuaaaauggcacugcaccucauccaaagaaucuuuccugaccccuucauggaugaugaaaugucucuccucugccccagagcaccaugcacaucucuuugaaauuaucuacuguugucuauuacagcaugacuuauuucuacaaccagagaaccucagugucuagcagaguagucacauaaguauuugcuagaauaaauccaccuuggauaauguaaccagcucuaccuaaaagguuuaagucuagauuucucaccaaaguuucuagaaaaccacugggcuccaagaacucaauuauuuacugaaacgugacaaaugcucaacaguguauaccuucaagaauuaaaucuuucuaacauucucccaaaaauccacuuuaaagauggaaguggcugggccuagcagcucaugcgugugauuccuuugcuuugagaucacuugcggccaggaguuuugagaccagccuagguaaaauagaccucaucuacagaaaaaaaaaguaagauuagucagggguggcaacucacaccuguagucccagcuacucgggaggcugaggugggaggaucacuugagcccaggaguucaagacuacaaugagcuaugaucaugccacugcauuccaaccugggugacaaagugagacugucucaaaaaaaugaaaaaauagagaugaaagaggccuacagggccuacaaacaaccaaggaucuaacucaaaugacagccuccuuuauaaccaccucaauggcuucccucucaagaaucugucuauaacagcaugaccuugaauaagaucuguuaauucagacacaaaacugggcacauuaaguaccuugguacuuaaaucuugagcugguugguaaaugugaaauaggaucuuaauauauaauacguuugcugcuaaugaaaaauuuccccuuucaaauguacagguaaagaacuaauaugcuaacuacuauaaggaccagggucaagaacuuuaagauuguaugugacaucuggcugggcucagaggcucaugccugugaucccagcacuuuggaaggccgagguggguggaucacccgaggucgggaguuugagaccagccugaacaacauggagaaaccccgucucuacuaaaaacacaaaauuagccaggcguggugacacaugccuguaaucccagcuacucggaaggcugaggcaggagaaucgcuugaacccgggaggcugagguugcggugagcugagaucgcaccauugcacuccagccugugcaacaagagcgaaacucugucucaaaaaaaaaaaaagaaaaaaagacugaaugugacaucugcagcucucaguauaccgagaaauagaaaaagauaaagcacauguagcagagacugguggaucugagugaagaacauaugggaaggaguguuucucaguguugcagguuaguggaauaccucuacuaggauggccacuuagggccaaugacuagaugcuaagaaaacaaaaaaaacaauauaaaagcuagucuaggccgggugcuguggcucacaccuguaaucccagcacuuugggaggcugaggcgggcggaucacgaggucaggaguucaaaaccagccugaccaacaugaugaaacuccgucucuacuaaaaauacaagaauuagccaggugugguggcgggcgccuguaaucccagcuacucgggaggcugaggcagaagaaucgcuugaaaccagaaggcggagguugcagugagccgagauuuugccacugcacuccagccugggcaacaagagggaaacuucgucucaaaaaaaaaaaaaaaaaaaaaaagcuagucuaccuucagguugaacagaacuuaaaugcuuguacuagcugauacuuacuuauaucccuggcaagggugaaguauguaaguuauuuaagacacuuuucacuaucucaaaaguaaccaaaauagaucaagaucaaaauaacccugaagaugaacauguaauuuauagucaguaacagaaaaacacagguucuguuuaaauaaucuccauaguuuaacaaaaucaauuucuaauccucagugaacuugaaaccaaaauuuuaucuucagaaaagugcuauuuugccaaguucaacauggccaaacacuauucuuccagucacucacguuuucaagaaccugcagucacuuaggaaagaaaagacuuaagaagagccaaacuuuacaacagaaccggagccacacacacaggcaguuccacaacaccaaaugguaagaaccucacauucccuccuccccauuauuuacaggucaagccccaggagacagaaaagagaaagacacauuaaggaagccaacaagugguugggaaucaaacucaagucuaaucacuucuacucaacaccacuacaaagaaaucucaagaguggagaagccaucguuccugaaaguuucccauuaucaaucuggggguuucacuuugguuaagcucacaaaaugauguuuucacaguaggacauuaaugccuagcugugguagguguucaacaaaugucaauaauauuaacccugcuuuuugaguaaguuaucuaaagcuauagauacuaacauccagagaagucaaaagacaguuuucaguuaaggaaaguauuuccuccacugugccucgcacucacuggcauugccuauaaaaugcaaccuucaaacuggagacaguuuaucaagauccuuuauuucuuuaaaccgggagcaaaggauuuuuucaucuuacagcagaaccauaucuucauuuguuuuuuccuacuuuaugaacccuccaaaauauagcacuuacuuaacaucaaccuuaaaguugacugccauagacuggacuugacaaaauguuaauuucaaaucuucuaaacuacccaauuuuuaaaaauuacuauuuuuuugaacuuuaaaaaauaacauguuuacaaauauaauuccauuccuaugaaguuuuagaaaaaauuaugguguuagaauagugguuauguugaaggugaaugcagugaguauguguuaggaggggaaccuuguucuguaucaguaauacucaguuucuugaccuggugcuuauugcacagguugguugcacugugugaacacauaaaaccucuaucucucuguaaguaugauauacuucaauuacaaaaacauauauucacuugcuuauuggagaggaugugaaaaacauccacauuacuuuugaaaccaaaacuaaguacaaucaccgauguuaaaaguaaaaauuuugaagcgacaaaauccacuuuagcugucucaaaugaaaaguccuaaccagaacuggaaguaggcaagcucucacaggauuuuagagucagcagcuaauuucaugagcacacggaagggcugccuccauggagugagaaagaguagacagaacccauuugaguccuaauaagcauaucuagagcacaaggcuacuaugaugcugcuuuggggccaaaggaaaaccuaacuuguauccaauaucuaucccaaagguuaucuaaacacauuuguaaccagacuauaccuuauuugcauugccugaacccugaggccgcuguaaucaaccucuuuuugcuccaauucuuuccauucaucuucguccuguaaaacaaacgccauuugaucaauuaaagcuauuuguagacauauaacuaagcaaauaacacacuacgaaaaguggaucaaguggcuggaaccuaaacuaaguauguacuugucuucuggucaaagcccuugcuucguucuggggcaaacuaggcuaaauggaggacaaacaugcucguaggcuaacacuauacuuccgcuggguuccugcaugggagcuguuacuuuaagcaacuaagaaaagccgaaggaagaagucaauaggaauuucacaacuacauuucuacuucaaccuugccaccgagaguuuucuuuuucuuucacgggcuuagagacuaagucaucacaaaagagcugcuacaaaugcggcugcugaaagcgaaaauucagcucaaacuacugggcugaggucagcacacggaauuacucagccuagacgucacccgauaaacgcugcucugugcugggcacugcggccccagaccuagugcccccggaggguggcgccgcccgggccuuggcuaacgccgagcgacgcggggugggaagggcggcuccaccgcggauaucggaaggggucccggcccuggcgagcccagcccgagguggagagccugcgucacguggcggcccgcgcccguccgcccggccuccgcggccccucccggacgcuuccccggcaggcgggggcgggcacauggggcgccggcgcgcggcccgggccccgagugccggccucccggccccucaccuucgucacagccuugguggcggccccugggcccgcagcccccgcgcuggcggucccgccgucacccggccggguccccgcgcccgccccgccgcccgccgcacccgcggcuccacugcuuccgccggcgcugcccgcugcgcccgcggcacucgccgcccgguugcuccgcuccuucuucuucuucuugucccucuuggcaaagaaguuguccaggcuccgcuccuccgucucagccauggccucggccuccucgacccggauggguggggccggcggcgggcgcggcccgcggggcuccgagcucggggucgaggccggcucugcgcucacgcugccgggcgcggcgacgccucagccccgcggggucgccgaggcgugcgcggcgagacgggcggcucccccugcgugcuggcgagcggugguacgguccgcccgggggcucgcgcgccgccgcugucgcccgaggcugccggggcugccgcugcugcugcgacggcggagcaggauuccgcucuccccacaaccugaggggaaaaggcacgcgcgagccagagguucuggcgagagugcucggcuagcagcggcgcgugccggaggaagaggcgcgcgcgcaggccuggagaggaggggaagggaguggggaggggagggagagggaggagggagggcgggccgcuagaagagagaggaagcgccugcgccugcguauuuugcucugccugccgcugugggaucgccaaggggcgggcggcgggaggagauggaggcggagcuggaaagagagccaaucag

SEQ ID NO: 16103 - RNA, 743 nt, Homo sapiens
gcacugccaaaccaugccugagaauucaaacaaaugguacaauggacagccucauccacccaucauacaguauauuaaaacuugauucauuuauauuuugauauuuucacaaucuuuuaaaaaguuauaacaagaguuguaauuuaaaucugcugcaggucuucagauuucgaguacaauaugccuuuacauaacaccuccacuuacucaucuguucauucuucaguaacauaacccccaacaaaauuuuguugggaaaaaaugcagggaaaaugcacaguucaacgaugaagagauuuuuuuaagguuuuucauucccaaauaaaagucuucaguuuaccaagaaucccauuucugauuuaaucauucaaccuucccuuggcuggcucaguuacucacccaaauauauuagaaggcaggcauccugccugccaccucaaaugucaacauugcccagaugcgaguggcaggucccgucaggagauacuguaacccuccucggaguccaauuccugcacggacacuuucgucaagacuaaacuccuaucugaaaacgcucccacgucaaaauaguuuuacucacccacuugcuucacucuugccaguagcaagucugcaacucaugcauuuggcaaagggauuuauuauagagaaacccggacucugcaucaaaugaugacauuaccacuuucacauauuucuauugaaccagauacaaaacuaggaaacugccagaccaucuu

SEQ ID NO: 16104 - RNA, 1612 nt, Homo sapiens
cacagcagcggaggaaaggccacgugaauaagcugccuugcaggaaggaaaagccuuaggggagaaaaugauuuuagaaaaaguacuggagaacagacgacgcggaugcucauuuccuaacaaaacgaaacaaagcaaagaaagucagucugcaggacuuguucggaaggagggucgcugacccaaggaaacaagaguugccggcauccagcaggaagggugcucagacuaggagacuggaagggaaucccgagggcggaacccacaagggaaugaagagccugugggguaaggauauguuaaggcgaguggaggagcguacuagguauaaaacaagcaaaaaaaagggguggggcuggacagggcagcgcccugagcuaaugucacucaaagccgggggggcguccaacgaaaggaaccagaccagcagccugggggaaggguaaucugcuuccuuagcagcugcaggcugcagcagccaagaccaccccguuuucccugcccugagccccacaaaguccccacggcgugggaagggaguaaggcagagccccagagcccagugcccggagucggcuuuaccuucgcgggaggcuggagaggcuccagcccuagcuccucccgccgccggcucagcuuccagagugggaugaggcgcccuccggccuccucacccucaccacuuccccuuucccccgccggggcccugcagcuccgcugccgcggguuccuggugccgccgcggcgcugccuccccgcccccuccgccuccucccucugccucucagaguuucacucuggaggccgccaucuucgcucaggcuuugagcgagcgcgcucuaauacgccugcgucgccaccgcccaggcugucacgagacccagucagcugauuucaacucuuccgucuucugccccgcccuccccguccuccccgucccgaucguucuuucccugaaauucugcuuuccuccggccagcccccagcagcuacacaugcgcagaguaacgacaccggccgugggauuuggauuccacgcagcgcgucagggggcuggcgccucggugggugcugaaaaggacacgccccugggcgcgcgcgggugcccaugaccacgccccuccggcgggugcccaugaccacgccccuccggcgugugccuuagggccgcgccccuccgcuuauguccugcggagaguagggucgcaacccgguacuuaagcuuuaaguccgaggaaaucuuguuuuaaaucaccucuuuuuagcucuugccgucaagugccauggagcaucugcgaggcagucugaagccucagccuaucuccugguuuggcuggauugggagccagcagguucauuuacuauugagacguccugaacgacagcagagcaggguuuaaguuauggaugcucuggaaggucucagagaccaaauucucagagacgccuaaggcauuugcaggugggaaugcuggaaagauaguucugguagccccauuuauuguguccggaucaaguguuuagaaguuuacuuaaagcugcuuaaucuucaacucucugagauacgaaucauccucguuuugcagauaaguugaggcccagccucagagua

SEQ ID NO: 16105 - RNA, 1612 nt, Homo sapiens
uacucugaggcugggccucaacuuaucugcaaaacgaggaugauucguaucucagagaguugaagauuaagcagcuuuaaguaaacuucuaaacacuugauccggacacaauaaauggggcuaccagaacuaucuuuccagcauucccaccugcaaaugccuuaggcgucucugagaauuuggucucugagaccuuccagagcauccauaacuuaaacccugcucugcugucguucaggacgucucaauaguaaaugaaccugcuggcucccaauccagccaaaccaggagauaggcugaggcuucagacugccucgcagaugcuccauggcacuugacggcaagagcuaaaaagaggugauuuaaaacaagauuuccucggacuuaaagcuuaaguaccggguugcgacccuacucuccgcaggacauaagcggaggggcgcggcccuaaggcacacgccggaggggcguggucaugggcacccgccggaggggcguggucaugggcacccgcgcgcgcccaggggcguguccuuuucagcacccaccgaggcgccagcccccugacgcgcugcguggaauccaaaucccacggccggugucguuacucugcgcauguguagcugcugggggcuggccggaggaaagcagaauuucagggaaagaacgaucgggacggggaggacggggagggcggggcagaagacggaagaguugaaaucagcugacugggucucgugacagccugggcgguggcgacgcaggcguauuagagcgcgcucgcucaaagccugagcgaagauggcggccuccagagugaaacucugagaggcagagggaggaggcggagggggcggggaggcagcgccgcggcggcaccaggaacccgcggcagcggagcugcagggccccggcgggggaaaggggaaguggugagggugaggaggccggagggcgccucaucccacucuggaagcugagccggcggcgggaggagcuagggcuggagccucuccagccucccgcgaagguaaagccgacuccgggcacugggcucuggggcucugccuuacucccuucccacgccguggggacuuuguggggcucagggcagggaaaacgggguggucuuggcugcugcagccugcagcugcuaaggaagcagauuacccuucccccaggcugcuggucugguuccuuucguuggacgcccccccggcuuugagugacauuagcucagggcgcugcccuguccagccccaccccuuuuuuuugcuuguuuuauaccuaguacgcuccuccacucgccuuaacauauccuuaccccacaggcucuucauucccuuguggguuccgcccucgggauucccuuccagucuccuagucugagcacccuuccugcuggaugccggcaacucuuguuuccuugggucagcgacccuccuuccgaacaaguccugcagacugacuuucuuugcuuuguuucguuuuguuaggaaaugagcauccgcgucgucuguucuccaguacuuuuucuaaaaucauuuucuccccuaaggcuuuuccuuccugcaaggcagcuuauucacguggccuuuccuccgcugcugug

SEQ ID NO: 16106 - RNA, 24941 nt, Homo sapiens
cagcuucugccugucgccccaaaauggcggacacaaugagccggcgacgcgccgguuguccgugagguggcugugaggacgaacggucggcgaggcuccacaguccaggcagaagacccucgaccaagcaggaagaagaggaggaggcggcccaacuguuggccgacuucccgcuagccgccggcgcggcgcccgccccgccuggguuggccccucggcagcccgcccgcucgccgccgggccccgccccggcccugcgccgccgcugccuuccccagccgccgccaugaagcugaccgacagcguguugcggagcuuccgcgucgcuaagguguuccgcgaaaacucggacaagauuaacugcuucgauuucagccccaacggcgagacggucaucucgaguagcgacgacgacuccaucgugcucuaugacugccaggagggcaagugagugcggcggaggcccugggcccgagucucagugccucccuccgguggcccagcacaggucccucggccugcccuccgucccgacuucagcccccagccuauuuugcacgcguuccugccagggccgccuccaccccgcagccguccaggagaccuuuuauuuuuuucuucuuaaaaaaaaaagauaacgauagucauaauuuuauaauauuauuuguaugucuucggucuccuuugagcgcuaugcaucacuugccaaaccccaccuugaccuugaccuuuaaacgcccgguccgcccacccugggcccaccagguagcguuuucagcuccucaggcugucaaaggugcuggucugcuccggccucgacgcaggacugcaggggcugcuuuucugccuccuucggcagcgucagcucucucuugugcucucuccacugugaccucgauuccgcccuggcacuccgcccauccccugccccucagcuucccgcggccuuucugccgucagaccgcguggguugcacuucuuagcugucaggauuuauuuguugugccccuuugagcccccuugcuuuuucuuccugcuccuagccuuucucuuacucauucagacuuggugcccacguucauaagugaacuuuucagcaacaucuaaaacuuccuuuuugccacacacaaacgaacuuggucgucccauccugaccugaaugugagcuuccguuaaaacaaagcaagcaucguagaacaauuucagguuuccuuucauacuuuuuuuuuucuauuacacuuuuugguccacuuugaauuccaauucugaucaugaaacuuuuauguugccacaagucaucuggagacccaccauaccugcaucuuuucgcaaaaucuaagcacagcacuuugccuuuuucccuggggguccuugucagcccuccucaccgcacgccuguggacuugcagcuccuuggagccaaaaacuaguuuagauuaaauucguuuuacccuuagccaccuuccccaagaaggcuugcugauguuugguuuaauucgguggacccugguuuuuucagacuugauuuugucaccuaguaacagauauuauuauuauuauuauuauuauuauuauuauuauuugagaucuuggguuuuucuccaccuucuccagcuguuccuuuuuccuuuuuuuuuuuuuagacugguguccuucuuuuggaacauaucucuucauuugugaauuugauuaucugaaguaaugcuaguuuggacugagcuauaaugguauccccccaguuuuuuuccccacuggggcugugagaaaguauuauguaaccggcucuggaucugccugcaguuuguggcagaguggucugcagugguggucuuaaggaagagggaauuguuagcuggacaaauaguuauuugagucaguguuacucauugaguagauggauuucuguccuggucuggucacuugaaucaguuuagaagacgaaguaacauuuaaaggugugguaguagggucagcauugugggguccuggaggaguaauuugaagcuggcuugcaugaaauguauagugcuuaugcacagauuagaaccucuucccagaaccugaggguggagauguauauccucauuuaaaggaaaugaagguuguuauagcauuucuuugcaguuuguccccaaauuuggcguaauuuugauuugggaaggaugaccuugacaugaaguccugucuuucuuuuuuuuguuuuuuuuuuucgggugggggacggagucucucuccgucgcccaggcuggaguguaguggcgcgaucuuggcucacugcaaccucugccucccggguucaagcgauucuccugccucacccucacaaauagcugggauuacaggcgccugccaccauacccuaacuuuuguauuuuuaguagagaugggguuucaccauguugaccagacuggucuugaacuccugaccucaagugauccacccgccuuggccuuccaaagugcuaggauuauaggcaugagcugcugugccuggccaaauccugucuuguuaaaaguaaaaugcuaguuuugugacauaaggcaguuuauuuacucguagcauuuuuacauaauuagaaacuaacaaaguuacaguguuucaaagaacucccauaugauucaauaacugguuacauuuucugcauuugcuucaugacuguagguaaauauuuauauguacugugugccuccccccaccuuuagaguuggagguaucaagccccuuuaucccuaaacacuucaacauggauuuucuuucuuuuuugagauggagucucgcucagucgcccaggcuggagugcaguggcgugaucuuggcucacugcaaccuccggcuccuggguucaagcgauucuccugccucagccuccugaguagcugggauuacaggugcaugccaccaugccuggcuaauuuuuguaucuuuaguagaggcaggguuucaccauguuggucaggcuggucuugaacuccugaucucgugaucuacccgccucagccucccaaagugcugggauuccaggcaugagccacugcgcccggcucaacguggauuuucuaagcacaaagacauucuuauguaaccagagcacaguuauccaaauuaggaaauuuaguacugauacaauacuacagggcaugcucuugaguuuucucugaucaauuaauuguaaccuuguuucauuaucuguggugaaggaguggccugguaguuaggagggaacuggguacuaguuuggccugugacuagguaugugacauuggucagauuacuucuuuggguauuagacaaccucuuuaguuuccauucuaggcaauaauaugaugaaaaauuuugucacuaguauaggucaaaccgaccucagaagaaaagaaguauuuccuugggaaggcaugguauuguaucuuuuauuuauuuauuuuuuugauagggacuuucgcucuuguugcccaggcuggagugcaguggcuccaucucggcucacugcaaccuccgccucccgaguucaagcgauucuccugccucagccuccugaguagcugggauuacaggcaugcgccaccacaccuggcuaauuuuguauuuuuaguagaugcgggauuucuccauguuggucaggcuggucucgaauucccgaccucaggugauccgccgccucggccucccaaagugcugggauugcaggcaugagccacugcgcccggccuuucuuuuuguuuguuuguuuguuuuguuuuguuuuguuuuugagacugccucacucuuuccuaggcuggagugcaguggcguaaucuuggcucacugcugcaaccucgcugcuggauucaagcgauucucgugccucagccucccgaguagcugggauuacaggcacccaucagugugccugcuaauuuuuguauuuuuaguagaaaugggguuucacaauguuggccauguuggucucaacaucuuaccucaagugaucugcccaccucggucuccucggccucccagagugcugggauuacauaugugagccuccgcacccggcccuguuuuuuuguuuuguuuuguuuuguuuuuuuguuuguuuguuguuaagacaaaggucuuccccuguugcucaggcuggagugcaauagcaugcuuauaguucacuaaagccuucaucuucugggcucaagugaucuucccaccucaaucuccaaaguaguugggccuacaagcacucgccaacuuacuuggcuauuuuuauuuuuaguggagacaaguucucaccagguugcccaggcuggucucaaacuccugaacucaagcgauccucucaccuaggccucccaaagugcugggauuacagguguuagcuacugugaccggccgaaggcauaguaucuuuauuagaugacccuaguguuagaauuugggaguuugaaaauggcuaaagcaagauuuugugugcuuaguauuuuccaguuuacuggucauuuaaauuuucuuuacaauggaguucgcccauugagugauauuucaauuuggaagaguauaaaggauauuguuugugguaggugaagcaaauuacucaaagugaaagguuaauauuauuuuccuuguugaugcuugaucaccagaauuauaguuugaggaaggaagcuuaccaaaauauuugaaaaauguugugcauguauuuuguaagacccacauggaugcaguacaguauaaucuugcuuucaaguuaggaaaugaguccaggugugguggcucacacuuguaaucccagcacuuugggaggccgaggcggguggaucgccugggucaggaguucaaaaccagccuggacaauguggugaaaccuugucuauacagaaaaauacaaaaauuagcugagccugguggcaggggccuguaaucccagcuacucaggaggcugaggcagggagaauugcuugaaccggggacgcagagguugcagugagccgagaucgugccucugcacuccagccaggguaacagagcgagaaugucucaaaaacauaaaaauaauaaaaaucaaauugggaaaugaaaugaggcaguagauuucuguuaucaggaaaaaaaaucucagguuaguguuuuugauaaauuugagacaaauagaccagaucuaaguggaaccagaaauuuuccuuacacuauucucuuucaacuugucaaguuagaguuggcucuucauguucugucuuuuuuuuuuuuuaagacggaguuucgcucuuguugcccaggucggaguacaauggcgcgaucuuggcucaaugcaaccuccaugucccggguuccagugauucuccuaccucagccucccaaguaacugggauuacaggugcccaccaccacaccuggcuaauuuuuuuaauuuuuaguagagaugggauuucacccuguuagccaggcuggucucagacuccugaccucaggugauccacccaccuuggcuucccaaagccugagauuacaggcgugagccacugcgcccggccaguuucugucuuugcuauuguagaugggaugaaauaacugauauaaacuucuuccacugguagcagagucaacuauguagagaguaaguauacagccacacacugagacugccucacugguuaccacacaguaaccccacaucagaaccccagacagugcacuuggcaaaguagccuuugcugaucuuuuuaggagugaaguguuauuucaguaaagguaagaauguggaaaauccaguguauuuguagugagaagucuguuggaaauggguuucauguagggaagcccuuggccucacuuuaacaaaaauugaaagugcaaauaacugacuucuuaaagacugcuugagucgugauuguuuaguaccuagauucugagaggauuuuacauugagaggauuagcuuuccuuuucauaaauuggaacucuugguuaacauuaguacaggauuuaugaaaucuuucuaaagaacuaaauguaggacauuauguuaaaggcuuuccuguuuuuucaguugaucguauuggagaguuauuuuagcauuugaaucuagauuuacauagauauuuaagucucaaauuuuuauuuuucuuuuuuuuuuuuuugagauggagucuugcucuguugcccaggcuagagugcaguggcgcgaucucagcucacuacaaucucugccucccaggcuuaagugauucucgugccucagccuccugaguagcugggacuacaggcgugggccaccacacccagcuaauuuuuguaucuuuaguagagauagcguuucgccauguuggccaggcuggucucaaacuccugaccucaggcaauccacccuccucggccucccaaagugcugagauuacaggcgugagccaccacgcccagccuaaaauuuuucuaacuuaaccaguauguguuagaguuuuugguuaaagguucuguugagaccaguuuuagccuugcucuucaagguucuguaaagggagacauuuaaggaacuucaacaaauggagauugauaaccucuagcuuggaaaugugugauuuuuugucuguuauugagguggagucucacucugucgcagaggcuguauugcaguggcacgaucuuggcuuacugcaaccucugccuccuggguucaaggaauucuccugccucagccucuugaguagcuggaauuacaagugugugccaccacacccggcuaauuuuuguauuuuuaguagagacgggguuucaccauguugggcugcucucgaacuucugacuacaggugauuugccuggcucggccucccaaagugcugugaugacugaugugagccaccaccuuguggccagaaaugugugauuuugcuuuaaaguaaaagcaaaggaacuauuuaacugguuuugcuagagaaaguuaggcuugccuucuaaaaggcucagcaagcgcuuuugaccuguaggauaggaaggauggaugucuucugcaagagcagguuacauuagcaaaggcaagcaguuuugcaucugguuucaguuuugaggaaucacugccgucuugaaaaaaaaaaacacagagcuucuuucuaaauggaugucuugagaagaaaaguuuggccucuuggguuugacauauucucauaucccucuuuguuguaaguuaagacuuguuuugugugccuuucuucccaaguagauguacagccaugcaucacuuagauggggaucaucacgugaguuuuuguugcagcagcaucauagaguguacuuacacaaaccugacgguauaaucugcacacaccuaggcuguuugguauggcccauugcuccuaggcuacaaaccuguacagcauuuuacaguacugaauacuguaggcaauuauaauauagcguuaaguguuuguguaucuaaacauagaaaaggugccguaaaacaguuuaagggauuuaaaaaaugaaacaucgguuguagagggcagcucuauuauaaucuuaugagaccauuacccuaugugcugucuguuguugauaaaaaugucaucacauggcacaugauuguauuuuuucucaaagcuuuugaacauuguaguaaagacugaauugaauccccagauuuacuuuuacuucccaccuaaccuugccacuagguguucuaagguggaaagcuucuucagauggcuguugcuugagcguuguuuuuucccuuuuggaagaaguuguuucuuuccaguguuagaacuuaccaaaaauccucaccuuugccacaucauucaagugcuucucuuuauguggagaucccagauuuugaugauggagaauguucaugauuuucugucucuauuuucuuaucagaccaaagagaacccuguacaguaagaaauaugguguggaccucaucagauacacucaugcagcaaacacaguuguuuacagcucuaacaaaauagacgguaagcaagccuuuuuaggaaguuaaggucaugguuuccuuuguuaaauaguucauggaaucuuugugacuacuucugcuuugugacuacuuuaguuuaaguauuuucauauaauguuaguaauguuaauugcauuguuuugacugaaggaaugcuggaagcaagccauuggcacuuuugaaggacuugggacugaguaugaaaagucuucaauucagaguggggaguggaaaaaggaaacaacuaauuguguuuaugauuuguacuuccugacacuuaaaagaacgcuuuuaaagccgggcguaggggcucgcgccuauaaucccaaccuuugggaggcugaggugggcggaucacugaggucaggaguucaagaccagccuggccgauauggugaaaccuugucucuacuaaaaauacagaaguuagcugggcacaguggugcacgccuauaaucccagcuacacaggaggcugaggcaggagaaucucuugaacccgggaggcagagguuguggugagccaagaucacgccauugcacuccagccugggcgacagagugagacuccaucuccaaaaagaacacuuuuagaacaaauaaaaggaaagaacacuugauacacagcaagugauaaacaacaggacuuuuucuuuuaaaaugauagagauuugagaaaaguuucacaaaugcuugaacuaugauaguuuaagggaaguuagaacaguuuugguguuuucccaaccuuagucacuucugauuccaggaacguuuuuugaucuaaagaguagaguuacuuuuagaaauugaacuugugaguuucuuucuauaauaaacaaucucuguuuuugccugcaugucucgagauaaauccuaaguuaacagauugucuugguaacugaacuguaacacuuauuuucauguuagaauucuuuaauuuuuuaauuuuguuuauuuucuuuuguuugucuguuuuuauuuuuugagacagagucucacucuguugccuaggcuggagugcaguggcgcgaucucagcucgcugcaaccuccgccucccggguucaaguaauucuccugccucagccucccagguagcugggacuacaggugcaugccaccaugccuggcuaauuuuuuguauuuuuaguagagacaggguuucaccauguuagccaggaugggucuugaucuccugaccuuguaagccaccgugcccggccuauucuuuauucuuuugagacagaguccugcucuuguugcccaggcuggagugcaauggugcaaucucggcucacugcaaucucagccuccuggguucaagcgaugcucuugccucagccucccaaguagcugguauuacaggugcccaccaacacgcccggcuaauuuuuguauuuuuaguagaguugggacuucaccauguuagucaggcuggucucgaacuccugaccucaagugaucugccugccucauccucccaaagugcugggauuacaggugugaaccaccacgcccggccaggauucuguuuuuaaacuuauuucaguggauuauugaugaucaucucacauuuugcaguaagguuuuuuuuaggccgguggcuacauaguggcucaugccuguaaucccagcacuuagggaggccuaggagaguggaucacuugagcacagaaguucgagauuagccugggcaacuugggaaaaccccgucucuacaaaaaauacaaaaauuagccaggugugaugggacgcgccuguagucccagccacuuguaaggcugaggugggaggauugcuugagcccuggaggucuagggugaucacaccacugcacuccaaccugggugacagagcgaggcuccaucucaaaaaaacaaaaaagauuuuucuaaugucauuccacaaggauagcuuauacugcuauuuuggcugugccuaucucagagcagaaugggcggaaguccuuuuuuccauuuuuuuuuuuuuuuaaugagacucuucugccuguauugauuuuuaguuaaguaugucauuucuacuuuucaugccuguauuucagaagugguuuucuaaggaagcaguguaguuaaugauuuuggaaaagaauguaaaaccuuaggauccugaggaaacaugucuaugugaucauccgaaugacugguuuauuucuucuguugggauguuuuucugagugauuaaaugaggauucuccaaauguggugcaagaugaggcaaauguguggcacuuguagcuuugcugccaagccucugcugugaggauguucccuuuccugucucaagugcauccugaagaguuccuccagcgcuccguuuccuuuugccugauuccaggcugagguaguaguuuguacaguuugagggucuaugauaccacccgguacaggagauaacuguacaggccacugccuugccaggaacagcgcgccagcugccaaguggggcugagaggauggcgucacccugcucaucucugggaaaccagguaauggggaggaagucuuuuucuucuuagggcaggugagucauuguuagcaguagaauaacuagaaauacuucguaguugucauucaagaaguuugaagauguuuucaaggaaaauuguguaguguucaaguuauggaauauacaaauaucccuauuccccuauucccccucccaaguuaaaugcccucuuauuagaaagcaccccugugaaccccugggaugacucgaugcuuucaaccccuuuauuccuauguucuguuugccuucagaauguucuuucuaugguuuucuuucugcauuuugguaccauuuucccuuagcuguuucucaacaauuuuuccuuauuccuagucuuuuuaaggggauaauacuuuucuauuuugcaguuuuauucuuuauggcacuucauuucucuaccgccaccauguuuuuuguuuguuuacucuuucagauagaaucauuugguuaagagugucuuauuuuuccacaagcacaaaucucugauuguuccuuucuuuaauauugucaaaaucucacugcuauuacucauugguauaagaauuugauuuuuuuaaugucuuaagaucuuuuuaacccagaucuugacaucacuucucugacguuuuguuuauuuucauuguaauuuguguguccaauugaagaauguucaaaugaguugagggugggucaacauacugauggagaacucuagacaaaaauugcugccaggguucaaccugaucuucaguuuaacugccauggcugcucaccucuuuaagucuguuagcucaacagccacauauuuuucuuuaagguuugccauucuguggacacuagaccaguaucuaaaauuauuaugugugcuuuacuuguuuuuguuuuuugaccaggguauauuugcagggugggaguugcauuguaauuaugaagaaaccaaauugguaauaaaaggucauuucaaacauugcuuucuaugcugucaacuuaagaacucugcuuuugaguuaggugaaaucuacauacccacucuucagcugcagaguagaauuauucaccauuauuuauucaugccuugcuugggauauagaauacaauggauuauuugaccuugucuuuuuaagaugaaaauguaaaguaaauuucuuuuaaauaguaugauaucaucauaccuuguuugucuuuuuacagauacuauucguuacuuguccuugcaugacaacaaauacaucagauacuuuccuggacauagcaaaagguaagacccacguauuauagaagcagauaguucuuuuaucccugagguuacccagagaauagaaggcuagagagagcuuauuagugaacugaagcuacuuccucacuacugcuuggcauucuucaucuucucuuaaauagucaacucuugauuuacugagguuauagaggugcagagguagguguucagagauaccucaguuaaaauauaacuaggcccagugcaguggcucacaccuguaaucccagcacuuugggaggccgcggcgggcggaucacuugaggccgggaguuugaaaccagccaggccaacgugucaaaaccccaucucuacuaaaaauacaaaaauuagccagguauggugguggacaccugcaaucccagcuacucgggaggcugaggcaggagaaucgcuugaacccaggaggcagagguugcaaugagccgagaucgcgccacugcacuccagcuugggcgacagagugagacuccgucucaaagauauauauguauauauauuuuuucuaguuauagguauaucuauuucuaguuagauauauauauuucuaguuuuauauauacauauaaaacuagaaaaaauguggauuaaagauauucagugaaaacuuauguaguaaaaauuagauuuggcauuuaggaauaccaaaucucacauaucccuuaauaaaggacuguuuguguuuaugaggccuuccaauauauguggcccccauuucagugggccccuauguaaaaauguuccauuuaaagaucuuaaugagaaugcaaaagaaaguccuuuuuuuaaaaucaagaaguuuaucuccuuuuucuguauuguaaugcagguugcuucucucuguucuucaccccaaugccccuaguuacuuuuuucucuaauuuuucaacuuuucuuugaauguuaaacacguuuuccccuggauaauauuuuaaucacuugggguauuuuuuccugcauccauuugcaaauguacaguaacccaggaugguuucgauugguauggagcccugacaggagauggccugagagccuccuguuagaaauugcacuuccaggccaggcgugguggcuuaaugccuguaaucccagcucuuuggaaggcugaggaggacagauugcuugagugcaggaguucaaaaccaggcuaggcaacauggugaaacccugucucuacaaaaaauacaaaaauuagccaggagugguggugugcgccuguaauuccuacuacuucggaggcucaggcacgagaauugcuugaacccgcgagacagaggcugcauugagccaagguggcgccacugcacuccauccagccugggugacagagcaagacccugucucaaaaaaaaaaaaaaaaaaaaaaaguugcacuuccaguugggcaggccauuuguguugcugaaauaaaggugaaauaagguggcaaccagugguaacugguuucagacaaaggauggcucaugauaaguagauguuuugcuuguuuuuauucaaauuaauguucacaaauguacuauuuguaauuaagaguugaugcaguuguuugacgugcuuuccagucuucccaauuauucaaccucuugaccuccugauucuuuuuuuuuuuuuuuuuuuuuuuuuuuuuuuuuuuugagacagagucucgcucugucgcccaggcuggagugcaguggugcaauguuggcucacugcaggcuccgccucuuggguucacgccauucuccugccucagccuccugaguagcugggaccacaggcacccgccaccaagccccgcuaguuuuuuguauuuuuaguagagaugggguuuuaccguguuacccaggauggucccugauccgcccgccucagccucccaaagugcugggauuacagacgugagccaccgcacccggcuggccgaccuccugauucuugauagaugacuuugucccuccuuuuaugagaaaaucaaggcuauacaaaaugaguuauuucagcuggguguggugguuaaggccuguuaucagcacuuugggaggcugaggugagaggaucgcuugagucugggagguugaggcugcagugagccaugauugugccacuguacuccagccugggugacaaagcaagaccgugucuccaaaaaaaagaguucuuuuaaacaucuaucccuuccaccuaaauucugucuuccuuggaauccuuuccuugagaaagcuguugucuuucuuucacaaaacagaccuuccucuuucugcuugcuuccaucuccuuaauuggccuuuccuuuguugccuacaaauuuacuuggucuuucuuaucuuaaaucuacuuauugacccuaucacccacuccuuuucacuaucaaacuugaaagaagaaucuguacauucccaucuccaccuccucacacauguucacuguugaaaucauuuuugcacuagucccagaaucgucuauggggcuuuauccaaaccuuuauccuucauucccugcugccucuaguuaaaaagccacugguuugggcuuuucuuggugcuuaaccucucaguaaaacuuacuuucccguggcaggugacuuuucccaugucgguucuguucuuguaguuuucagccucuguuuugacucuaaaauaaacaaauauuuuauccgcuuucuuaucuccaucgcugauuucauuuaccuccauucagguggcuucccaaaucaguauuuuuagcucaugucuauuaucaguuucagacccgccuuccaccuacagguuuuguuuguuuuuuuguuuuuugagauggaggcucaccgggucacccaggcuggagugcaauggcaugaucuuggcucacugcaaccuccaccuccugaguucaaacgauucuccugccucagccucccgaauagcugggauuacaggcacgcaccaucaugcccggcuaauuuuuguguuuuuauagagacaggguuucaccauguuggccaggccgcugucaaacuccugaccucaggugauccauccgccucagccucccaaagugcugggauuacaggcaugagccacugcacccagcaccaccuacauguuuuauacacaucuuuguagcugucucuucuguccaauacucuuucuaauacucagguccaguacucuguccaucauuguuaccuuuuuugggccagcuucucucugucuuccucauauuuauucaucucugucucuuccaauucuggcucaaagcaucuguuguuaguucacucuuuuuccccugccaucauauucagugaguuguuaaacuauuuaguucucccuagguuuaaccucaugugucacuuuccucuguguucucuccuuugcuucugcccuggcucaugcccugugagguaaauuauuguuagcuccuaauuaaucuucccaucucuuaccauccuguuucagcuuccuggauugcaguuugauugcuucacaaucucucuuaaugguucucuauauuuucauugcuccuuccccuuguagucagguucugucccuucuggcucugacccauuuucucagcauuuucucccaccauucccauuaaggugaacucugggcuacuucuuugaaauccuuucuaccucagauguuguaucuuuccagaagccuucucugguccucuuggagucauguggacuggacaguuaaaauuccuuacggucggggucuuacuucuccauguguucccuguacuucucagcauagagucuugugcugagcucuugggcugaaugccauggcauaaaauuacauguccacaacguguucugcucauucugauuuuuguuuuuugagacggugccuugcucuguuucccaggcuggaaugcaguggugugaucuuggcucacugcagccuccaucucugggguucaagcgauucuuccgccucagccucuugaguagcugggauuacagguguacgccaccaggccuggcuaauuuuuguauuuuuauuaguggugggauuucaccauguuggccaagcuggucucaaacuccugaccucaggugaucgcccaccugggccucccaaagugcugggauuacaggcaugagccaccgcaccuggccugcucauuguguuuuauuaccuccucagcauucucaggaaauuuuggcuuuuaacaauaccuuuuaaaauuuuaacuugaggagcuggugcagauguuaguugaguuacauuggaagaaaauguuuuucagugagugucucuugaugguauaaccacaaaagggaaccaaaaaaggaauacaguugcuguuagcauaggcuugugguucucuagguguggugcccaaaacagcagccucacccaucaccugggggcuaguuagaaacucagauucacagaccccaagucaggccuacuggauuagaggcucugggagcagauccuagcagucuguuuuaacccacccuccaggugaugcugaugccacuuagguuugagaauaucuguguaguccucacacaucuugauaaggaaucaugcuuuuuuguguuuuuuuaauugagauacagucuacauacuguaaaugauuccuuuaaaaauguacaguucagugguuuuuacuauauuugcaaaguuggacaacuaucaccaucaucuaacuucagaacauuuuuaucacuccaaagagaaacucuguacccauuaguaaucacucccucagccccuaccaacugcugaucuacuucugucuuuauagauuugccuauucuagacauuuuguguaaauggaucaguucauaucugaucuuuugugccuggcuucuuuuacuuagcaugguguucccaagguuccuccauguugucacaugaggcaguacuuuauuacuuuuuauugccaaauaauguuccaguguauagauacagcacauuuuguuuguccauccauuaguuaauggaccauuuggguuauuucuacuuuuuggcuguuaugaauagugcagaucugaacauauguguacauuuuuguguggacauauauuuucaguuaucuuggguaaauaccuaggaguggaguuucugggucacgugguaacuuuuuuuggaaaaacuuuuccaaagcaacuguaccauuuuuacauuuccauuagcaauguaugaggguuccaauuucucugcauccucaccaacacuuguuaucucucuuauuauagcuaugcuagaggguguggaguaguauuucauugugguuuugauuugcauuggaaucauauauuuuuauuuuguagcuuuaaauuuuuuuuuuuauacuaguugccuuuguuuguuccagauaugguugugguauguguguuuuauuguguuucuuaaaauggcaauuuugggagaacagguauauauauguauagauaggcagagugguuuagaauucacauccaauuuuugcuaauauuucgcaucaacuccuauuuaucucgauguauugcagggugguggccuuguccaugucaccuguggaugacacuuucauuucugggucucuugauaagaccauucgacucugggaucuccggucuccuaacugccagguaaugguaccucacaguuauacuuuuugagcauuuucuuugguaggcacuguaaugaacucuaccucucaaagaagggagaaaacagugguuccauucugggaucacagggucuuuuuaaacuuuggagaaaaucuguuuuuuuaguugguagcugcuaagcacauacccuaaucuagugcagauugcauuguacucuguggcuuaauuguuguggguuuuuuguuguuuuguuuuguuuuuguuuuuguuuugagacaggguuucgcucuuguugcccaggcuggagugcaauggugcaaucucagcucaccgcaaccuccaccuccaggguucaagcgauucuucugccucagccucccaaguagcugggauuacagucaugcaccaccaugucuggcuaauuuuguauuuuuaguagagacgggguuucuccauguuggucaggcuagucuccugaccucaggugauccuccuaccuuggccucccaaaguucugggauuauaggcgugagccacugcgcccagcuggcuuaauguuuuuaaaaguguuccuagagcuuuuagcuucaagggauuuauuuuuauuugaauucugugucuguaauauugugcaguuagaguugaucagaaauuguugucuggagaccuguuuuuuaaaagcuucauuuuaguuuuauguuuuuuuuguguguguucuguagguaggcugauauuuguuuguaugccuuucuuaguuuuaauugggaaaaguaaauuauauagugguaagguccuggauucauuuuuuuuuccccauuguaccagcagucuuugguuauuccacguaugguuguggcauguguguuuuaguguauuucuuauuucuuuucucuuagggccucaugcaucugcaggggaagccaguuuguucuuuugauccagaaggguuaauuuucgcugcaggugucaacucugaaauggucaagcuuuaugaccuucguucuuuugauaagguaaaucuuugaaucuuugagaucuuugagcuguuuuuuguuuuguuuuguuuuugagacagaguuuugcucuuauugcccaggcuggagugcagugguguaaucucagcucacugcaaccucugccucccagguucaagugauucuccugccucagccucccaaguagcugggauuacacguguccgccaccacgccuggcuaauuuuuuguauuuaguagagauggguuucaccauguuggucaggcuggucucaaacuccucaccucuggugauccacccaccucggccucccaaagugcugggauuacaggcgugagccaccgcgcccggcccuguaagagccuuuucuacaaaaggaaaaaugugguagauauuagagaguggcagagaaguagcucauucucugcuuuccuuagucaaaaaguaaucuaaaggaauaggaugggaauuggcucuagcagaagaaauuauuaauaugccuggggcuacuguuuuuuaucuuuugcaggggccauuugcuaccuuuaagaugcaguaugaucgaacuugugaguggacaggacuuaaauucagcaaugauggcaagcucauccucauuuccaccaacggcagcuucauucgucugauugaugcauucaaaggaguggugaugcacacauuuggggugagcugacagccuucaagcauggcuguuuccaugcucauacuuccuaugcuaagaauuauguuagcugguugguggagaccaacaguuacucuugacuuacucaugaaggcaugcacuuguauuuucuuccugcucaugaacuuaccucucuuggauuucguagauguucauuucucaccaagugacccaaguuugguauuuagauauaaaauaauuuccuaacaauaaaguuuucuugcccccuugaguaugccuugaauacagaguugagggugggaguggauugucaacgauggcaaccacauuuggaagcuuggugguguaguacaugacaaggaaaggguuucauggaaaggaaggugaugcaugugcugagucaguguuuguaggcagcuguuuuuauuaauggcucuguaagaacaaaagaacugcucuguuuuguuuuaggguuaugccaacagcaaagcugucacacuggaggcuucauuuacuccagacucucaguuuauuaugauuggugaguuuccuuuuauccccuguggggguuauuucucugguacuaugcauuucuuuguuuaaauuauuaacugagacauuauuaucuauuugauagauguucuuagauuucuguauagcacauuaugccaaggacauagugucuuuuaacugcccugacuggaccaaaauuugaguuaaacuccacaagcacuaccuuauuaguaaugcuaauguccugguguaacccuacauucagucaucuuaguggcugccuguugguaggguaaugguauucggccccuuuuuuagaugagaaaacugaaguuagaacggaagugacaugccugugaacaaauagcuagggucaagauaaauuuccaaaguguccuuccuucacugccucuccucccucucaauuuugccugagggauggguccuaaagcuuggcguauccucagaucucaauccaugucucauuuccaguugucuuuguauugcgccuugagcuguuacauuuuccgugaauauccucuuuagguucagaggauggcaagauccaugucuggaauggagagagcgguauaaaaguagcuguguuggaugguaaacacacaggcccgauuaccuguuugcaauucaaccccaaguucaugacuuuugccagugcguguuccaacaugguaugugaacaguaagagguaucugcuacucagggacccuucccaguugggguggugggugccucaacaagcacagcaagcuguguucuacauagguacauuacaagcauccaaguacauguuucucaacuggugguuucccuauuucaucuccuauuauuugaucucuggcugggcuggucuugccuuucauuuuuauucuuccuagaggugaucaggaaucaucuuugaguuccaaggagaucauaggccaguuuuugcucuggacccuaauuuuagguccaaacuaccugggcuaugcuuggcaauuuuuuugcuccuuaaaauacucugaaccggccuuuugugguuucaguuuuccauuccuguugguuuacgccaaauucccagaaauuucuacaguuggucauaacucaccacuuagaauuaacuccaggcccuuaucucuuccuagauaauacuaacagaacaaaggaucagugagucucagcuccaguuuucccuugugaucuccuaaaccugccuggguauucggggaugagacauuucauuacuagccuacccggagcacauugccaccuugcuuuuuuuuuuuaaccaagaaaaaaauguuagaaaaaauacagcaaaaccauccaguuccuuacuuuuuacagcccaggaaggugggggccuguuggagguaaccugguggauuagcaaugaggacagguuacuuauucacccaccucccaggcagcacuccuuuuuuucccuuccuuuaaaaaaaagggggcggggggucugcuuugguggaagguggacagugauuauuggagaaaaacagaaccauuuuacuuucacauagaggaaagaguguuucugucuccuuagagcaucgggguugguugguuaggagagagggcuaccagagccacugggguugggcacauuuuugcuguggggugggaugugaagaaccguuggcagugaggagaugcuuggcuuuuuaaaguugauuuauguucuccuucuaggccuuuugguugcccaccauugaugacugacccuguugcugcuuggcuauuucuguauagugagggcggccagcaggaagaaacucagagggaacugagauaauagugggauuggaucauuugacugggcuggagaacauccuuuuacauggccuucccauggaugugcuguacaucugcucaaaagaaaauaauuacuuugaugagcgucuucaaaaggacucuuggugcaacagacucaauuggaacucagcuuuucuaacugucacugcaccaagcucugcuggaggagugaccagacucacgauuugguauaguggggcucucaagcaucuucaauuugaauguacaugcugcugaggagccggugaagucaucaguuccgcacaucccuucuacccuccaacugcaugggaagccaaaguccugguuuugaaaugcuugggcagcucagccgcuugcccucacccugcaugucuuguuacugggucucccuguguacuuguggcauuauccacaaccaucauguuucuuaggugccaaacauuuacagaaacauuuucauauaucuuggggucagagaaagggacagauacagaaggaccuugcuugcaggaagccaugcaguuaguuucugcaguuagucgugugaggcuaggugguugggcaggccucgggcuguagguguugggugggaaaaagacccaagggccugaaagggagggaaaggggaggguagcgggaggguagcaggugaguuccuagggcuggaagguuuagcagcagccuggugcagugcccugucaucaagacaaacccacgguccuccugggugccuaccaagcuugguuuguacaaaagcaaggugggagucuauuuuuguacaugagauacaucacacuuaccugugggccaguauugugaagugagucugaguuguuuacacugaugccuucccugcccaccacaaauuguguacauagucuucagaugauaccaccccuuuccccagcucccaaccaagagcugguucuaggccuguguuauaugucauauuuagcguuuuuauauaugaccuuugauuucuguuguuuguauuuuagcacaguguaugcaccuucauuuaaauacaucugugugcauacagauacgcauauaugugugugcguaugcauauaucucucaucuguaguuuccaagaguucagcugaagcagauggaguccugcagcccaggagacacccugcaucccugcuaauaguguuugccacaaguauuagugagucuuccuuauuaauauuuucauuucagaagacugaagcaaagcugauaguguuugcuguuucuuuggcagcuaagugagggucuugggaugacuugcuguguuccucaagcugcacuuuggggccaucucugcaguauuagcccccuuuuugcuuggugguacucugucugugccugugugugugugugauagucacucuugcauggcuuccaugucugguuuguggcauuuggggauaaggugcugaagccagagcauuugcaguuuguuugaggccucguugccaaugauagaucacuccuguugaccugguaugucugcuugcuugcugcuuuuccuugcuuucucuuggaagaggaaaggacucuggucaggcccaggcugagugagaugagcugcagcuggcucauggccuucuuagagcagagagaggaguaugucauuuuacuaaguuccuaaacaaacauuuaugcaggcaacacuccuugcagauccagaaacugaggcacaauaggguuaugacuugcucaagaauauguagcugcuaggggguaaaucaaggcaucacaauuucuguucagcgggcaggaauaggcugugaauugcuagcacuuuuuuuuuuuaagcaauuacuuuuugacuuguuccucugaaagugcaagaggcguacaccuuucccaaauguagacuagaaucugcaggaugccacccacuguauaguucugcuuucccagagaggaagaacuuuuagaaaccaaaugaucuuaauuguuauugcccaccccuggcuuuuccggguagaaaauucacaguaggaaugauuguuaagagagagugcuuggaaccauggguuaacaggaaaggcuaccuaacuucacauaucugcaaccagagcagccaccaagcauuacuuagcagcaggaaaaugauuguauuugaguuccuguguguccaaaacugagcaccauguucuuugaaaacaugccaccucaaggcugggcgcgguggcucacaccuguaaucccagcacuuugggaggccgaggcgggcggaucaccggaggucgggaguuugagaccagccugaccaacauggagaaaccccaucucuacuaaaaauacaaaauuagccgggcgugguggcaugcgccuauaaucucagcuacuugggaggcugaggcaggagaauugcuugaacccaggaggcggagguugcggugaguugagaucgugccauugcacuccggccugggcaacaacagcaaaacuccgucucaaaaaaaaaaaaaaaaaaaugccaccucacagucucuaucguugggcccugugguugcaaagcugccuccugaauuaagaaggaaagggaaaagauauagcuggaagcgaguggaagagaugcugagggcuggggcugcacagacgugcucagcagggcuacaggugcucaagcccuauuggggauggguggggaguggggcagcggcguuugccaccuuaagaauuggggccaaagccacugauguuuauuugacagugacacugcacuggguacuuaaagaaauuauuucccguuguaauuauaauuacugcuuauuaaggaaaauaugggaauuuuagaaagaaucaaguuugccacccaaaugcuaccacuguuaaucuuuugguguuaaauguucccccuagacauuucugugcauagauuuuugguguguuuacauagucguuauucuguauauacaauuuuaugucccuuuuguacuuaacguauaaacauuuuuuccauguuacagucuuaaacagaauuuuauggcugcagccucuucgauuugaguuucuguagcaugguuugccugguucccagagcuggagggaggcuuggguugucuccuguuaguucuggcucacacugcagcuugcuguaaugcuguguagacggauugcugggcucccugggacugccucugacugccccuugguaacuaagauuuaugggcuggugggaggaaccccuagaaccagccuucaaccccaggcuguaauagccauagagccagcaaugacugacggggcaaggcaagccugagccagccugaaucuucggagacugucuggcacuuaccucaggcugccuugcauccucuacuguuuacucaacccuucaccagauugacaaccucuaguuggaauauguuuuguccugcuagacccugguuucaggaaggcaagaauacuggagucucucugaggccccagcacccagucuggcagaaggcaauugcuuugguaacccauuugccuggaggcugcugcucuagcucagcauucucagagcuguagaaccugcuuccugcucuugccucgcccucucuggaccagagaagaaaaccuugggccugccacauuuucacauugcucaugggacucugcaacaguggcggagggaacauccuagcuugugugugacaggccaugcacaggcucuucugacacuacguacguaggaagagacccccuccuggccugguggga

SEQ ID NO: 16107 - RNA, 24941 nt, Homo sapiens
ucccaccaggccaggagggggucucuuccuacguacguagugucagaagagccugugcauggccugucacacacaagcuaggauguucccuccgccacuguugcagagucccaugagcaaugugaaaauguggcaggcccaagguuuucuucucugguccagagagggcgaggcaagagcaggaagcagguucuacagcucugagaaugcugagcuagagcagcagccuccaggcaaauggguuaccaaagcaauugccuucugccagacugggugcuggggccucagagagacuccaguauucuugccuuccugaaaccagggucuagcaggacaaaacauauuccaacuagagguugucaaucuggugaaggguugaguaaacaguagaggaugcaaggcagccugagguaagugccagacagucuccgaagauucaggcuggcucaggcuugccuugccccgucagucauugcuggcucuauggcuauuacagccugggguugaaggcugguucuagggguuccucccaccagcccauaaaucuuaguuaccaaggggcagucagaggcagucccagggagcccagcaauccgucuacacagcauuacagcaagcugcagugugagccagaacuaacaggagacaacccaagccucccuccagcucugggaaccaggcaaaccaugcuacagaaacucaaaucgaagaggcugcagccauaaaauucuguuuaagacuguaacauggaaaaaauguuuauacguuaaguacaaaagggacauaaaauuguauauacagaauaacgacuauguaaacacaccaaaaaucuaugcacagaaaugucuagggggaacauuuaacaccaaaagauuaacagugguagcauuuggguggcaaacuugauucuuucuaaaauucccauauuuuccuuaauaagcaguaauuauaauuacaacgggaaauaauuucuuuaaguacccagugcagugucacugucaaauaaacaucaguggcuuuggccccaauucuuaagguggcaaacgccgcugccccacuccccacccauccccaauagggcuugagcaccuguagcccugcugagcacgucugugcagccccagcccucagcaucucuuccacucgcuuccagcuauaucuuuucccuuuccuucuuaauucaggaggcagcuuugcaaccacagggcccaacgauagagacugugagguggcauuuuuuuuuuuuuuuuuuugagacggaguuuugcuguuguugcccaggccggagugcaauggcacgaucucaacucaccgcaaccuccgccuccuggguucaagcaauucuccugccucagccucccaaguagcugagauuauaggcgcaugccaccacgcccggcuaauuuuguauuuuuaguagagaugggguuucuccauguuggucaggcuggucucaaacucccgaccuccggugauccgcccgccucggccucccaaagugcugggauuacaggugugagccaccgcgcccagccuugagguggcauguuuucaaagaacauggugcucaguuuuggacacacaggaacucaaauacaaucauuuuccugcugcuaaguaaugcuugguggcugcucugguugcagauaugugaaguuagguagccuuuccuguuaacccaugguuccaagcacucucucuuaacaaucauuccuacugugaauuuucuacccggaaaagccaggggugggcaauaacaauuaagaucauuugguuucuaaaaguucuuccucucugggaaagcagaacuauacaguggguggcauccugcagauucuagucuacauuugggaaagguguacgccucuugcacuuucagaggaacaagucaaaaaguaauugcuuaaaaaaaaaaagugcuagcaauucacagccuauuccugcccgcugaacagaaauugugaugccuugauuuacccccuagcagcuacauauucuugagcaagucauaacccuauugugccucaguuucuggaucugcaaggaguguugccugcauaaauguuuguuuaggaacuuaguaaaaugacauacuccucucucugcucuaagaaggccaugagccagcugcagcucaucucacucagccugggccugaccagaguccuuuccucuuccaagagaaagcaaggaaaagcagcaagcaagcagacauaccaggucaacaggagugaucuaucauuggcaacgaggccucaaacaaacugcaaaugcucuggcuucagcaccuuauccccaaaugccacaaaccagacauggaagccaugcaagagugacuaucacacacacacacaggcacagacagaguaccaccaagcaaaaagggggcuaauacugcagagauggccccaaagugcagcuugaggaacacagcaagucaucccaagacccucacuuagcugccaaagaaacagcaaacacuaucagcuuugcuucagucuucugaaaugaaaauauuaauaaggaagacucacuaauacuuguggcaaacacuauuagcagggaugcagggugucuccugggcugcaggacuccaucugcuucagcugaacucuuggaaacuacagaugagagauauaugcauacgcacacacauauaugcguaucuguaugcacacagauguauuuaaaugaaggugcauacacugugcuaaaauacaaacaacagaaaucaaaggucauauauaaaaacgcuaaauaugacauauaacacaggccuagaaccagcucuugguugggagcuggggaaaggggugguaucaucugaagacuauguacacaauuuguggugggcagggaaggcaucaguguaaacaacucagacucacuucacaauacuggcccacagguaagugugauguaucucauguacaaaaauagacucccaccuugcuuuuguacaaaccaagcuugguaggcacccaggaggaccguggguuugucuugaugacagggcacugcaccaggcugcugcuaaaccuuccagcccuaggaacucaccugcuacccucccgcuacccuccccuuucccucccuuucaggcccuugggucuuuuucccacccaacaccuacagcccgaggccugcccaaccaccuagccucacacgacuaacugcagaaacuaacugcauggcuuccugcaagcaagguccuucuguaucugucccuuucucugaccccaagauauaugaaaauguuucuguaaauguuuggcaccuaagaaacaugaugguuguggauaaugccacaaguacacagggagacccaguaacaagacaugcagggugagggcaagcggcugagcugcccaagcauuucaaaaccaggacuuuggcuucccaugcaguuggaggguagaagggaugugcggaacugaugacuucaccggcuccucagcagcauguacauucaaauugaagaugcuugagagccccacuauaccaaaucgugagucuggucacuccuccagcagagcuuggugcagugacaguuagaaaagcugaguuccaauugagucuguugcaccaagaguccuuuugaagacgcucaucaaaguaauuauuuucuuuugagcagauguacagcacauccaugggaaggccauguaaaaggauguucuccagcccagucaaaugauccaaucccacuauuaucucaguucccucugaguuucuuccugcuggccgcccucacuauacagaaauagccaagcagcaacagggucagucaucaauggugggcaaccaaaaggccuagaaggagaacauaaaucaacuuuaaaaagccaagcaucuccucacugccaacgguucuucacaucccaccccacagcaaaaaugugcccaaccccaguggcucugguagcccucucuccuaaccaaccaaccccgaugcucuaaggagacagaaacacucuuuccucuaugugaaaguaaaaugguucuguuuuucuccaauaaucacuguccaccuuccaccaaagcagaccccccgcccccuuuuuuuuaaaggaagggaaaaaaaggagugcugccugggaggugggugaauaaguaaccuguccucauugcuaauccaccagguuaccuccaacaggcccccaccuuccugggcuguaaaaaguaaggaacuggaugguuuugcuguauuuuuucuaacauuuuuuucuugguuaaaaaaaaaaagcaagguggcaaugugcuccggguaggcuaguaaugaaaugucucauccccgaauacccaggcagguuuaggagaucacaagggaaaacuggagcugagacucacugauccuuuguucuguuaguauuaucuaggaagagauaagggccuggaguuaauucuaaguggugaguuaugaccaacuguagaaauuucugggaauuuggcguaaaccaacaggaauggaaaacugaaaccacaaaaggccgguucagaguauuuuaaggagcaaaaaaauugccaagcauagcccagguaguuuggaccuaaaauuaggguccagagcaaaaacuggccuaugaucuccuuggaacucaaagaugauuccugaucaccucuaggaagaauaaaaaugaaaggcaagaccagcccagccagagaucaaauaauaggagaugaaauagggaaaccaccaguugagaaacauguacuuggaugcuuguaauguaccuauguagaacacagcuugcugugcuuguugaggcacccaccaccccaacugggaagggucccugaguagcagauaccucuuacuguucacauaccauguuggaacacgcacuggcaaaagucaugaacuugggguugaauugcaaacagguaaucgggccuguguguuuaccauccaacacagcuacuuuuauaccgcucucuccauuccagacauggaucuugccauccucugaaccuaaagaggauauucacggaaaauguaacagcucaaggcgcaauacaaagacaacuggaaaugagacauggauugagaucugaggauacgccaagcuuuaggacccaucccucaggcaaaauugagagggaggagaggcagugaaggaaggacacuuuggaaauuuaucuugacccuagcuauuuguucacaggcaugucacuuccguucuaacuucaguuuucucaucuaaaaaaggggccgaauaccauuacccuaccaacaggcagccacuaagaugacugaauguaggguuacaccaggacauuagcauuacuaauaagguagugcuuguggaguuuaacucaaauuuugguccagucagggcaguuaaaagacacuauguccuuggcauaaugugcuauacagaaaucuaagaacaucuaucaaauagauaauaaugucucaguuaauaauuuaaacaaagaaaugcauaguaccagagaaauaacccccacaggggauaaaaggaaacucaccaaucauaauaaacugagagucuggaguaaaugaagccuccagugugacagcuuugcuguuggcauaacccuaaaacaaaacagagcaguucuuuuguucuuacagagccauuaauaaaaacagcugccuacaaacacugacucagcacaugcaucaccuuccuuuccaugaaacccuuuccuugucauguacuacaccaccaagcuuccaaaugugguugccaucguugacaauccacucccacccucaacucuguauucaaggcauacucaagggggcaagaaaacuuuauuguuaggaaauuauuuuauaucuaaauaccaaacuugggucacuuggugagaaaugaacaucuacgaaauccaagagagguaaguucaugagcaggaagaaaauacaagugcaugccuucaugaguaagucaagaguaacuguuggucuccaccaaccagcuaacauaauucuuagcauaggaaguaugagcauggaaacagccaugcuugaaggcugucagcucaccccaaaugugugcaucaccacuccuuugaaugcaucaaucagacgaaugaagcugccguugguggaaaugaggaugagcuugccaucauugcugaauuuaaguccuguccacucacaaguucgaucauacugcaucuuaaagguagcaaauggccccugcaaaagauaaaaaacaguagccccaggcauauuaauaauuucuucugcuagagccaauucccauccuauuccuuuagauuacuuuuugacuaaggaaagcagagaaugagcuacuucucugccacucucuaauaucuaccacauuuuuccuuuuguagaaaaggcucuuacagggccgggcgcgguggcucacgccuguaaucccagcacuuugggaggccgagguggguggaucaccagaggugaggaguuugagaccagccugaccaacauggugaaacccaucucuacuaaauacaaaaaauuagccaggcgugguggcggacacguguaaucccagcuacuugggaggcugaggcaggagaaucacuugaaccugggaggcagagguugcagugagcugagauuacaccacugcacuccagccugggcaauaagagcaaaacucugucucaaaaacaaaacaaaacaaaaaacagcucaaagaucucaaagauucaaagauuuaccuuaucaaaagaacgaaggucauaaagcuugaccauuucagaguugacaccugcagcgaaaauuaacccuucuggaucaaaagaacaaacuggcuuccccugcagaugcaugaggcccuaagagaaaagaaauaagaaauacacuaaaacacacaugccacaaccauacguggaauaaccaaagacugcugguacaauggggaaaaaaaaaugaauccaggaccuuaccacuauauaauuuacuuuucccaauuaaaacuaagaaaggcauacaaacaaauaucagccuaccuacagaacacacacaaaaaaaacauaaaacuaaaaugaagcuuuuaaaaaacaggucuccagacaacaauuucugaucaacucuaacugcacaauauuacagacacagaauucaaauaaaaauaaaucccuugaagcuaaaagcucuaggaacacuuuuaaaaacauuaagccagcugggcgcaguggcucacgccuauaaucccagaacuuugggaggccaagguaggaggaucaccugaggucaggagacuagccugaccaacauggagaaaccccgucucuacuaaaaauacaaaauuagccagacaugguggugcaugacuguaaucccagcuacuugggaggcugaggcagaagaaucgcuugaacccuggagguggagguugcggugagcugagauugcaccauugcacuccagccugggcaacaagagcgaaacccugucucaaaacaaaaacaaaaacaaaacaaaacaacaaaaaacccacaacaauuaagccacagaguacaaugcaaucugcacuagauuaggguaugugcuuagcagcuaccaacuaaaaaaacagauuuucuccaaaguuuaaaaagacccugugaucccagaauggaaccacuguuuucucccuucuuugagagguagaguucauuacagugccuaccaaagaaaaugcucaaaaaguauaacugugagguaccauuaccuggcaguuaggagaccggagaucccagagucgaauggucuuaucaagagacccagaaaugaaagugucauccacaggugacauggacaaggccaccacccugcaauacaucgagauaaauaggaguugaugcgaaauauuagcaaaaauuggaugugaauucuaaaccacucugccuaucuauacauauauauaccuguucucccaaaauugccauuuuaagaaacacaauaaaacacacauaccacaaccauaucuggaacaaacaaaggcaacuaguauaaaaaaaaaaauuuaaagcuacaaaauaaaaauauaugauuccaaugcaaaucaaaaccacaaugaaauacuacuccacacccucuagcauagcuauaauaagagagauaacaaguguuggugaggaugcagagaaauuggaacccucauacauugcuaauggaaauguaaaaaugguacaguugcuuuggaaaaguuuuuccaaaaaaaguuaccacgugacccagaaacuccacuccuagguauuuacccaagauaacugaaaauauauguccacacaaaaauguacacauauguucagaucugcacuauucauaacagccaaaaaguagaaauaacccaaaugguccauuaacuaauggauggacaaacaaaaugugcuguaucuauacacuggaacauuauuuggcaauaaaaaguaauaaaguacugccucaugugacaacauggaggaaccuugggaacaccaugcuaaguaaaagaagccaggcacaaaagaucagauaugaacugauccauuuacacaaaaugucuagaauaggcaaaucuauaaagacagaaguagaucagcaguugguaggggcugagggagugauuacuaauggguacagaguuucucuuuggagugauaaaaauguucugaaguuagaugauggugauaguuguccaacuuugcaaauauaguaaaaaccacugaacuguacauuuuuaaaggaaucauuuacaguauguagacuguaucucaauuaaaaaaacacaaaaaagcaugauuccuuaucaagaugugugaggacuacacagauauucucaaaccuaaguggcaucagcaucaccuggaggguggguuaaaacagacugcuaggaucugcucccagagccucuaauccaguaggccugacuuggggucugugaaucugaguuucuaacuagcccccaggugaugggugaggcugcuguuuugggcaccacaccuagagaaccacaagccuaugcuaacagcaacuguauuccuuuuuugguucccuuuugugguuauaccaucaagagacacucacugaaaaacauuuucuuccaauguaacucaacuaacaucugcaccagcuccucaaguuaaaauuuuaaaagguauuguuaaaagccaaaauuuccugagaaugcugaggagguaauaaaacacaaugagcaggccaggugcgguggcucaugccuguaaucccagcacuuugggaggcccaggugggcgaucaccugaggucaggaguuugagaccagcuuggccaacauggugaaaucccaccacuaauaaaaauacaaaaauuagccaggccugguggcguacaccuguaaucccagcuacucaagaggcugaggcggaagaaucgcuugaaccccagagauggaggcugcagugagccaagaucacaccacugcauuccagccugggaaacagagcaaggcaccgucucaaaaaacaaaaaucagaaugagcagaacacguuguggacauguaauuuuaugccauggcauucagcccaagagcucagcacaagacucuaugcugagaaguacagggaacacauggagaaguaagaccccgaccguaaggaauuuuaacuguccaguccacaugacuccaagaggaccagagaaggcuucuggaaagauacaacaucugagguagaaaggauuucaaagaaguagcccagaguucaccuuaaugggaauggugggagaaaaugcugagaaaaugggucagagccagaagggacagaaccugacuacaaggggaaggagcaaugaaaauauagagaaccauuaagagagauugugaagcaaucaaacugcaauccaggaagcugaaacaggaugguaagagaugggaagauuaauuaggagcuaacaauaauuuaccucacagggcaugagccagggcagaagcaaaggagagaacacagaggaaagugacacaugagguuaaaccuagggagaacuaaauaguuuaacaacucacugaauaugauggcaggggaaaaagagugaacuaacaacagaugcuuugagccagaauuggaagagacagagaugaauaaauaugaggaagacagagagaagcuggcccaaaaaagguaacaaugauggacagaguacuggaccugaguauuagaaagaguauuggacagaagagacagcuacaaagauguguauaaaacauguagguggugcugggugcaguggcucaugccuguaaucccagcacuuugggaggcugaggcggauggaucaccugaggucaggaguuugacagcggccuggccaacauggugaaacccugucucuauaaaaacacaaaaauuagccgggcaugauggugcgugccuguaaucccagcuauucgggaggcugaggcaggagaaucguuugaacucaggagguggagguugcagugagccaagaucaugccauugcacuccagccugggugacccggugagccuccaucucaaaaaacaaaaaaacaaacaaaaccuguagguggaaggcgggucugaaacugauaauagacaugagcuaaaaauacugauuugggaagccaccugaauggagguaaaugaaaucagcgauggagauaagaaagcggauaaaauauuuguuuauuuuagagucaaaacagaggcugaaaacuacaagaacagaaccgacaugggaaaagucaccugccacgggaaaguaaguuuuacugagagguuaagcaccaagaaaagcccaaaccaguggcuuuuuaacuagaggcagcagggaaugaaggauaaagguuuggauaaagccccauagacgauucugggacuagugcaaaaaugauuucaacagugaacaugugugaggagguggagaugggaauguacagauucuucuuucaaguuugauagugaaaaggagugggugauagggucaauaaguagauuuaagauaagaaagaccaaguaaauuuguaggcaacaaaggaaaggccaauuaaggagauggaagcaagcagaaagaggaaggucuguuuugugaaagaaagacaacagcuuucucaaggaaaggauuccaaggaagacagaauuuagguggaagggauagauguuuaaaagaacucuuuuuuuuggagacacggucuugcuuugucacccaggcuggaguacaguggcacaaucauggcucacugcagccucaaccucccagacucaagcgauccucucaccucagccucccaaagugcugauaacaggccuuaaccaccacacccagcugaaauaacucauuuuguauagccuugauuuucucauaaaaggagggacaaagucaucuaucaagaaucaggaggucggccagccgggugcgguggcucacgucuguaaucccagcacuuugggaggcugaggcgggcggaucagggaccauccuggguaacacgguaaaaccccaucucuacuaaaaauacaaaaaacuagcggggcuugguggcgggugccuguggucccagcuacucaggaggcugaggcaggagaauggcgugaacccaagaggcggagccugcagugagccaacauugcaccacugcacuccagccugggcgacagagcgagacucugucucaaaaaaaaaaaaaaaaaaaaaaaaaaaaaaaaaaaagaaucaggaggucaagagguugaauaauugggaagacuggaaagcacgucaaacaacugcaucaacucuuaauuacaaauaguacauuugugaacauuaauuugaauaaaaacaagcaaaacaucuacuuaucaugagccauccuuugucugaaaccaguuaccacugguugccaccuuauuucaccuuuauuucagcaacacaaauggccugcccaacuggaagugcaacuuuuuuuuuuuuuuuuuuuuuuugagacagggucuugcucugucacccaggcuggauggagugcaguggcgccaccuuggcucaaugcagccucugucucgcggguucaagcaauucucgugccugagccuccgaaguaguaggaauuacaggcgcacaccaccacuccuggcuaauuuuuguauuuuuuguagagacaggguuucaccauguugccuagccugguuuugaacuccugcacucaagcaaucuguccuccucagccuuccaaagagcugggauuacaggcauuaagccaccacgccuggccuggaagugcaauuucuaacaggaggcucucaggccaucuccugucagggcuccauaccaaucgaaaccauccuggguuacuguacauuugcaaauggaugcaggaaaaaauaccccaagugauuaaaauauuauccaggggaaaacguguuuaacauucaaagaaaaguugaaaaauuagagaaaaaaguaacuaggggcauuggggugaagaacagagagaagcaaccugcauuacaauacagaaaaaggagauaaacuucuugauuuuaaaaaaaggacuuucuuuugcauucucauuaagaucuuuaaauggaacauuuuuacauaggggcccacugaaaugggggccacauauauuggaaggccucauaaacacaaacaguccuuuauuaagggauaugugagauuugguauuccuaaaugccaaaucuaauuuuuacuacauaaguuuucacugaauaucuuuaauccacauuuuuucuaguuuuauauguauauauaaaacuagaaauauauauaucuaacuagaaauagauauaccuauaacuagaaaaaauauauauacauauauaucuuugagacggagucucacucugucgcccaagcuggagugcaguggcgcgaucucggcucauugcaaccucugccuccuggguucaagcgauucuccugccucagccucccgaguagcugggauugcagguguccaccaccauaccuggcuaauuuuuguauuuuuaguagagaugggguuuugacacguuggccuggcugguuucaaacucccggccucaagugauccgcccgccgcggccucccaaagugcugggauuacaggugugagccacugcacugggccuaguuauauuuuaacugagguaucucugaacaccuaccucugcaccucuauaaccucaguaaaucaagaguugacuauuuaagagaagaugaagaaugccaagcaguagugaggaaguagcuucaguucacuaauaagcucucucuagccuucuauucucuggguaaccucagggauaaaagaacuaucugcuucuauaauacgugggucuuaccuuuugcuauguccaggaaaguaucugauguauuuguugucaugcaaggacaaguaacgaauaguaucuguaaaaagacaaacaagguaugaugauaucauacuauuuaaaagaaauuuacuuuacauuuucaucuuaaaaagacaaggucaaauaauccauuguauucuauaucccaagcaaggcaugaauaaauaauggugaauaauucuacucugcagcugaagaguggguauguagauuucaccuaacucaaaagcagaguucuuaaguugacagcauagaaagcaauguuugaaaugaccuuuuauuaccaauuugguuucuucauaauuacaaugcaacucccacccugcaaauauacccuggucaaaaaacaaaaacaaguaaagcacacauaauaauuuuagauacuggucuaguguccacagaauggcaaaccuuaaagaaaaauauguggcuguugagcuaacagacuuaaagaggugagcagccauggcaguuaaacugaagaucagguugaacccuggcagcaauuuuugucuagaguucuccaucaguauguugacccacccucaacucauuugaacauucuucaauuggacacacaaauuacaaugaaaauaaacaaaacgucagagaagugaugucaagaucuggguuaaaaagaucuuaagacauuaaaaaaaucaaauucuuauaccaaugaguaauagcagugagauuuugacaauauuaaagaaaggaacaaucagagauuugugcuuguggaaaaauaagacacucuuaaccaaaugauucuaucugaaagaguaaacaaacaaaaaacaugguggcgguagagaaaugaagugccauaaagaauaaaacugcaaaauagaaaaguauuauccccuuaaaaagacuaggaauaaggaaaaauuguugagaaacagcuaagggaaaaugguaccaaaaugcagaaagaaaaccauagaaagaacauucugaaggcaaacagaacauaggaauaaagggguugaaagcaucgagucaucccagggguucacaggggugcuuucuaauaagagggcauuuaacuugggagggggaauaggggaauagggauauuuguauauuccauaacuugaacacuacacaauuuuccuugaaaacaucuucaaacuucuugaaugacaacuacgaaguauuucuaguuauucuacugcuaacaaugacucaccugcccuaagaagaaaaagacuuccuccccauuaccugguuucccagagaugagcagggugacgccauccucucagccccacuuggcagcuggcgcgcuguuccuggcaaggcaguggccuguacaguuaucuccuguaccgggugguaucauagacccucaaacuguacaaacuacuaccucagccuggaaucaggcaaaaggaaacggagcgcuggaggaacucuucaggaugcacuugagacaggaaagggaacauccucacagcagaggcuuggcagcaaagcuacaagugccacacauuugccucaucuugcaccacauuuggagaauccucauuuaaucacucagaaaaacaucccaacagaagaaauaaaccagucauucggaugaucacauagacauguuuccucaggauccuaagguuuuacauucuuuuccaaaaucauuaacuacacugcuuccuuagaaaaccacuucugaaauacaggcaugaaaaguagaaaugacauacuuaacuaaaaaucaauacaggcagaagagucucauuaaaaaaaaaaaaaaauggaaaaaaggacuuccgcccauucugcucugagauaggcacagccaaaauagcaguauaagcuauccuuguggaaugacauuagaaaaaucuuuuuuguuuuuuugagauggagccucgcucugucacccagguuggagugcaguggugugaucacccuagaccuccagggcucaagcaauccucccaccucagccuuacaaguggcugggacuacaggcgcgucccaucacaccuggcuaauuuuuguauuuuuuguagagacgggguuuucccaaguugcccaggcuaaucucgaacuucugugcucaagugauccacucuccuaggccucccuaagugcugggauuacaggcaugagccacuauguagccaccggccuaaaaaaaaccuuacugcaaaaugugagaugaucaucaauaauccacugaaauaaguuuaaaaacagaauccuggccgggcguggugguucacaccuguaaucccagcacuuugggaggaugaggcaggcagaucacuugaggucaggaguucgagaccagccugacuaacauggugaagucccaacucuacuaaaaauacaaaaauuagccgggcguguuggugggcaccuguaauaccagcuacuugggaggcugaggcaagagcaucgcuugaacccaggaggcugagauugcagugagccgagauugcaccauugcacuccagccugggcaacaagagcaggacucugucucaaaagaauaaagaauaggccgggcacgguggcuuacaaggucaggagaucaagacccauccuggcuaacauggugaaacccugucucuacuaaaaauacaaaaaauuagccaggcaugguggcaugcaccuguagucccagcuaccugggaggcugaggcaggagaauuacuugaacccgggaggcggagguugcagcgagcugagaucgcgccacugcacuccagccuaggcaacagagugagacucugucucaaaaaauaaaaacagacaaacaaaagaaaauaaacaaaauuaaaaaauuaaagaauucuaacaugaaaauaaguguuacaguucaguuaccaagacaaucuguuaacuuaggauuuaucucgagacaugcaggcaaaaacagagauuguuuauuauagaaagaaacucacaaguucaauuucuaaaaguaacucuacucuuuagaucaaaaaacguuccuggaaucagaagugacuaagguugggaaaacaccaaaacuguucuaacuucccuuaaacuaucauaguucaagcauuugugaaacuuuucucaaaucucuaucauuuuaaaagaaaaaguccuguuguuuaucacuugcuguguaucaaguguucuuuccuuuuauuuguucuaaaaguguucuuuuuggagauggagucucacucugucgcccaggcuggagugcaauggcgugaucuuggcucaccacaaccucugccucccggguucaagagauucuccugccucagccuccuguguagcugggauuauaggcgugcaccacugugcccagcuaacuucuguauuuuuaguagagacaagguuucaccauaucggccaggcuggucuugaacuccugaccucagugauccgcccaccucagccucccaaagguugggauuauaggcgcgagccccuacgcccggcuuuaaaagcguucuuuuaagugucaggaaguacaaaucauaaacacaauuaguuguuuccuuuuuccacuccccacucugaauugaagacuuuucauacucagucccaaguccuucaaaagugccaauggcuugcuuccagcauuccuucagucaaaacaaugcaauuaacauuacuaacauuauaugaaaauacuuaaacuaaaguagucacaaagcagaaguagucacaaagauuccaugaacuauuuaacaaaggaaaccaugaccuuaacuuccuaaaaaggcuugcuuaccgucuauuuuguuagagcuguaaacaacuguguuugcugcaugaguguaucugaugagguccacaccauauuucuuacuguacaggguucucuuuggucugauaagaaaauagagacagaaaaucaugaacauucuccaucaucaaaaucugggaucuccacauaaagagaagcacuugaaugauguggcaaaggugaggauuuuugguaaguucuaacacuggaaagaaacaacuucuuccaaaagggaaaaaacaacgcucaagcaacagccaucugaagaagcuuuccaccuuagaacaccuaguggcaagguuaggugggaaguaaaaguaaaucuggggauucaauucagucuuuacuacaauguucaaaagcuuugagaaaaaauacaaucaugugccaugugaugacauuuuuaucaacaacagacagcacauaggguaauggucucauaagauuauaauagagcugcccucuacaaccgauguuucauuuuuuaaaucccuuaaacuguuuuacggcaccuuuucuauguuuagauacacaaacacuuaacgcuauauuauaauugccuacaguauucaguacuguaaaaugcuguacagguuuguagccuaggagcaaugggccauaccaaacagccuaggugugugcagauuauaccgucagguuuguguaaguacacucuaugaugcugcugcaacaaaaacucacgugaugauccccaucuaagugaugcauggcuguacaucuacuugggaagaaaggcacacaaaacaagucuuaacuuacaacaaagagggauaugagaauaugucaaacccaagaggccaaacuuuucuucucaagacauccauuuagaaagaagcucuguguuuuuuuuuuucaagacggcagugauuccucaaaacugaaaccagaugcaaaacugcuugccuuugcuaauguaaccugcucuugcagaagacauccauccuuccuauccuacaggucaaaagcgcuugcugagccuuuuagaaggcaagccuaacuuucucuagcaaaaccaguuaaauaguuccuuugcuuuuacuuuaaagcaaaaucacacauuucuggccacaaggugguggcucacaucagucaucacagcacuuugggaggccgagccaggcaaaucaccuguagucagaaguucgagagcagcccaacauggugaaaccccgucucuacuaaaaauacaaaaauuagccgggugugguggcacacacuuguaauuccagcuacucaagaggcugaggcaggagaauuccuugaacccaggaggcagagguugcaguaagccaagaucgugccacugcaauacagccucugcgacagagugagacuccaccucaauaacagacaaaaaaucacacauuuccaagcuagagguuaucaaucuccauuuguugaaguuccuuaaaugucucccuuuacagaaccuugaagagcaaggcuaaaacuggucucaacagaaccuuuaaccaaaaacucuaacacauacugguuaaguuagaaaaauuuuaggcugggcgugguggcucacgccuguaaucucagcacuuugggaggccgaggaggguggauugccugaggucaggaguuugagaccagccuggccaacauggcgaaacgcuaucucuacuaaagauacaaaaauuagcugggugugguggcccacgccuguagucccagcuacucaggaggcugaggcacgagaaucacuuaagccugggaggcagagauuguagugagcugagaucgcgccacugcacucuagccugggcaacagagcaagacuccaucucaaaaaaaaaaaaaagaaaaauaaaaauuugagacuuaaauaucuauguaaaucuagauucaaaugcuaaaauaacucuccaauacgaucaacugaaaaaacaggaaagccuuuaacauaauguccuacauuuaguucuuuagaaagauuucauaaauccuguacuaauguuaaccaagaguuccaauuuaugaaaaggaaagcuaauccucucaauguaaaauccucucagaaucuagguacuaaacaaucacgacucaagcagucuuuaagaagucaguuauuugcacuuucaauuuuuguuaaagugaggccaagggcuucccuacaugaaacccauuuccaacagacuucucacuacaaauacacuggauuuuccacauucuuaccuuuacugaaauaacacuucacuccuaaaaagaucagcaaaggcuacuuugccaagugcacugucugggguucugaugugggguuacugugugguaaccagugaggcagucucaguguguggcuguauacuuacucucuacauaguugacucugcuaccaguggaagaaguuuauaucaguuauuucaucccaucuacaauagcaaagacagaaacuggccgggcgcaguggcucacgccuguaaucucaggcuuugggaagccaagguggguggaucaccugaggucaggagucugagaccagccuggcuaacagggugaaaucccaucucuacuaaaaauuaaaaaaauuagccaggugugguggugggcaccuguaaucccaguuacuugggaggcugagguaggagaaucacuggaacccgggacauggagguugcauugagccaagaucgcgccauuguacuccgaccugggcaacaagagcgaaacuccgucuuaaaaaaaaaaaaagacagaacaugaagagccaacucuaacuugacaaguugaaagagaauaguguaaggaaaauuucugguuccacuuagaucuggucuauuugucucaaauuuaucaaaaacacuaaccugagauuuuuuuuccugauaacagaaaucuacugccucauuucauuucccaauuugauuuuuauuauuuuuauguuuuugagacauucucgcucuguuacccuggcuggagugcagaggcacgaucucggcucacugcaaccucugcguccccgguucaagcaauucucccugccucagccuccugaguagcugggauuacaggccccugccaccaggcucagcuaauuuuuguauuuuucuguauagacaagguuucaccacauuguccaggcugguuuugaacuccugacccaggcgauccacccgccucggccucccaaagugcugggauuacaagugugagccaccacaccuggacucauuuccuaacuugaaagcaagauuauacuguacugcauccaugugggucuuacaaaauacaugcacaacauuuuucaaauauuuugguaagcuuccuuccucaaacuauaauucuggugaucaagcaucaacaaggaaaauaauauuaaccuuucacuuugaguaauuugcuucaccuaccacaaacaauauccuuuauacucuuccaaauugaaauaucacucaaugggcgaacuccauuguaaagaaaauuuaaaugaccaguaaacuggaaaauacuaagcacacaaaaucuugcuuuagccauuuucaaacucccaaauucuaacacuagggucaucuaauaaagauacuaugccuucggccggucacaguagcuaacaccuguaaucccagcacuuugggaggccuaggugagaggaucgcuugaguucaggaguuugagaccagccugggcaaccuggugagaacuugucuccacuaaaaauaaaaauagccaaguaaguuggcgagugcuuguaggcccaacuacuuuggagauugaggugggaagaucacuugagcccagaagaugaaggcuuuagugaacuauaagcaugcuauugcacuccagccugagcaacaggggaagaccuuugucuuaacaacaaacaaacaaaaaaacaaaacaaaacaaaacaaaaaaacagggccgggugcggaggcucacauauguaaucccagcacucugggaggccgaggagaccgaggugggcagaucacuugagguaagauguugagaccaacauggccaacauugugaaaccccauuucuacuaaaaauacaaaaauuagcaggcacacugaugggugccuguaaucccagcuacucgggaggcugaggcacgagaaucgcuugaauccagcagcgagguugcagcagugagccaagauuacgccacugcacuccagccuaggaaagagugaggcagucucaaaaacaaaacaaaacaaaacaaacaaacaaacaaaaagaaaggccgggcgcaguggcucaugccugcaaucccagcacuuugggaggccgaggcggcggaucaccugaggucgggaauucgagaccagccugaccaacauggagaaaucccgcaucuacuaaaaauacaaaauuagccaggugugguggcgcaugccuguaaucccagcuacucaggaggcugaggcaggagaaucgcuugaacucgggaggcggagguugcagugagccgagauggagccacugcacuccagccugggcaacaagagcgaaagucccuaucaaaaaaauaaauaaauaaaagauacaauaccaugccuucccaaggaaauacuucuuuucuucugaggucgguuugaccuauacuagugacaaaauuuuucaucauauuauugccuagaauggaaacuaaagagguugucuaauacccaaagaaguaaucugaccaaugucacauaccuagucacaggccaaacuaguacccaguucccuccuaacuaccaggccacuccuucaccacagauaaugaaacaagguuacaauuaauugaucagagaaaacucaagagcaugcccuguaguauuguaucaguacuaaauuuccuaauuuggauaacugugcucugguuacauaagaaugucuuugugcuuagaaaauccacguugagccgggcgcaguggcucaugccuggaaucccagcacuuugggaggcugaggcggguagaucacgagaucaggaguucaagaccagccugaccaacauggugaaacccugccucuacuaaagauacaaaaauuagccaggcaugguggcaugcaccuguaaucccagcuacucaggaggcugaggcaggagaaucgcuugaacccaggagccggagguugcagugagccaagaucacgccacugcacuccagccugggcgacugagcgagacuccaucucaaaaaagaaagaaaauccauguugaaguguuuagggauaaaggggcuugauaccuccaacucuaaagguggggggaggcacacaguacauauaaauauuuaccuacagucaugaagcaaaugcagaaaauguaaccaguuauugaaucauaugggaguucuuugaaacacuguaacuuuguuaguuucuaauuauguaaaaaugcuacgaguaaauaaacugccuuaugucacaaaacuagcauuuuacuuuuaacaagacaggauuuggccaggcacagcagcucaugccuauaauccuagcacuuuggaaggccaaggcggguggaucacuugaggucaggaguucaagaccagucuggucaacauggugaaaccccaucucuacuaaaaauacaaaaguuaggguaugguggcaggcgccuguaaucccagcuauuugugagggugaggcaggagaaucgcuugaacccgggaggcagagguugcagugagccaagaucgcgccacuacacuccagccugggcgacggagagagacuccgucccccacccgaaaaaaaaaaacaaaaaaaagaaagacaggacuucaugucaaggucauccuucccaaaucaaaauuacgccaaauuuggggacaaacugcaaagaaaugcuauaacaaccuucauuuccuuuaaaugaggauauacaucuccacccucagguucugggaagagguucuaaucugugcauaagcacuauacauuucaugcaagccagcuucaaauuacuccuccaggaccccacaaugcugacccuacuaccacaccuuuaaauguuacuucgucuucuaaacugauucaagugaccagaccaggacagaaauccaucuacucaaugaguaacacugacucaaauaacuauuuguccagcuaacaauucccucuuccuuaagaccaccacugcagaccacucugccacaaacugcaggcagauccagagccgguuacauaauacuuucucacagccccaguggggaaaaaaacuggggggauaccauuauagcucaguccaaacuagcauuacuucagauaaucaaauucacaaaugaagagauauguuccaaaagaaggacaccagucuaaaaaaaaaaaaaggaaaaaggaacagcuggagaagguggagaaaaacccaagaucucaaauaauaauaauaauaauaauaauaauaauaauaauaucuguuacuaggugacaaaaucaagucugaaaaaaccaggguccaccgaauuaaaccaaacaucagcaagccuucuuggggaagguggcuaaggguaaaacgaauuuaaucuaaacuaguuuuuggcuccaaggagcugcaaguccacaggcgugcggugaggagggcugacaaggacccccagggaaaaaggcaaagugcugugcuuagauuuugcgaaaagaugcagguauggugggucuccagaugacuuguggcaacauaaaaguuucaugaucagaauuggaauucaaaguggaccaaaaaguguaauagaaaaaaaaaaguaugaaaggaaaccugaaauuguucuacgaugcuugcuuuguuuuaacggaagcucacauucaggucaggaugggacgaccaaguucguuuguguguggcaaaaaggaaguuuuagauguugcugaaaaguucacuuaugaacgugggcaccaagucugaaugaguaagagaaaggcuaggagcaggaagaaaaagcaagggggcucaaaggggcacaacaaauaaauccugacagcuaagaagugcaacccacgcggucugacggcagaaaggccgcgggaagcugaggggcaggggaugggcggagugccagggcggaaucgaggucacaguggagagagcacaagagagagcugacgcugccgaaggaggcagaaaagcagccccugcaguccugcgucgaggccggagcagaccagcaccuuugacagccugaggagcugaaaacgcuaccuggugggcccagggugggcggaccgggcguuuaaaggucaaggucaaggugggguuuggcaagugaugcauagcgcucaaaggagaccgaagacauacaaauaauauuauaaaauuaugacuaucguuaucuuuuuuuuuuaagaagaaaaaaauaaaaggucuccuggacggcugcgggguggaggcggcccuggcaggaacgcgugcaaaauaggcugggggcugaagucgggacggagggcaggccgagggaccugugcugggccaccggagggaggcacugagacucgggcccagggccuccgccgcacucacuugcccuccuggcagucauagagcacgauggagucgucgucgcuacucgagaugaccgucucgccguuggggcugaaaucgaagcaguuaaucuuguccgaguuuucgcggaacaccuuagcgacgcggaagcuccgcaacacgcugucggucagcuucauggcggcggcuggggaaggcagcggcggcgcagggccggggcggggcccggcggcgagcgggcgggcugccgaggggccaacccaggcggggcgggcgccgcgccggcggcuagcgggaagucggccaacaguugggccgccuccuccucuucuuccugcuuggucgagggucuucugccuggacuguggagccucgccgaccguucguccucacagccaccucacggacaaccggcgcgucgccggcucauuguguccgccauuuuggggcgacaggcagaagcug

SEQ ID NO: 16108 - RNA, 2413 nt, Homo sapiens
cgucuggcuugcguucuuccgggcuucggaacuuuucuucgcggagccuggggaagcuuuuccaguaguacuuuccggcguuguugacccuauuucccgugcugcaccgcagccccuuucucuuccgguucuaggcgcuucgggagccgcggcuuauggugaguguuggccgcgcggcauccgaugccauccgcgacuuacggguggcggcggggcgcgggcugcggagaggacuggugaccgaccgugugucugucgggagcaaaagcugcggggugggaauggugcuucuagguccuaggagggggauggcagggaaagccacuuuauuggggaaugcagcuuuccggggguaaggaguugauuucagggcaucauuaccuggguuugggaggccaggacuggcguuuggucgugcagaguaagccgagacucguggaggcugcacauucucugccugcaggcucauucugaccagaauggggggggcagagguggcccagccuggcgagcccuuaacccugaucuccacuuuugucuuccaggugcagacauggccaaguccaagaaccacaccacacacaaccaguguaaguuuuuugggcccugccuacaucccagacccuggcaaggacugguucaggcaaacugggacagagaugaaggggcacguuuccauugugggccugaggcugauugauuucacccaguaauaacuuuaggguuuauagguuuagagaucuacuugagauacagaguguuuugcauuuaguaguaaggguuucccauaucucaaguguagcugcuguaggaaguguugguucucccagacuugccagcugugauguuggguggucuuauuagaggaaaguucuuuguuggcuuaauucccuuuuuuucucccacagcccgaaaauggcacagaaaugguaucaagaaaccccgaucacaaagauacgaaucucuuaagggggugagugcacugaaucacauggaagugucuuuucuugguuccaggugcacagucaaggccucucauguaguuuuucucuagcuuuggcuucugccugagcacagccuaacuggcccacccaaagccugcaauuccuuuuucuacccuaccagacccauaauaaagcuuuccuuggucuccacagccugaaguguaacccucuggucaggguguaaccugccuccugagggcaguuuggcuaucucccuugcuuggcaguggcacuuaggguaaggaguggccuugucugagugcgugcagggcacauucccacacugaccagccuuaugaccuccaucugacccagugcuggaguuggggucagcuucucuuccugugucaggggguucuaaggauuagcugagaaggcuggagggucuaggggagagcugagcauguccccagucuguuccuucccuuuacuuuugcucucuguuccguggagugaaucacaaacucugagccucaguuuccccauaucccaccuuggcuauaagucuuuuggaccagacuugguauuuaauugacaccuucuucuaaagaggggagggggugucccugaggggaugucaggaaaaaacuuggucgaaccccugcuguaggaaguugaagccccacaaccuuggcagacagggcagcaaagcagcuuguaauuuuguucuugaaggaggucugcacagcauuacccagguggcguauuggcucccugggguggugguacacuuucucuggaaauaguuucaagagguuggguauuuccacauuugagguugacuugaugcugucuuuagaaugcuggguaccccuauggagaggggcagcagggagagacuuggggacccacaugcugccaccuguaccuuuccugcuuuucagguggaccccaaguuccugaggaacaugcgcuuugccaagaagcacaacaaaaagggccuaaagaagaugcaggccaacaaugccaaggccaugagugcacgugccgaggcuaucaaggcccucguaaagcccaaggagguuaagcccaagaucccaaagggugucagccgcaagcucgaucgacuugccuacauugcccaccccaagcuugggaagcgugcucgugcccguauugccaaggggcucaggcugugccggccaaaggccaaggccaaggccaaggccaaggaucaaaccaaggcccaggcugcagccccagcuucaguuccagcucaggcucccaaacguacccaggccccuacaaaggcuucagaguagauaucucugccaacaugaggacagaaggacuggugcgaccccccacccccgccccugggcuaccaucugcauggggcugggguccuccugugcuauuuguacaaauaaaccugaggcaggauuuguuagccucugucuaugauccug

SEQ ID NO: 16109 - RNA, 5808 nt, Homo sapiens
acuucagagacagcccuguccauagacuuuauuauuuggaagggggaagaggagguccuuggcacugguugggauggaagccccaggggcaaagguuuaggaguuccagggcucagcugucacugggcagggcaggcacacuggcaagggcaggcagcaggcguguauauauguccaccccacggaggaacacagccucaugcagccguucaucguggucgugcagcagcacaggugugcgguucaugggugagaagccuagagcugggacccccaccugcaggggugaggaagagccguuagggaaaagccagcacucaggcccaguccacugcccaggcacuauaugcaaguggcucaccgcgcggauauagcgguugucaguggcagcaggcaugaucucaggcuccagagugagguuccuguaggagaaagagccugaugaauggggagggagaaagcgaagaauugaaggggcaaaggaaggugggaaagaggugggagaaggagggagaagggagggggcagcaggaaggagaggaguagggggcugggcugugaggagagcuggccagcgugcucacauauccuugcagacccggcuaaaagcugcccaccaaggguuugagucaucaguaggugucacuugggggugcauccacuucugagggacaggaagaauggcaggaucaggacaugggccugggcaucuugcccuauuucccauagagugggcugugccuaguacauaacaccuccccacccccacuccuucaccuacccagacaucuggguagccaguccagccacagguccucuuucagccccucaaauguccuaggucugggaccuucccacccuccgucuacuuaccuccuguccauccuucagauccuagcccaagugccccuuccucaagauggcucccccagaccucucagacuaguuggauacuccaguuacagguuuucagagugcaaggggccacccuuuccuguaccacauggguuauaugaaaguacggcugggcgcaguggcucaugccuguaaucccagcauuuugcgaggccaagguggguggaucacuugaggccaggaguucgagacaagccuggccaacauggugaaacacugucucuacuaaaaaugcaaaaauuagcugggcgugguggcaggugccuguaaucccaacuacucuggaggcugaggcacaagaauugcuugaacccgggaggcggaggugagccgagauugugccacugcacugcagccugggugacggagugagauucucucagaaaaaaguaauaucacauaaauguuugauuuauaucuccccguuucaccauacaagggcaugaacugugccuaauuuuacuccccacagcauuccccagcacccacaguggccucuacaaugaaugcuuguuggaauaaaaugugucugucacagauaaagaaaugcccagacauaugcagacacaccaagcacacacuccacuguugcacacuugggucucccccggcucccacacucucccaucacaugucccaaguccauaccugagcaaacucuagggugacccccucgccagcugccuggcaccagcucugcagcugcuccucaaaagccuaagagaagggagacgagcugauccuucaggcuuuccagaggccucuaggacaagacugaggacccaggaucccuccuccaaacccagguggagguggcaccuugaaguccacauccggugccacacggaagucaaagcuggcgcucaugguggcagguaucacguuauaggccacgccacccucuagcuuagucagguucacggaggucacggaccccucuuucagguggggguuugacugcagccuguggugugggggcaggguagcggcagcaacagauaaaagagguggcucagacucuauccucugugguaccgccucccagagccaccccacugccucccaggcugccucaccucugccauuccuucucccggaaugccaggauggaguuuacaaccuugugcuaugagaauaugagguuaaaugggacaguggccucaggauagagccuccugaacucccagacucccuccuggggugccacguaccagcuucucugcugcuguguccuccaugaagcgugaggcauggccuggccucccagugcugguaacccgcaccccuggggagguguagggggaaggcagugucuucagccugaggggcuggagacacaaucagccuggggugggcccaggucucccccucauuccaggcuccucuggcaggguccuguccccacucagggcccguagcauacagcugguuucugcccauucagggcuugcccucagagaagcucagauaggaaagagcugggagguagaggcccuggguucaaggccuucucaggccucaacuuugcugugcaacccugcauaggaccgugcccuuucuggccuagccucccgccuguagagugagcccucccuccaagcucauacuuacaccagggacuccgcucacuauaaaagacagugaaggcaucagugggauuggcuaugccugaggagggaaaggggguucagaggguggagcagcucaguccccacuagcagccuccuacucccugccuggcugcucauuggcuugccaaccugcucacccucauccagggcaaagccugcccucagggcguggaacucaggccgcugcacgaacagcuccaugccuuggugacccccaaccuccucaucuguaaaagcagcagggacgugagaugaggaggcugccccgccccacccuccccuuucccaaagguaucugagccacuccuaccaggcacaaaggucauguggaugguucuggggaaccgguggcccuccaccuucagccuccucacagcuuccagguaccugagggggcauaagccaggugcugggggagccaccagaugcgcaggcuggccccacaggcagggccagcaggcuggaguccuguguccuggacuuuacccugccacacccugauagggacuccagaaagucccugccccucucuggucugaaucucccuauccaugcaauggucauggcaguaguuccuguccaagaggucacgguguuccuuggccuugaguuucuccaaucacccccucagguccugcuucaauccacuggaccaguggggacauuguggaggaguaggaauggaggacacucacuggaugcugacgcacuucauguccugggcaccccuggcauagauguagcccucagaauccuugaaggccucaaaggggucgugacuccaauguuccugggggcagggaugggaagaggggcccaaaccccaaauuuagccauuaauccacucuggucaacaguggcccugcccuaggagcccaccauaggguuggagugacagguggaguggugggagaggaaagacgggggcugaagaaggcagcugauugccaucccccauugcugucuccugcuucccaccccccaguccccaccccacucuggcccagaacuugcugcuggaugaaggcugcuugagugguguaaugucauaaggauguugagaguuagugucaggacuggggccaggaccaugagcaacuugagguugaauccuggggucugcaucaugucuguccccaaggccugcacugcccaccuccccagccccuuacacaccuugaagacaggcaccacauccgugugggaguugagcaagauggaggagaguguaggguuggugccuggccaggucaacacggucaccacauagccaggugccaccuggagauggucaggaggguagguggucugagcagggugaggaagugcccaggcccaccucccuuccccgcuuagggccccaggcucaccucuacuuucugacagcccaggcccagcuggcgggcugucuccucaaagaaagccacagcagcuccuggaggcacagagugucuuggggcugcuucugccuacccacagcuucccaccagcccaggcagcccggagaguggagcauacccagaaaugggcugcugccuccccgacacacuccauaucccucagagaugcuugcauuuccauccccaagaaagaagauauuuuuggcuacucagugacccuuucuggaaguccagggggaugucuggacacaggguuggaggaagguguuaucuuccuuaaauaugggaaacuauggcacagagacaugaagagauucacccaccaucucucagcugauuaaucacagaggaggaauuuggacccauguacacaauucccagccacuaaguuuuuuuuuuuucuuuuccuuuuuuuuuuuuuuuuuuugagacagggucucacucugucaccaaggcaggagugaaguggugcgaucucggcucacugcagccucaaccucccaggcucaagcgauccucccaccucaaccucuggaguagcugggacuacaggugugccaccauuccugacuaauuuuuguauuuuuucuguagagacagagucuugccauguugcucaagcuagucuugaacuccugggcccaagcaaucugccagccucaaccuccugaagugcugggauaacaggcaggagccaccucccaggcccuagccaccaagcuugacucccuaagggcuguggccuuuguccagccccagugggcuucuggagggccucuccuuucccuguggcugccucaggcuucccccaccacuccugcccuggagagugaggugaaguuuuucuuuaaccagcugccaggaguaaccuuggucagcagcagagucucuggggaaaggguuccucccuaaccuggaggggcugccucagucuauuuacuuggggaauggcuggagggguuggggagccauuugggacagcagaguggggcucagcugggugacagggguuggaggcugguuuagagcacaguccccgucccuuaggccccgucacaggcucuggaaccaccgucuucucaccauagucaggcuugggcuggacagugcggauacgcagguacuggcggaagagcgucaccgaugggugcuccuccucgggacccuugcuggucauggcgcugcgcguggugagcugggggcaaagugaauggcuaacuaccccuccaagacccuggaaauggugagcuccugcacacagccuguccccacggcggcucccggacuucccacagggguaggauaccguguuucggagcccccauuaaggagcacccauucuguuucaggcgcugggcugucugcuuccagcacauuuccuuauuuaauccccaaaagagccccaugaaguuugugcucagaaugcccacuuuacagaggagaaagcugagaggcucagagagguucaaggacagcucauagaguagcugagcaagguuugaacccagacuuguacuccccccgcccuccuaaaaaaaaaaaaaggcaaaaacaaaaacaaaaaacaaacaagaaaaaccccaacgccucccaguugcccggcuuucaagccacggagccccagucccucuaucccuccccagggcccccaccucacucuccugucgcugggcucacgcucgccucucagcgcccuucccugacuguggccuggacuuaggguccagcgaggucgccugcgaggucgcaggcucaggaccgccccgguccgcccaccacguggccgaggccggaugucggggcggagaccgaagaccgucagugagggccgucccggcgccagcggccgcgucggcgcggau

SEQ ID NO: 16110 - RNA, 5808 nt, Homo sapiens
auccgcgccgacgcggccgcuggcgccgggacggcccucacugacggucuucggucuccgccccgacauccggccucggccacguggugggcggaccggggcgguccugagccugcgaccucgcaggcgaccucgcuggacccuaaguccaggccacagucagggaagggcgcugagaggcgagcgugagcccagcgacaggagagugaggugggggcccuggggagggauagagggacuggggcuccguggcuugaaagccgggcaacugggaggcguugggguuuuucuuguuuguuuuuuguuuuuguuuuugccuuuuuuuuuuuuuaggagggcggggggaguacaagucuggguucaaaccuugcucagcuacucuaugagcuguccuugaaccucucugagccucucagcuuucuccucuguaaagugggcauucugagcacaaacuucauggggcucuuuuggggauuaaauaaggaaaugugcuggaagcagacagcccagcgccugaaacagaaugggugcuccuuaaugggggcuccgaaacacgguauccuaccccugugggaaguccgggagccgccguggggacaggcugugugcaggagcucaccauuuccagggucuuggagggguaguuagccauucacuuugcccccagcucaccacgcgcagcgccaugaccagcaagggucccgaggaggagcacccaucggugacgcucuuccgccaguaccugcguauccgcacuguccagcccaagccugacuauggugagaagacggugguuccagagccugugacggggccuaagggacggggacugugcucuaaaccagccuccaaccccugucacccagcugagccccacucugcugucccaaauggcuccccaaccccuccagccauuccccaaguaaauagacugaggcagccccuccagguuagggaggaacccuuuccccagagacucugcugcugaccaagguuacuccuggcagcugguuaaagaaaaacuucaccucacucuccagggcaggaguggugggggaagccugaggcagccacagggaaaggagaggcccuccagaagcccacuggggcuggacaaaggccacagcccuuagggagucaagcuugguggcuagggccugggagguggcuccugccuguuaucccagcacuucaggagguugaggcuggcagauugcuugggcccaggaguucaagacuagcuugagcaacauggcaagacucugucucuacagaaaaaauacaaaaauuagucaggaaugguggcacaccuguagucccagcuacuccagagguugaggugggaggaucgcuugagccugggagguugaggcugcagugagccgagaucgcaccacuucacuccugccuuggugacagagugagacccugucucaaaaaaaaaaaaaaaaaaaggaaaagaaaaaaaaaaaacuuaguggcugggaauuguguacauggguccaaauuccuccucugugauuaaucagcugagagauggugggugaaucucuucaugucucugugccauaguuucccauauuuaaggaagauaacaccuuccuccaacccuguguccagacaucccccuggacuuccagaaagggucacugaguagccaaaaauaucuucuuucuuggggauggaaaugcaagcaucucugagggauauggagugugucggggaggcagcagcccauuucuggguaugcuccacucuccgggcugccugggcuggugggaagcuguggguaggcagaagcagccccaagacacucugugccuccaggagcugcuguggcuuucuuugaggagacagcccgccagcugggccugggcugucagaaaguagaggugagccuggggcccuaagcggggaagggaggugggccugggcacuuccucacccugcucagaccaccuacccuccugaccaucuccagguggcaccuggcuauguggugaccguguugaccuggccaggcaccaacccuacacucuccuccaucuugcucaacucccacacggauguggugccugucuucaagguguguaaggggcuggggaggugggcagugcaggccuuggggacagacaugaugcagaccccaggauucaaccucaaguugcucaugguccuggccccaguccugacacuaacucucaacauccuuaugacauuacaccacucaagcagccuucauccagcagcaaguucugggccagagugggguggggacuggggggugggaagcaggagacagcaaugggggauggcaaucagcugccuucuucagcccccgucuuuccucucccaccacuccaccugucacuccaacccuauggugggcuccuagggcagggccacuguugaccagaguggauuaauggcuaaauuugggguuugggccccucuucccaucccugcccccaggaacauuggagucacgaccccuuugaggccuucaaggauucugagggcuacaucuaugccaggggugcccaggacaugaagugcgucagcauccagugaguguccuccauuccuacuccuccacaauguccccacugguccaguggauugaagcaggaccugagggggugauuggagaaacucaaggccaaggaacaccgugaccucuuggacaggaacuacugccaugaccauugcauggauagggagauucagaccagagaggggcagggacuuucuggagucccuaucaggguguggcaggguaaaguccaggacacaggacuccagccugcuggcccugccuguggggccagccugcgcaucugguggcucccccagcaccuggcuuaugcccccucagguaccuggaagcugugaggaggcugaagguggagggccaccgguuccccagaaccauccacaugaccuuugugccugguaggaguggcucagauaccuuugggaaaggggaggguggggcggggcagccuccucaucucacgucccugcugcuuuuacagaugaggagguugggggucaccaaggcauggagcuguucgugcagcggccugaguuccacgcccugagggcaggcuuugcccuggaugagggugagcagguuggcaagccaaugagcagccaggcagggaguaggaggcugcuaguggggacugagcugcuccacccucugaacccccuuucccuccucaggcauagccaaucccacugaugccuucacugucuuuuauagugagcggagucccugguguaaguaugagcuuggagggagggcucacucuacaggcgggaggcuaggccagaaagggcacgguccuaugcaggguugcacagcaaaguugaggccugagaaggccuugaacccagggccucuaccucccagcucuuuccuaucugagcuucucugagggcaagcccugaaugggcagaaaccagcuguaugcuacgggcccugaguggggacaggacccugccagaggagccuggaaugagggggagaccugggcccaccccaggcugauugugucuccagccccucaggcugaagacacugccuucccccuacaccuccccaggggugcggguuaccagcacugggaggccaggccaugccucacgcuucauggaggacacagcagcagagaagcugguacguggcaccccaggagggagucugggaguucaggaggcucuauccugaggccacugucccauuuaaccucauauucucauagcacaagguuguaaacuccauccuggcauuccgggagaaggaauggcagaggugaggcagccugggaggcagugggguggcucugggaggcgguaccacagaggauagagucugagccaccucuuuuaucuguugcugccgcuacccugcccccacaccacaggcugcagucaaacccccaccugaaagagggguccgugaccuccgugaaccugacuaagcuagaggguggcguggccuauaacgugauaccugccaccaugagcgccagcuuugacuuccguguggcaccggauguggacuucaaggugccaccuccaccuggguuuggaggagggauccuggguccucagucuuguccuagaggccucuggaaagccugaaggaucagcucgucucccuucucuuaggcuuuugaggagcagcugcagagcuggugccaggcagcuggcgagggggucacccuagaguuugcucagguauggacuugggacaugugaugggagagugugggagccgggggagacccaagugugcaacaguggagugugugcuuggugugucugcauaugucugggcauuucuuuaucugugacagacacauuuuauuccaacaagcauucauuguagaggccacugugggugcuggggaaugcuguggggaguaaaauuaggcacaguucaugcccuuguauggugaaacggggagauauaaaucaaacauuuaugugauauuacuuuuuucugagagaaucucacuccgucacccaggcugcagugcaguggcacaaucucggcucaccuccgccucccggguucaagcaauucuugugccucagccuccagaguaguugggauuacaggcaccugccaccacgcccagcuaauuuuugcauuuuuaguagagacaguguuucaccauguuggccaggcuugucucgaacuccuggccucaagugauccacccaccuuggccucgcaaaaugcugggauuacaggcaugagccacugcgcccagccguacuuucauauaacccaugugguacaggaaaggguggccccuugcacucugaaaaccuguaacuggaguauccaacuagucugagaggucugggggagccaucuugaggaaggggcacuugggcuaggaucugaaggauggacaggagguaaguagacggagggugggaaggucccagaccuaggacauuugaggggcugaaagaggaccuguggcuggacuggcuacccagaugucuggguaggugaaggaguggggguggggagguguuauguacuaggcacagcccacucuaugggaaauagggcaagaugcccaggcccauguccugauccugccauucuuccugucccucagaaguggaugcacccccaagugacaccuacugaugacucaaacccuuggugggcagcuuuuagccgggucugcaaggauaugugagcacgcuggccagcucuccucacagcccagcccccuacuccucuccuuccugcugcccccucccuucucccuccuucucccaccucuuucccaccuuccuuugccccuucaauucuucgcuuucucccuccccauucaucaggcucuuucuccuacaggaaccucacucuggagccugagaucaugccugcugccacugacaaccgcuauauccgcgcggugagccacuugcauauagugccugggcaguggacugggccugagugcuggcuuuucccuaacggcucuuccucaccccugcaggugggggucccagcucuaggcuucucacccaugaaccgcacaccugugcugcugcacgaccacgaugaacggcugcaugaggcuguguuccuccgugggguggacauauauacacgccugcugccugcccuugccagugugccugcccugcccagugacagcugagcccuggaacuccuaaaccuuugccccuggggcuuccaucccaaccagugccaaggaccuccucuucccccuuccaaauaauaaagucuauggacagggcugucucugaagu

SEQ ID NO: 16111 - RNA, 6722 nt, Homo sapiens
gggcagcccggcgcuagacccaacggggauccaagcagccccggggagagggaggcugcgucuguauccgggcccaaggucaccgcgcgaccggcagaugcgugcugcaggccccggccacaugagcagcgcuacggacgcgacugccccggccuuggauaugccagaucgaguguccacccguccgugggacuggucgccugacucggccugccccagccucugcuucaccccacugguggccaaauagccgaugucuaaucccccacacaagcucauccccggccucuggcgauuguugggaauucucucccuaauucacgccugaggcucauggagaguugcuagaccugggacugcccugggaggcgcacacaaccaggccggguggcagccaggaccucucccaugucccugcuuuucuugggugaguguccuaugguccugcccacggcagggcagggcaaggccuggugggacuggccuuugcccucuaucaguucaaggccacugauccggaguucuggcuccucagaacucuugaguccauugggaagggcuucuacagcucuggguucuaagcuccgggaggauaaucuggccccaagaauccugcccccaggauccucugcccacccucccccauagcucggugacucggcccggcaaccaugccagggcugaacuagcugacacagggggaggagccccgaaguggaagagagagagccuccuuucacuuucccuaccccucaggacacacaggugagcugcagaggguagggagccaggcagacccuguugaccagagugggcagacuggacagaguccuaaccuugcacuugggacuggggaaagggguguuucugagugacaaagagcuggguguggucuggggcugggaaugccgucagaguggacacaggaugcagugggaggccaccgaagggccaacccgggguggggcaaguuggugcugugcuggcccagggcagggguggggacugagagugggucguuggggaugaggagaccauggaggccuaagggccucucugugccccaggacagccauggcuccaaagccgaagcccuggguacagacugagggcccugagaagaagaagggccggcaggcaggaagggaggaggaccccuuccgcuccaccgcugaggcccucaaggccauacccgcagagaagcgcauaauccgcguggauccaacauguccacucagcagcaaccccgggacccaggugagcugcaguccccagucaggcccagagccugcccacugauaagcacaaacacacccaggccacccccuuaggacucuguucugguuuuggagcccaaggcccccagguaagcgccagagcaaggccauguucuccugaccccagacaucagggcugugucccgucagguccaggcgggucacaucugcccuucagaccccaugcaggccuccucccaccgcacuuagggaaaggcugugacuacaucagucuccugggcgcuugcccauguccccucagggcagagccaugucccucucagauucccccauccagggcccagcugugucccccccagcaccccccauaccuccaugucaggguuuagccauguccucucacaccgcauccccuagggaagagcagugacccccccaagcuuccaagacagggucccucugacucccacugccgucagacuccuguccccaucagagcccucucgguguacggccaggcaccccaucugaccccagccagccugccccccaccuccccucuggcccagguguaugaggacuacaacugcacccugaaccagaccaacaucgagaacaacaacaacaaguucuacaucauccagcugcuccaagacagcaaccgcuucuucaccugcuggaaccacuggggccguguggugagugcccugccugcucugcacauacuccccaggguccucaaaaggccacagcuacugacuugggggggcaccucccaacugucccagggcacucagcacagggccuggcccgacacacaggccagcaaaugcugauggugggcauaccccugaaggcugucgguugcagggagaggucggccagucaaagaucaaccacuucacaaggcuagaagaugcaaagaaggacuuugagaagaaauuucgggaaaagaccaagaacaacugggcagagcgggaccacuuugugucucacccgggcaaguacacacuuaucgaaguacaggcagaggaugaggcccaggaagcuguggugaaggugagauggccaaggaaggugggcaggcccuggacugagggaggggacucguuggagaguucccgcugguugggcucugccacugcccagcugcgcagccucagccacagaacuccccucuggccucaggcuggcuggucucugucuggugucacgcccugccccgcugcuccugcccacaugugcccucuaucuucagguggacagaggcccagugaggacugugacuaagcgggugcagcccugcucccuggacccagccacgcagaagcucaucacuaacaucuucagcaaggagauguucaagaacaccauggcccucauggaccugggugaggggugagaggcaggcaggguggcaggggccucaggguggcagggcuguggggcugagucuccccacuccccugucccccuagaugugaagaagaugccccugggaaagcugagcaagcaacagauugcacgggguuucgaggccuuggaggcgcuggaggaggcccugaaaggccccacggaugguggccaaagccuggaggagcuguccucacacuuuuacaccgucaucccgcacaacuucggccacagccagcccccgcccaucaauuccccugagcuucugcaggccaagaaggacaugcugcuggugagggcuggcaggggugcgggcaggcaguggggcacugaacagacagccuaggcgagcgagaugaagggcagguggccaagaaggcccagaaggauggacugccugggcaggcugacagacggguggggaaggcugggcagacagauaggguggggagggacaggugggacacacaggugggguggcuacaauaccagucaugugagagaggagaggggaggccagaggucaagugggaagacaaacugccagggcccaucauccuaggugcuggcggacaucgagcuggcccaggcccugcaggcagucucugagcaggagaagacgguggaggaggugccacacccccuggaccgagacuaccagcuucucaagugccagcugcagcugcuagacucuggagcaccugaguacaaggugaguugggccccacagaggggccaggcuaucagugggcacugucccucugcccaccugcccucgaggugcccagaggaauacucgcccucagccuucucuuccugugucuccagggccugaggagggcuugggacugggggaagaaaaaugggggauuagcuccugagccucccacccuggcaaccagcuucugcucuccccacaggugauacagaccuacuuagaacagacuggcagcaaccacaggugcccuacacuucaacacaucuggaaaguaaaccaagaaggggaggugagggagguucccccaccucucccccaucaccacugugccuuaggaagauguccuuggcuaaucggucccuuagcaaaucguuuagcagcucuggucaguuucugccggccaugagugcgcgugaguaagcagagggacacuaggccuuggucacaagcagcagggcaaggcgacugagugcucggguggcaucacucccauuucucacuuccucuccacucaggaagacagauuccaggcccacuccaaacuggguaaucggaagcugcuguggcauggcaccaacauggccgugguggccgccauccucacuagugggcuccgcaucaugccacauucuggugggcguguuggcaagggcaucuacuuugccucagagaacagcaagucagcuggauauggugaggugccccucugggccaagcccugggaggguuggcacuaagauggauugggcccaguccuuggccacuggaaauucauggugaauccaagagaggaauccuuuaaugguuaaugacuacagugcucagugggcuguccugggcuuugguggcggggggucuuagagaaagugucugauggucagggauggcuuccugggggaggcaauacagauaggaugggugcaccaaccagaccugggaggggguaaaaggggagccuuugagccaggugugguggcauacaccuguaguuccaucuacucuggaggcugaggcaggaggaacgcuugagcccacaaguuuaaggcugccaugagcuaugaucacacuccagccugugugacagagccagacuccaucugaaaaaauaaaaauaaaaaagaggagacgucaaggcaaggggauaggcagagaggcugggaggaugugaggauguggcaggucagggcuuccaaacacuuccugauacuggagcucagagcaaugccuagccgggggcagggugggcuaggggcccagaacgaucgaggaggcuuuauccagagagugaugguuagcccagcuggacuugucuguagcaggaucccaguggcuacagcuguggagaggggggcagcagccagaggcugcagagaggccauccucuuauccaggcuggaugugaugggugccuggcccaagggcugggaagugcaggggagggagcccaugagaggggcauguaggagaugggauggggagcgugugggaaagggucaaggcugucuccagugacuucugaguuucuggccaggaguguccucaccaaaaugacccccccagaccagcuccuccacccaggcuguccccaucauuggaggccaccacccagcuggccaagagagcaaggaccaaggauucaucccagaacagauggggcugaaguucuaggaugccugaggucaccaagagcaagggguccaccaggagggcagaggggcuuaggaaagaguggcgggguggagggcuuaggagagccagcgcgaggaagucccagguaggggcugaugaugucaggagcaaagucagcagagcaggccagggagaaaagccccugccacggguuuggucacugggaggccauugcugaccuuggugaggacagcagaggguacagaugccuggccauagggagcacagugaggugggagggagcaggccgggacaaggagggagugacgguugggggagagugagccuuuucuugcuggagcagcaaagccagaaggaauaacaucgcagcagagaggggccccacaggucagcaggaggcaggcugagcugcccaccggugccucccugugucuugcaguuauuggcaugaaguguggggcccaccaugucggcuacauguuccugggugagguggcccugggcagagagcaccauaucaacacggacaaccccagcuugaagagcccaccuccuggcuucgacagugucauugcccgaggccacaccgagccuggugaguccucagaagcuguacagcccaaggagagagguggggccgagauaggggcugggacauuuucagggagggggcugugaagagggacaaaaagaagcuucccugucgucacucaguuugucauuugacaaacauccacugguucaacacaucauuccugggcaucccggagggcuucaaaaagaggaguuguugacugagcauugaaggauuaguacaaguuucccagagagaagucggggaggacaccccaggcagaagccccagccccugcagugguuuggaggugggcaagguggaaaugagcaggcgugcccugugacagacauggagagcauagggggcaggacuuacucguaaggccugggaccagugaccccugggccacccuggcccuugcugugcccugcagauccgacccaggacacugaguuggagcuggauggccagcaagugguggugccccagggccagccugugcccugcccagaguucagcagcuccacauucucccagagcgaguaccucaucuaccaggagagccagugucgccugcgcuaccugcuggagguccaccucugagugcccgcccugucccccgggguccugcaaggcuggacugugaucuucaaucauccugcccaucucugguaccccuauaucacuccuuuuuuucaagaauacaauacguuguuguuaacuauagucaccaugcuguacaagaucccugaacuuaugccuccuaacugaaauuuuguauucuuugacacaucugcccagucccucuccucccagcccaugguaaccagcauuugacucuuuacuuguauaagggcagcuuuuauagguuccacauguaagugagaucaugcaguguuugucuuucugugccuggcuuauuucacucagcauaaugugcaccggguucacccauguuuucauaaaugacaagauuuccuccuuuuuuaaggcugaaugguacucuguuauguauaugcaccacauuuccucuauccguucaucuaucaguggacaccaagcugcuuccauaucuuggcuauugugaacagugcugcagugaacugggaaagcagacgucucuuga

SEQ ID NO: 16112 - RNA, 9946 nt, Homo sapiens
ggcuuuggagccauggcuguccuggggcacagagaggcccuuaggccuccauggucuccucauccccaacgacccacucucaguccccaccccugcccugggccagcacagcaccaacuugccccaccccggguuggcccuucgguggccucccacugcauccuguguccacucugacggcauucccagccccagaccacacccagcucuuugucacucagaaacaccccuuuccccagucccaagugcaagguuaggacucuguccagucugcccacucuggucaacagggucugccuggcucccuacccucugcagcucaccuguguguccugagggguagggaaagugaaaggaggcucucucucuuccacuucggggcuccucccccugugucagcuaguucagcccuggcaugguugccgggccgagucaccgagcuaugggggagggugggcagaggauccugggggcaggauucuuggggccagauuauccucccggagcuuagaacccagagcuguagaagcccuucccaauggacucaagaguucugaggagccagaacuccggaucaguggccuugaacugauagagggcaaaggccagucccaccaggccuugcccugcccugccgugggcaggaccauaggacacucacccaagaaaagcagggacaugggagagguccuggcugccacccggccugguugugugcgccucccagggcagucccaggucuagcaacucuccaugagccucaggcgugaauuagggagagaauucccaacaaucgccagaggccggggaugagcuugugugggggauuagacaucggcuauuuggccaccaguggggugaagcagaggcuggggcaggccgagucaggcgaccagucccacggacggguggacacucgaucuggcauauccaaggccggggcagucgcguccguagcgcugcucauguggccggggccugcagcacgcaucugccggucgcgcggugaccuugggcccggauacagacgcagccucccucuccccggggcugcuuggauccccguugggucuagcgccgggcugcccauggaggggaggagucacguuccagaacgcgaaagggcgccgcgucucuggcgccccccagcggccaaggggcgcaaacacagagaaggcucuugcuccgacuucgaagugggccagcagcagagcgcaagcgccacagcaucaggccggaagcgccguggagaugcgggcuuccuacucgagccuggugcgggagccuaggaacuucaggaggcggggcuacaagcgugcauccuaugggugccugggggcguggcagagccugcagaaggacccaauggagcaguaggaggcggggcccggcgggcgguggaagccuaucaauacgcggggucuugccaggcggcuggggagcugggaggguucagcugccacgugaguucugcggccgcugcuacacgccuggugggcagcaugucggcaacagcggcugcucguaagcggggaaagccggccucuggggccggggcuggcgcgggggccggcaagcggcggcgaaaggugagcauggcgcuucugagggccgcggucagcccugcuacugggacaaccgucaucccauccaggggaccugggucccggcccuuccccagcccuucgcccuggaccccugcuggagucagcuucgucccucucuccgcgggccaaauccuagaaagccguucgcuuaacccgggaaccaccgccuuccccauuccugggguucugagggaaccgaggggggggggcccuuggucaaugccaggguggucuggaccccugaccaaagaaaagaccguauaauucccaggccgacucugcgggggacaggggcaaauccaaggguggcggcaagaugaaugaggagaucuccagcgacucugagagcgagaggugagcuauucuuuuccacauagugggagggaaaacugagucccauggugcacggaagacugagugaguccgaacagaacugagccuagaauccaagacucugucccuuggcucugagaucguggcuguuuccuuuaguuucugguccugcaaagucuuguuucugcgaggucucugggugggaaggacccugggccccaauccgaggccauugagaccuccuuagguuuuggcagggacuggacugauugagaaauugcaggaaaacagaacaaagcugucaaguauuucuugcauccuucuucccuugccaguuuuccugcaauuucacaauuacugggcuccccgucucuuaacaugccaggcacugccuuugcuguuggaagugcagagauaggcaggcgggugaagagaguguguuguagugagguguguauuuuauaguuguguguucugggaacagaggagggacauuuaaauagggucuugagagaugaagaggagucucucacggagagguagggaaggcauucagugaucagaggaaagucugagguguaagugugccagaaugggcaguagaaaagaugaaagggggcugggccugguaacucaugccucuaaucccagcacuuugggaggccaaggcgggaggauugcuugaugucaggaguuugagaccagccugggcaacauagcgagaucuugucuguacaaaaaaaaaaaguuagcuggguaugguggugugcaccuguagucccaacuacucaggaggcuaagguuuggggaucccuucccagggaguugaagcugcagugaacuaugaucaugcacugcucuccagucugggugacagcaagauccugucucuaaaaaaaaaccacacacaaaaacaggaggacuggucauaagugcauguagauuguagagggcuuuggaugccucccucauuucugcaggugaugggugugguugcuugcagguuuucaaagggucaggcauggugucaggccugacccuguggguuggaggcucuuggaccagagaauccuagugccuucccuaugaguugacuuuagaacucgcuucuaaaauugaguauguguugccuuaauuugcucauggaaagaauguacuuuuuuuuuuuguuuuugagacagagucucacucuguugcccaggcuggagugcaguggugcgaucucggcucacugcaaccucugcuucccagguucaagugauucuccugccucagccaccugaguagcugggauuauaggccugcaccaccaugccuggcuaauuauguauguuuaguagagauggaguuucaccauguuggccaggcuggucucgaacuccugaccucaagugauccgcccaucuuagccucccagagugcugggauuauaggcgugagccaccacacccagccauuaauguacuuuucuuaauccgaagguuauugugggugagugugugccaggcuagugugggcuaagugcuuuuaaauauuuuuagaauguuguguugugaaguguguuagauacagaaaagugaaugagauauauuugcacuacagagaguaaugguaaaaugguaaaccucuguacacuuacuuaccacuuagguuaagaacuagaacauuugcagaaacuuagaagccgcaacugucauuccuaacuugaguuaaucauuucuuugguuucuuuguucuucuuuuaaaaaauuaacauuuuccauuuagguauaauuuacauauaguaacaugcccuuuuuaaaguuauaguucagugaguuuugacaaacacacacaguugugugaccaccucuacccugaagguaaagaguuucaucacccuccagaacuccuccugcuccuucguagucagccccucuccuuccccccaagucucugcuaaccacugccccuagaguugugcauuuucuagcaugcccuguaaauggaaucauaguguguacuucccuugcauuucuuuagcguucugucucaugcguaugaauccuucaacaauagauuaauuaguuuggcuaaauugaguagaaguccgaaguuaacacaggucccuuggcuguguaagggaagggcagcacuagcccuguuggcugaaggcuugccaggcacagggcacuaaauuauuucuggggcaugguccagcuuuggcuuuccugagaguuuucaaggucccuucuggggaagucaggggcagguuuacgagugagucuugggaaacacgguuaggggaguggacagagacuagaugucuucaggcacaugaucagagggagugggcugccuuggauucucugugucugagugcccaugaccuacccccagcucccaggagcaggucaaagcagcaccugucuuugggugaagugaguacucucagcugguccgggggcuggggcauggaggggaaagccguaacuucaccaguaaaggccaauccccaaacagugaagguucgcuuggaaccuuguucccaggguaaaggauggugcuguggugaugacaguccuggugugucugccugguggguccuuggaucugauccagacugcccccgucaugucuggggauagugucacccuuucugcucucuugugucgcaucucugguuuccgguaucccuugccuuucucuuucccaguuuacccucuuguuugggagcacagcuucuauccuuccuaaagaaaaagagggagaaaauuccauggcaccuugcacaccuggcagugucgucguugauuguuugacugggcauggcauuuuaggggucaguguauuccuccagagcuuugugugugaggcuucuuugucuucuuguucucaguauugcuguugagaugccugcacauuuugauuccugacucuuuguaugugaccugauuucuuuuggaagccugguuucucuuggaagccuccucuuucccccagaguugagaggcuuuagugaucucuuugggauuugggucuguuuccaccccuacguggggcacugaguggggccuuuuaguuuggggagucacauccuucaguuuucugcaguguagucaccgaccaugugggcuagcagggaauaggggagguuggauggcaaggugagcauccagaaggcacgauccuagcggucagaggaacaaggugagccccucagacccagccccuuccugcccacagccuagcuccaaggaagccugaggaggaggaggaggaggagcuggaggaaacugcacaggaaaagaagcugcgcuuggccaagcucuaccuagagcagcuccgucagcaaggugagccagugggcaggccagccaugggcagggcuucugccugugcuggucugcugcccgccgcugcagccccagccacuugaugggugacugacauggauucccagugggugcccaggcugucagugcuggcugcccuguggggguggccagaagcucucaugggccuccuggggagcccgcagggggcugaucugauaaguaaaggcaggaggaaacccuccagcuugcccuccccucugcugaggcagcuggagcuuccugcauuauccagcccuggggcagugggauggggacaggauggaagggaaagaggggucucagccucaguuuacuuggucuggucuguccugcacagaggaggagaaggcugaggcccgugcauuugaggaggaccagguggcggggcgccugaaggaggaugugguaaguguggagggagaguugggggaggacggggguggagcugaucugcucccagggucucauccaucucuucuccaugcagcuugagcagaggggcaggcugcagaaguugguggcaaaagaggugagugggcaugguauuuugguauaagguuggagggaauugggggccccacuuggaacaugguggacacuugggccuaucuggucagguaaggaucugguuguuguagccuugggucuuguuuuccuucuggccugggugggaaaggccaacacuacgcagugggguuggugaagguagugccuuuaugccacuagccacagugaccuggccccugucugcccagauccaggccccagccucagcugacauucgcguuuuacgggggcaccagcucucuaucacauguuuggucgucacccccgaugacucagccaucuucucugcugccaaagacugcagcaucauuaagugugagugagugccuggguggggcuggagcccccauggcggauccgggagggcuggucaggggagugggaguggucauggcaggcugagcccugaaguggggaagucucuggaggcagguuugcugcccuaggagugcucucugggugacagugaaagcugcugcccggcaguggggcuuaugagcucccugucccuagagaccuuugggcaaagucaggaugaugauuuaaugggaauuaaugcugcagguaggugguuggacuagaagacauuugaggcugugcaguccugggauugagugcccgguccuccuggguucccauccguugcuggcugaccagcgguuccuucuacacccgcuguaguaacagaagaacucacaccaucaaucccaaagcccuuuuacaucccuucucuuuuuugggcuuuguggcugcuguuuggcacuaaugucccucuucauagaugaggaaacugaggcagcuuguccggaggcucacgguggcugagccaggucuucuggccgaguccgggacauuugccauggcucuuuuuuccaugcugccccuugagggggguugccagccagcccuauccccccaucccaguagcuucucccccacccccaacugcagggagcguggagaguggacggaagcugcaugugauuccucgagccaagaagggugccgagggaaagcccccuggccacagcagccacguccucugcauggccaucuccuccgacggcaaguaccuuguaaggccagguuggcccugggggcaggcgggaggucuggugcauggugggugccugugaucauugucuucaucccugcaggccucuggugaccgcagcaagcucauucucauuugggaggcccagagcugccagcacuuguacaccuucacaggacaccgggaugcagugucggugaggagcugggucuaugucaguggaucuuuagugggcacaugcuaguguucuaggcucagugcuggccucuggagucucuguccucagggaaccugcauccugggguagcgaguggguagcgaguggugcuguaaaauacauaaaugggcuaaagggauggggaggagcugggggagaccgggccgagcuugcucaggaaucaacgagggccuugagaagccgccucugggcgggauguagcggcucuugccuauaauccuagcacuuugggaggccgagauggaggaucaucugagcccaggagauggaggcugcagugagcuaugaucgcaccacugcacuccagccugagcaacagaaugagacccugucgcuaaaaaaaauaaauaaauaaaaaagacgucugcaucugcucaggggcagaugggcaugugggcaguacaaaauugccucacagcacgugccacauggcuugcuuuuugggaaguccucccugggccugaccugucucucgccugcuguaguccagguccccuuugcccucuccccaugcacccuuagggucuggcauuccgcagaggcacccaccagcucuacagcacaucccacgaucgcuccgugaagguguggaauguggcagagaacuccuacguggagacgcugugaguguggaugggagaggguguguggauggugugagagagggugugggagugugugcccgugaguucaugcaguaccccuauccccacuauccugcucugcccggcccucuagcuucggacaccaggacgcuguggcugcacuggaugccuugagccgggagugcugugugacggcugggggccgggaugggacuguacguguguggaagauccccgaggagucccagcuugucuucuauggccaccaguaagguggccugccaugccagugggggcuacaugggcugggggugggcuugggccacgcuccucacagccccuuucuccaggggcuccaucgacugcauccaccuaaucaaugaggagcacaugguguccggcgcggacgauggguaagagguccuuuggaugucucuggccacggcuucugcuccugagugcuggcuguccacggggcccugagcuugccucagggcacccccagugggggagcuguuguaaccucuuuucauggaugaggaugaugaggcagagagcucagauggccuuguccgggcugugugcccuugaucccuuccugucauguggccuuuuuucuuuuuuuuuagaauuaaaaaaaauuuguugugggugcuuaguagguguacguauuugugggguacuugagauguuuugauacaggcaugcaauauguaauaaucacaucaugggaaaugggguauccauccccucaagcauuaauccuuuguguuacacagggggccuuuucugccucuggcccccucacugcuguauucccucccuguuuauagcucuguggccuuguggggucucuccaagaagcgaccacuugcccugcagcgugaagcucacgggcugcggggagagccaggccuggagcagcccuucuggauaucgucgguggcagcccuccucaacacagaccuuguggccacaggugggugcccugagaggcagggaggaggggucgccgggugggccggugcagggguugcucacuguuccagucuccccaggcucccacagcuccugugugcggcuuuggcaguguggggaaggcuuccggcagcuugaccuucucugugacaucccccuggugagugagugugcuugaaugcucagccugucucugccacacugccuaggccccuggaguuagcucuuuaaggucuuucuuccugccagaagggaaccuucucagggcagggccagcuccuagcacagggccuggcaggaacccuccccacuuucccuccucugcuccccuuccuauccuaggcccuguccagggugcugggguacaagucagggagcagcauggggagaggcauggaggccuggcccugugaugaauucuguacugcuggugccagauugggugccaggcuagaggguguggaccucacuguccacacuagggugaccugggggaggguggcaggaucugucagugaugugugcugagaaugcagggucuaggucaguggggacagucauggggucuccagggccccaccaccaggagccagccucaggccauacuggguguacacugccuccuucauccucacaaacucacugcuagccccgugcucugcuuacccccaucucgcagauguggaggcugaggcccugacaagugaagggcuggccugugucaccagguggcaggaggcagagcagggauuuaacccaggccugauaaggcccagcccuugacugugaugcugaggacggugguggcggggggcguucuaaugucuuuccguguugucuuucugcucagguggguuuuaucaacagccucaaguucuccagcucuggggacuuccugguggcugggguagggcaggagcacagguauguguggcccucgaggguucagguaagguggugcaggcuggacagcucgguggaaaugggguggagacugggccgagucucagcugcgucuugcacucccugcaggcuuggccgaugguggagaaucaaagaggcucggaauucugucugcaucaucccacuccgcagggucccuguacccccagcugcugguuccugacacucuuauccuccuuauuuaaguccuucccaggcuaugccccacccucuuuguauuaaaagccuccucuuuugggccuugu

SEQ ID NO: 16113 - RNA, 33155 nt, Homo sapiens
auccaggugaaacaaguaaaucauuggcuuuauucuggguccuggaagcuccacugugagucugaaaaaaagacacaacagggguggcagcccugggggcuggugcagaaaauagucccuggcuccucuggcccugggagccuaaagggcagugaggagaaggcuuagcaagaggccuggagcaggggaagucaggucccucaggaaccccuccucccccagaggaaggaggaagagggcuggagagucugcuggagagucugcucaguuccucagcaacugcacugcaggagggugcaggccauggguuacuccuugcccuucucaggggcagugggcucccagagccacuugguaguccccaggggcucagucccaggguccagccgugacuccccuaagggccccucgcccuccaaguccagcuccucaaaagaggagccgcuggcaccugacucgcuguagcugugcucgcugcgggugucaccgucaucccagccacggcugcucgccccaggugacaguguggcagcugaagucucccggcugccagggcucacuuccaagcuuacagaacucgugucacucauugugucagcuccuaugaccaggaaaagggagcacagguuagcuaggaccaccccacccccuccuccagggagaggcaacucagcacgcagugcacucaugaauaaugcagccucccgggcucagggggcuugcuccagcugcccucugcccucuacccugacuggggcugcacagacagggcagagggaaagagcugggaggaagggagggagggaaggagggagggagggagagagggugggaggaggcagcugugcacucuucuccccacucuaaauuagccucagcucccugcacuuccacaaagccugcugcccuccccccacauuuauuaagggccacucagcccugaggugaggagcugagguagaacaaagagacacaaguaguguccucuccaccuucccccacccccacuucaagcuuggaaagagauguguccagggccagcuacagaacaucacccacagggcacgaggacugcagaaugcagcaggaggccccucugcagcccucccccgugcagggcucccaggagcagcauccagggagucagcaggccccugccucugguacacaccaagucccaguugaggagggagcugaaguacgaggaggauggagaaggccugagaaauacucaaccagcugcaaggaggagggugcugggaugaaacauguuaaggguuuucucucccuaugccugggucgacccugagaaacccuuacccaccccacccccaaugacuggugcuuccugagccacaagauagcaaaaggggaugaugagagcacucugcuggugguuggggugccccaaaccagugcugagccagguugauggcccaaacuccuucuaaccugcuccuuccacccccaauacauccuccaagcaagcagccccuucaucugcccuguccaggagcaaccccuggguucaucucccuggaucagaggcacugaaugcaggcugggguggcaaggaggaacacauggcucaggcucgcugugugcaggaauccagacugggagaaaguggaucugcuacccuuccuguaugauggggagagggucagcugucaaacaucacagaaggugagggguuagccagcuuccccagccacugucuccaugguguuggagccaagccaggugcagcuggggucugcuuggcgccuggacucagccuggggcuuuccuugagccucaaauggggccuagguugggggugggagaauuaggagaggggggaauuuggggucucucccuacccccaccacccacucagcccccagaauaugcccucugggcgcuacuggcagaggugaggugagcccuagaagcccaggcugcuggcccagggcccuccucuugcugaggccccagguguggcucccaggacagaagccugugaaugagguggucagggagcugggggagcuuuaaguuuuggguaguuucuucugaccaggggacaggaugccaggcccucacugcuccuuaaauaaugaucagugccccagggaccgcaggccugaaaagagcaaaggagggagacaguuucucccuggcccuauuaaacuguauguucugucugcccacccacccaauggcucucuugggaccccagguauaggaaugugccugcuucccagcaugcuaccuccuaccacccagcuccuaggcuaggaauguucagaggaaggagccuaggggugccuccuucaggccaggacagccugcugaaaugaagacagccccuggagacauauauacacuucaagcaaaggaauucagcuggaggccaggcacgguggcucacgccuguaaucccagcacuuugggaagcugaggcagguggaucacaugaggucaggaguuccagaccagccuggccaacauggcaaaaccccaucucuacuaaaaauacaaaaauuagccgggcaugguggcaggcaccuguaaucccagcuacucaggaagcugaggcaggagaaucgcuugaacccacgagguggagguugcagugagccaagaucaugccauuucacuccagccugggcaaaaaaggaaaacugucuuuaaaaacaaacaaacaaaaaaaaggaauccagcugggcaugguggcucaucccuagaaucccaacacuuugggaggcugaggcaggaucacuugagcuaacaaguucaaggccagccugggcaauauggcgaaacaccaucucuauaaaaaauacaaaaacuagccaagcauggugguacacgccucuugucacagcuacucaggaggcugaggugggaggacagcuuaagccugggagggaaagguuacagugagccgagaucuugccacugcaccacuccagccugggcgauagagccagaccuugccgcagaagaaaaaaaaaaaaggaaugcaauacggggaaguagcaucccuauacccccaccaagaucuacacaggaggaggucccagagucccaugccugcaucccugggcagaagauaccaggcaaggcagggcccuaccuaaauccccacgacuacuggggcaggggacuugaagcccacccccuucacccaaaucccucccucucgcucugcccacagccagugcaagacgaucaaauauucaucgccucucugaagcuaaauaauacaucaauguaauaacaggcacaaggcagcuaaucacccccuuucaccucccggccuaagcuagggccacagcagggaggcgggcagggacaggccaagccuugggcagucagacauccugcaugcacccaccaccaacugcugugucaguggcaugcaccuggugggcaaacaccgagucccgcuggggugucaggacaggcccugugagaggugggcagaccccuuggccccaacaccagggagugggugggcgggcuggaggggaggaaaacaggcugaggagcuggggaaugugggagcugccacuacagccagcuguagugggugccaagcaguccuucaaugacccugacaggcaguguuugggagggaaggaagcugggugggugggucaaggagggggaggcaggcagcagagggaggucacaguaaagugaaggcacucugucuuccugcccuggaggcugccugggccugcugaccuugugccauguccugugcccacaguaggggcacugaagagugucugccgggcacuaccaggcagaagggagcuguaccccauggagguaauuaaguggcagaugaaguuaacuguguuggacacaggccccuagggaguagagacugcucccaauacccuccuacccagcccuagcugacacgucucccuagggugaccuuggcuguugaagacuggaugggcagagcaucugcuaaagaaggaggagaggagggacaguuccucuccccacagcccuguaccacuccuagaagucacaaacuccaccagguuggccaaggauaaggcccccugggaccaucugggauguaacccagcagacccccuugugccugagacagcccggggucacagaucauugcagaggggugggcaggcaagcagccuuccagccuggaccuggggccuugaggcugccagcaggagugugggcuggcccuggagaaaggcacaggugacugaucuccuggcuccccucugcaugcucccugguuguucccuggcagggagaaagcagcuggcucuggguggggcccguacugagggacaagagaacacuuugcuccccuccuuaccuuccagaucuaugccaaucuuacuuccugcugagccccacccaagggacuccuuuccugagcagccucagcccccucccaugaacaucgagcugucugugaucuuuguuuccaaggguacuccugcugcaucuggagggaauccaggcagggucuuuguaucuguguugccaggagguaaugugugugaauccacaucuauguagauccaugugucugggaacaggcaacuccacauguggguccucagguaggugggucuccuuccucccucugccaagcauagccugacacccacagugccaacccagagagggaggagccuccucaaccaagccccuggaguccagaagagaggagcuccaggagggccccauccucauaccccaccuucuguaccugugccauccaccugggugucaauggccuccacaagcccccgccauuuccacucugucuccuucaucucaggcacauagaagucucccugccgugccagugggcacaugaaauggaucuggucuuccugguagaucuccagccgaggauaggcacacagcuuccgcuccuagucagagaguggcaaaagguagaaugagcccuacagggccccugacucacuugucccugggugacccccagaacugucuauuaccuauucugucccaggggcuggcucugccucucaaccucuuccaaguuccaaagcccugcugagggaggcacacauagaucacccuaacagcagggccccauaguccagagugcaauaauagucugaagacccaggacgacacccuagggcaggugguaaaagaacccaggagccuggcacugcucuccuauguguacaucugagaccaaaaagcuguuccagaaggcacuggucucacagagccaugaagcuuggcaccccuggaccaccccaggauagggaccccaugugccuaagccaaggucucaccuaccagacuuuccaucccaggacccccuggcccugaccuccucuccacccuggacaacgcugacugacccacagauaucagaagaccagcacccccaguccuuaggccuccagccccugcucuugcagacaugcuacuauagacccugaacaaggaucaaggccagcuaaacaccacuuccacucccauucauuccccugcuaguuuagagcuaugucaaccucugagacuaucagguaugguucccauaccuccucacauguaaacucagguuuuagcugauggggaagagggagacccuggacuggaaggucagguaggacaaguagaucuagcacaggacauuacccagugggcugauguaccaccuuuugggccccaaguuccaaaaggcacuccaccucccucugccuagacacagaauccagugcuccccaucccccaaugaguauggaggggcacagacaugccagagccacccugaggcaggcagggacagccagaacaggggucaaguugccucuuacucagagccugccccgccaccuuuccugcgaaggagcacaaauacccacuaugaugacugcaaggccccugcccugucacugcucacccgccaaucuucacaacacgacuauuuauagcauucgccccgcucucaccaugagcucugaaaugagccuuccacuuagcaguaaugagagacuuauugccuggcaaggagaagccacuccaagacuccacuuguccaccugccuggccaacccuaggguugaggaaccuccuucaacuaaagcaagcuagcaaagaaggguuaaaagcaagcccacggaugauaaagggaaagaggagugagccugaaagguuuaccuagcuaggacccucagcagccagcugaagggagggugcaucuaggaggccacgcgggagguggauggccugucccaggucuggcuguggcucagccucugacuccaugggugauccaggcaaagccuuccauccuaagucuccaugugcucaacagcaaaguagaacacccuagcccugaugcuuccaaggucggugaaggaaagucauuauuuuuuaauaguuggagucaaaucuucuuugccaaccugggugcccucggggcuuccuccaucucaagaguccaugccccugacacgucccauuucuaaacacacagauggcugucuuugcuucucuacccacucacauacccacuccagccuuggucuccaggaggaggcuaaacaagaucacagugucaggaagcaggagcugucaggcucuggggccccuccaaugccagcacuuagaggcaggcaucugccaaaccugaacccaacucagcaaacugguccaggucacugaggccaggggcagggaggccccugaagaagguccagguccuuccccaguagcuagaugaaagaaaaggaucccugaaucuagucagggcauggccuucaccaacauccucacacucuggacaaaggacccaaaggguaguagcugaguggccaucacaagagcagcagacauuuggcuuuugggggaagaucccagaggacagagccuguguccacccagagauuccagggacaauggggacccuagcccaaccccucucaacacucaagccaccucccuagcuucccuucuggaggaacuuggccauaacaagauaauaagagggaguacugcucuuuccacccucuccccuaggcugggcagcaccaggcugccacccugugccaccuguucugccagcccccucguuggcaggcgggaggcagcucugcggcuguucugcgcaucugcuuccuccggagagcccggcucugaaguugccuggcuguggacagccccguugccauggaaacugcauccuccauccuugccgucgccuucaucucaaagccaucagggagaacagaggaucaagggagacagaggauggagagaaaacuguggcccugcgacacagcccuuccuucucugcccagcucucccuccucacagcaucucacacagggagcaccaggucccagagccugcucccagaccccuggaggggcagccucaggcccaaaacuagccugguccuaccugcuguuaccugggggcccugguccucccuacuggagggaggcauggagcuaauuaaaaugccauugacuguucagccccaaaucauuauagcacaugcaccagguccuaccaaaauucagacuugggcagagaagggacaggaagaaggcaaaggagcaaacuucuaagccaggcccacaggcagagaaggggcuuguaguugcccccuggcccuuccugggagacugcucucccuugcaugcucugcccacugagcaagaaugacucuagugggggcuggggauggaaggugaggggcaggacaagcuauaugcucugucccugagugaucaggcagagaggacaagcccuuucccucccagccaggugcaaccucggagggaagacagggugaccaugggcuggcucucagguccuugcugcacaguaggagccauggcccgggcaauaugucaaugagccaguaaauauuggaaaaucauuggaggaaggcgaggccagcugccucucccucaguuagccccagggagcccuuggagagcagacugccaguggccaaggacacuagcucaaggucacacugggcuggucccacuggugaagagccugggugggccugggguccuccuagcccuggcacauccccuuccacagcccagacagccagcaguguguggaagcauugccaggacaugagaacgugcucugccacugacaccacuggccaucuaacaaacccacagcccagagcagcucacucccacacacagacccaaggagacuauaaagccucuuuccaaggugggagaguugcagauguucacauuccucuccaccuaacaggcaaaagucagugaaccaugccaaggugcccccagggucugccagaaacuggauucagaguuccagucccucagacacaccuccgggccuucccucccaccugggucuuccacaugcagaaacaagauggggacuugggacaccacccaugaugcaggaauuucuaagagaccccagacaccagcacuuccccaccaccaccccacccugcaccaacaccugcuuacucacucaggaguguuggcaaaaaagggaaggagcagcucacccaccucacacaggcugccacagugccacugcgucagcuaccuuggggacacaccacacacucccaccucacuucagccugaguucaucuccugggcagggugcaggcauuuaccccauucagcucagggcucccacaacagggcaagacugauacaccaggccaagcuuucccccacgggacccacagugccuccccagcaggucuuucugaauuaugggagaggaagaaaagagguaagagagaggaccuggaccugaacuauccucauuuagugcuuuguauucaggacaucacccugugcccuggcuucagcuagggauugggagcaaauagaagacagaagaggucaggcccaggacgaaggcugaugaugggucccacucccaggcuacccagaggcuggagguuugcuuagaacuagguggcugcaaaugcccaaaagaaggaggcaaugugugggccaaggacgggucacaucuccuacauaagcucuaggcccagcaagggaugaggucuggcugaggggcccugggccuugccuuacuguucacccugagcuacccaguccuaucuauccuucugugccaggcuggauacccaggcagcugcacagccagcaagcagcuguugcaucccacccgagguaguggcgucuccucacugggugaagugaugcaugcucauuuuuaauuacagacaccaacaugcaccugccugcacacagcagucccugcaaguggggacucaaacccuggaggccccucaggcagcuggucuucauggcacgugcaugcuuuggggagguauagcaagaggcugcagcuagaagguagcacguuauuauucugcccggaaacuuuccucucacccccaccaggcugccccaaagcuucuggcccagaagccagaccugucuguuggugcucuggggccuugccacagcagcagggagagccugcagaagggcuggugagcaccuuccccucucucuacucuccccucacaccagcagagcccaaagcucugaaaauggcaggcaaaggagacagggaguaagacaggauggccagggagggaaaagaggaagcaggaaguggcagagagcaccccaggcaggagccuagggcauuggcuuggcuacacaaaucgguagcuucccucuggcccucaauuugcccaaguaugaaauaaagggucuacagucauaccacccugaaugcaccugaucuugucugaucucagaagcuaagcaaggucgggucuaguuaguacuuggaugggagacugccuggaauaccgggugcuguaggcuuuuggccuaucguucccucccucuuucccucuuuggccaggcgcgguggcucaugccugcaauccuagcacuuugggaggucaaggcggguggauuacuugaggucacaaguuucagaccagccuggccaacauagugaaacccugucucuacuacaaauacaaaaauuaaccagguguggugacaggugcauguaaucccagcuacccgggaggcugaggcaggagaauugcuugaaugcgggagauggaggugcagugagccgagaucgcgccacugcacuccagcccgggcaacagagcaaaacaagaaagaaggaaagaaggaaggaaggaaggaaggaaggaaggaaggaaggaaggaaggaaggaaggaaggacggacggaaggaaggggaagggaagggaagggaagggaggaaggaaggaaggaaggaaggaaggaaggaaggaaggaaggaaggaaggaaggaaggaaagaaagggauuagaauagaugaucucaaaagaagugaggaacuggaaaggaugaauaaaaacaccauuaugugacgguaagaaaacuauacucagaaaacccaaaaagaaucaauggagggacuaccacaaacauuaagucacaaagguaacucaagcacagcccauuuuucugugcaacagaucagccaaguagaaaacauaauggaggccgggagugguggcucacgccugucaucccagcacuuugggaggccaaggugggcagaucaccuggggucaggaguucgagaccagccuggcugacauggugaaaccccaucucuacuaaaaauacaaaaauuagcugggcguggugucggaugcuuguagucccagcuacuugggaggcugaggcagaagaauugcuugaauccgggaggcagagguugcagugagccgcgaucgugccaccgcacuccagccugugugacagaaugagacucugucucaaaaaaaaaaaaaaaaaaaaacauaauggaaacgagauauaauggcccucuugggguuaggucgagcccagggccagccugggagccaccggcugaaaggcagggaauggcagaggagccagggaggcagguccaggccugggugggaaccuggggaagacugcaggagugggaaggugugagagagaauggggcgggagacggugugcugugccuggcaccccagccugcugcgccugcugccgccacugccugaagacuuuucauuuucaccucagagccggcagcucaccacacaauuuacaccucuauucaucucccuggcacgacgcaggcccuggcuuccucgguguccuguggaggagggccuaggcagcagucaagcacagggcagccugggguauugagggguggggaaacaauguuucccucuaagcaggcacaugggacacaggcucuuaagcaccuuagugcccagauggacugggaggccccuaauccugcauccauacccagccuuaccuuucucuaggcccagagggccaagauacaacccugguucagcccugcucuggccuucuugggccugggccguuguguggccagaccagaggguuggggaguacaggagugaguaccccaaggagagcucagcuagagcacugggugagucagcccugaucccauugcucucccuugcaaaucugggaggagagccacagccuuccagaugauggcucuaccaucgcaggcuccacagcccacccccucuccaagauccagcauucuuagcagcuugucuguguagucaaggaccuugagcccuguccugcucacaagcugacaaacugguugcugaugauuauccagcagcaggaaggcugcucguacagauggagcugggaagccaagcaccugagagccagaggagucaggaauugccagaggggaaggacaagugggcaagugggaauggagaggagacaggggacagaagagagggagagaaggagaaggcccugaauuucucaucuccaacugguaccucugaccucugcuccacuccucagugaaguccuuuccuucccaccugcauaacuagacagcuagccucuccuaaucugagggcucagcugaagaagaaguuguucugcuugggggagagggggugcacugcaaauucucuccuuggaaucucuuuccccucccuaauuccaaucucaagcuuccuggagaagagcaacagaauucuucuuugauaaguaaauuccaucugccuggggaagaaggcucccucuggacuggugacagcccaaccccacagcaccauccagacaagcuucagcccccaggguccugcagggcugccaagcuacaauauccgagcugguauuuugagagugguggcucccacgccgcccuagcaaaggcuggcuuugugcuuucauuccugggggaagggagggaggugggguaaagccagagaggcuaaggagcagguuccagugccuaggccaacaaaggggagaggccuggcucccaacaccucaauacccaaggguagcucccuaaggggagccggggaagccaagccgugguauggugggaggaucgccucuuggcuuggggacaucugggaaugaaaagucacugcuacuuucagcuaacuugcauuaucuuugugcagaauuugacuguggccucuggcucuuccuccccaucuccuagguacugaagagacuugaucugaagcccagccuggauacugucacucaucugcucagacgccaucagugucucccuagugccugcaggacccagccuauaucucuuaggcccaaacucuugcuccucuccuguacuccagccucacuggauacacaagccaugacugccaccaagccaguaucucugccugaccugccuucccaccuggggaacacugccuaccuuauaggugcagcccaaaugccaccaccgcacaaggguuguuuugccuuucccagcgaaucuaucccuccccuccccacacccaggcauggcuaggcucuguggcuggaggagguggaagaggaaagagugcuggaggauugucacucagcuccagguccugaugcugccaaaagugcccuccucccugugccagagcaggccacuuagcagguggcaguaccagcagguaagccagcccuugagauccagggagggaagccugggaauagaaccgccucugccucacugaggguguggacaagaggcccgauaaggugccugcagcagcugcuuccugugcccagagcaguucccaaggccugccuuaaugagugccugcugggcaagcggguacacagccucuuccugugcuuugccucggcucccccagcagucuccuagaccugaagccucagccuccaacugugacuaccaggguuggagaaagaaggaaagaaagcccacccuggggcaccaucccgagcauaucccaaauugaugacaaguucucagccucuugguuccagccccacuuauguacaggauggaguggcaaaaggcauauagccaucggaacgauccucggccuaagggacccagucuggacucagcuaccgcuccaucccuugaccuuggggcaccuuccuucccuaggccucagccuccccaucuguaaaacaauggggaugcuggcuuugauuaggacucuaugacgccuccuagcugguuccuccaugcgcagaacaaugacacacacaagagaccucaguaaauaacugcugaauaagugacugagcugagaugccaagagggccucccuuguuaaaaauaaaguuuggaagcuucccauguuagcuuggcaaaggugacaggcaggaagagggaaaugaccacagauuucacauuccugcuggggcucccucaccugcuuuuuuuuuuuuuuuuuuugagacggagucuugcucugucacccaggcuggagaucagugucgugaucucagcucacugggcagugucgugaucucagcucacugcaaccucugccucccgaguucaagcaauucucgugccucagccuccugaguagcugagauuagaggugugugccaccaagcccagcugauuuuuguacuuuuaguaaagaugggguuucacuguguuggccaggcuggucucaaacuccugacuuuaggugauccacccaccucagccuccuaaaguguggggauuacaggcgugagccaccacacguggcguccucaccuguauuuccccggccgaggccuuguugcucugcacugguguuuuggccccaguguggacucagacccaccgacugacucccucagggucacugaggcagacuaaagggaagcaaacacaagcgguucugugcccacuggacagaacacaggcuguggccaggcuguuucgagcuuccucacagccacugcucaacaggcugacccauuuccacaggcaaucugcuggggcccacaggccuuaguuccaagcuggcugccccauaaugcuaucacccaccacucaggaguucagucaccaccaccccaggagaacuccaaccugcagcuccccagggucccuccagguccagcuuccaaucagucacacuccccucaagacaagugccucucuuuggagcuccugcccuaccugcacaagggcugggcccuggugccucccagcuccacucauacugcaguuacagcauccucaggaucgagaacagacauguagugggcgggacuggagguggcaucugcccaguuuugccccucucuuaggacagagguuuucaaaccagcugagccuuagaagcucccuuccaaacaaaagcucaagacaccuggguuguaaaacucacaggcagaacuacuccaggugaagcaggaaagggucugaguacagcucccaccacaggcugauagccacagggcaccucagcacagccagggcagucugagaacuauggucugggguccuugccuuacuuucuuacuuuacuuccuuccuucccuuuuuuuuuuuuuuuaauguuuuuacuuuuauuuuuuugagauggguuucacuccuguuacccaagcuaaugugcaauggcgugaucuuggcucacugcaaccucugucuccugagcucaagcaauucuccugucucagccucccgaguagcugagaccacaggugcacgccaccacgcccagcuaauuuuuuuguauuuuuuuucuguagagacgagguuucaccauguuguccaggcuggucucaaacuccugagcuggaguaaucuaccugccucagccucccaaagugcugggauuacaggugugagccaccaugcccccuucauuuaucuauuuauuuauuuuugagacagagucucacucugucacccaggauagacugcaguggcacaaucauggcucacugcagccuugaccucccaggcucaagcgauccucccaccucagccuccugaguagcugggacuacaaaugccuggcuaauuuuuuuucuguuuuuuuuagaggcaggaucucacuuauguugcccaggcuggucuggaacuccugggcucaagugauccucccaccucaggcucccaaaguguugggauuacaggcaugagccaccacaccuggccuuauccccuuuaagccccugguaagacagucccagucaacccagcugucccagaauucggccaccaagguuccccucacaggcucacuauauucggugaccccuccuuacuuacacgcuuuucuccaauuugaugguggauagucagacauuagucugaccuccagggccaccugcacuccccagccaaucagccacuacaugaacaaugcccuguaacacccuaaacuugggagaggaggcucaaaccauuuuacaaagacccucccccuaaaaacucccugaaaucagagaccauggggaagggcacuuuugaaaaagauucuggacgggucugggagagaaaucaggcaugggggcuuggcugugugucaaacacucucaauggccuuccucaccaagugcuacagacagauaugagcaaacugcacuagagaccuuacacacacaaucccacacaucgaauucccaggcccaucccucaguccuggucuguuccauguguccgaagccuucccuggacacucauuaagacuggugaauuugggggccucugcccauugcucugggcucacaucugggccccaucuccccucugcagguuugcaauuucaagcaagcucuguuccauccugcagcuuccagaagauaccccuuuccugggacuuggggaguggucuccuccuguacuagaggccaccuccuuggacuccagcggagcagccugacaaagcugaggcaucuuccauauggagugauggucacacaguacgcauggauuccaggggaaugaguguucagccugggggcccuuagcaguuuauauggagaaaggcagaguuccagcaucuauagcaguuugccaggcugccaagcuggggaaggcuagccagagagccagaggcugccaugcaaaccaggaaagcugagaucagccaucccuuccagaaucccgagaguccugacaagugcuucuccuugggccucucgccgugaacuucaggucccucugucccaugagaccaauccuguuccaggcucaggcacaucugcaacucccgggacagcagcugcucuccaccucccaaacccgaagcuaagauccauucaccccugccccucaccuagccucuggagaggcuggugagccugccaaguccuccccccgcaacuccuggcagcagggcuccuggccucucucaccccugccaaagcagaaagcugacggcugcugucauuccauuugaagagccuucacagcagucccagauccagagagaaaaagaaggguguacacacgcgcacgcacacacaguuaaaagcugucggugcuagaagagugagacgcaacuagucucauuaguaaucuccuuucucugaccucagggcaggggagaugaaggcagggauggaagggagccuuauacucucuccuugcugucuccugggcugagagaggcacagggccaccccuguccacugcaggcugugaccagcaaacagagcuagccccuuccucaucucuccccuggcuuuguuccccaagacgcaaggucaggcuaaacacaggggcagaggcaacccccacacccugcugccaaaacaagcccaggaccuucggccaugccucuucugugggcagccggccucuaucuuacucuccccgcugauggccaagcccacacaagcaugccucacaccugucucugggagaagccccuugcucucccccauaucacuggcuuccuugucucaacccccacuccaggagcacagcugacaggcucccaugggagcggggaggaaggaggaagggcuuucaucaaagaggugacgucaaaaccaggcaacuugugaagcugucaggggccgggaaauuuggacaaaggugucuaaaaauaaaccccugaagccaggaaaaggcuuugguggcugaguugcucaccaccacaccacaugccacauguccuguucugaggucuggaacccaagaagucucuuucccaggggugccccuccagaugggcccaugagguugaggauggcaccgacaggacuggagaggccuuccuugaaugaaauggggcgggacuccccagaggcagcacacuaagcaggccuagggcacugguaucuuccuuccugcccacaccaccagccagcccgcccccaccuccaguccaaccgcagccaggcaagcacauccugccccacaccccuuuuggccaccacccuccagcucacaaaggaaacuccccucuauucucccugugcccuugccuuaucaccgugacagcccuccccuuuccaggucuucucacuccugauucuucaaaccugucuuugaccgccaaggacacagcuggugacccagggccucauuuauucauuccucagccccaacaccagacuccagggacaucugaacucccauuuccaucaucaacgcugugucccuuuccccaagcugcuuuggugaacaaaguugcaaggauccuccaaguguaccaggcucucacucccacugacucucguccuguucccugaccccugccacacuggccacgcccucugcgcagccuuugcugccacaggcuguccacugccuaccuggucccacagaggcagggaggcacagggcagccucccaggucaaauacugccaacaggcugauguccccaaauauauccaccagcccagccuuuccucaacuccaggccacacauaccauugcugacuccacaccccccaacuuagauguaucucaggcagcuccccugacauagcccaaauagcuaccuuccccccaaaaccagggccucccucaguuccccacaugucagugaaagcaucacuacauacuugcccaccugcccaggccagaggggagcagagcccucugugacucccucacugccucuccuuccacaacagugaauccacccaaagucuaucaguucuaucccaaaagugauuguaaaucuccauccuuguccacagcucuauagccgcugggccugcccaagcugccaccacucacaaugggauucaugacagccuccuaggcuaauuccuuagccccaggccuaagcaucuccaccuggucccagaucugugguccagucccacccugcccagagaugggacagcucaucuuguacagacguggcuccaacuguguuauuuuccugguuggaacacugcagugacuuccugcugcauuuagaccaaagcucugacuagaaguucuuaucuccucucuaaaggcucuucuaggacucugccuugagguuaucuccucugagaggcugucccugaccauucuguccaaguugguucccugacuuuucucacccucuccuucucuagcacacguccuauuuuugucugauauuuauuaccuaucuucaccaccucacugugaauggcuguuucaugcaccaacguuucauucacauugugcccauuauagcaccuggcacacagacuauaaauacaaguuaaaugaaugaacaaucacguccaagcccaaacuggggucauuucccuagcaaccaaguuuacaaaacguuuaggggaggagggauguguaacagggcaaguuuuaaaaaaauuucuguagacacagaaacccgucagaugaccaggugacuggcucuccuuccuccaggaagguugggcugccagcauugccaguaaccaagucaggaaguaaaggaaacagagccugccacugcugucccagcccuggccucugggagcagauguauaagcccaugcacaggcagggccacgggcaauacaugauuaccuggggccugcccagacacugggagccucagguccuugcuuugcaggccuccagcaggaugagaauaaaguggccuguccauucaucugagccaggagugugggauaagcacuauggaugucuuuggucaaagccagagccaaacuaaccagaucagauuuaugaacaaguucuccaugcucuugggauaugcuccggcuuccaaaagaucuugggcaucugaaagagaugccaacaaccucugcccaucuuccuagcuccacagguaccuguuccaugagggccccagggugcugcucucccaaaaccacuucuuccucccauucuaggcaguccuccucagcuccacccaaggggccuggcuguccccaacacacacaccccaggccugugccucaccuugauguagguguccaaggcaggauggacacggcggguagccagccagauggacagaauggugguguaggggaagguggcugucaccacauggcugggugccgggaaggagaacaccuugaagccaaauuucugguagaggucgaugagcucaggggagggcgauuccucaccuucacucaggaugcugcccacggcacaucggcacuuaucagggggcaccuggggaagcaaagcaugggugugagaguuggccaaaggaaggaggcccucagaccuccuuccuccugggacugugccagaucaggccuaaaagaaccagcagcucugacaagccaugcagccccagauaccaggacacagcuagcuauuuucuuacuggaacccaccuauggccccugccuguggcaucguaccacaggacucucaucuauuccuucaacaaacaugccaugcccuguggaaacccagggaucauagugagggguuagacuuggucucugcccuucuggaggccaggagagggaagggcggagaggaccucugaaccaucacccuccacauggcuccacugagggggcccuuccaccccaccauaagacccucugucagcccccacgccccagggccaccagcagaacuguacaguggcugauccugcagccuggguccagcaaaauccuauuagcuaauuucccuccuaucuccuggagaagagcaggcuuuacaggcagagaaauuauggcaggcaagggagcaaaacugaggagugguaauaaagagcucagagcccuccacggucaugcccuaggaaagcaagaacacguguguguguguuuacacacaugcuugcagggucaggaccuggcaaguggcugaggaggggcugcaggaagcaccugucaggacauaggauugggaucacugacaucuggguugcuggugaaauucugugaagagaucauccuccccaccccucuggcagggccagcuaccaucaccagagccucuagacuucuucugcaacccauggcccauccagggaccuaucccacuuccuaagucccuuccuggcuaaaagccaagaccacugguuccccuccaaaucucuguagguugcuagugccugcacuucccacucugcuugccucccuaccuaauuucccuccucuggcucccagaaaccucagccauguaaggcuccuaugugagccuccaacacuuccuaggacugaaugaaugcugcaaggcccaguacucauuucuccuccuggcaucaagaggccucacuuugucucaccuacugcuaccuguuucccacgucagcuuuccaggugccuaagucuguaccagccuucagacugggcccucagagacauaugaucuugaauccaagagauucagcacagaccuuguacccucaauccuggguuuugcucaacucuaaaggcuccuuucucccuacccaccgcaaaaaaauuuuuuuugccagcaguucaccuucacagggaugaccccuaaguuuaaacaggcuucucccucuaccuccacuuacuccucuccccagcccuccuucccagcacugugaagucauuauuaccuguucucaccucucccucccauuacagcccuuuccaagcccucucugaaauccccuggggguuucucagcccugaauggccuccucuacucaggccaacccaggccuuccuuuuagucacaguuugccugggacuugggcaccuauuccaggcucucacuucuaagcagacccuaacggucacccucaacugucugcagcucugguccccuugcagcccccuugaagccuacggcauccaaaccuggcucagagcuuuaguagcaggcaaccggguguaguggucagaaacacagcuugagagaggcaggccacggugcgaaucugagucgugugauucuagacaagucccuuggguucugggagccccaguuccucaauaucuacuuacagaacugccauauuaaacaagaaacuucacgagagcuuagccuggguccagcauucagcaaaugccccauaauugugguuauuaguagcuaugacacaguccaaacaacuguccauggccuagaaugcccgaccacccaaaccucugaauaugcagcuccucccugccuguccuuccgguucaaauacccucuugaagagccuuucagcguggcucaguggcacucucuucucccccaguauuuugcuguaaacuuucuugcccuccauaagucuaccuugcacacagucacuucuuuuggccugaagcuccucccaccccacccagaggcacaggagaucacugcaauaccaucucuugucucuagaugguggaacugcccuacucacacgccaagacuugagaaugaccagauaggcaggaaguuaucuggcaggccuccugcugacaagccaagagacacugccugccacaaagccuaucuucaugucccugacccuaccaaccugugcugugcaaaagaaacaucuacauaagucauauggagaaacggaugaaaggucacuuauucucuuccuuucuacagcuggcuugccuggguuugaguuccagggucuuuccugggaacgcuucagcaggccuuaugggacucccagcucaacauccucuucaguagccaaaagacaccagaacacauguggucaucuugcucagaaccucucaauggcucccaauuuaccucuaggaugaaacuaaauucacaagccaauaggcaaggcucuuuuggaguggcccacauaauacugcaugaauuugcccacacacucaccuugcacucccuuucugcagccucaggccccagcaggggccagagcccaggugggcaggcaccaacugagugucugcauggcagagggagggacagauccaggcucuggcccagcccgccuugccagccuccucacccgccacacccccacacacacccacaugaaacuauuugcagcuccccaaacaugccacauccucccaugcuuccugccuuugcguaagcuacuuccucugccugaaauguccuucuucacccuauuccagagucccuucugacugggaaacuccugcccauccugcaagacucagcucaacuuuccccuucaaagccuucuguugcucuccaccaagcagccccuccucucugaucccaaguacccaccagggagcagguguugugcugcacuguaacugauggccuccccaucucucuccaucacuccaggccucuaggcaaaaagguccaggauccugcgcacacagaaaguucuugaggcaugcucagugacaguacaugcaugcacacacaagcaagcccugcaccauaacaaacuuccucucccuccaccuggagaaaaggcagagcuccugucaaaguggaagaagggagcuaagaagacagggcucccaggauccaggagguguguggggcacagcagcuccuuuccuggcuaagcaacucccuaauuccacaaguaagaacacuuccuaccuccuccccugcccuggccuaaggaggagccuagaaggucucucagcaagccuaccacccacuaaguggccccaugcaaaguugaagcugggaagcagcugaacaaggcaccagcaaggaggaaaugggacaggcccuaaaauaaccuagggaguggcaaggcugauccaguggcagaggaaagcuuuccuggccucccaguaaagcccagacccgccuccagggaaaaggccuacuaaggcugucaagugcccagaagguugggauguccugaugggcaagagaccccauccaccuuggcucaaugaguaucuguauuugggccgaacccuaggacauaggccugggccucccagcccuaccugccugcuccucuuccuccccagaucagcuauuucucuggguaccucugcccagaacaagaauuggaccagaacuaguaccuacaaggaaccacaucugggaaacagggcaguggccagacccaccaccacucgggguaaagacaagcccauccaggauguguccucaaagcaagaguaccaggaaaacaacagaggcaugccaggccccagagcaucuccuuugggcugaaaagccuccugagucccauuacugggaggagagggcagucugcuuagaaccugaggcuuccagguacgagcuagucccaaggcuggccccacugccccuuccugaguggugucacagugcccugccgacccuauugugugaggcuauagcgaagacagccaucucggggccccugccaagccaagaccucgcugagucugggaacuggacaagacugauaaucuuccaggaugcaggaaugagaaauggugucagcggcccagaccaaauguagucauuggguucaggguuaauacaaacugccaaccccaggcccacaaccuacacaaccugacagggacagcagcaccaucucucaaacccaggcacagagggcugcccuuacucuucccaugccagcccacugacccagagcuacccaaguuaagggggaaaguagaggcagggcccuucauuugcacuuguacucccaagggaauagacgagcugcacuggcccaugacuaggugguugauacgggaccucguuugcccuccuaggugcuacaggucaacacgccaacccccaacuucccugggaagcuuaugcccaaaggcacacggagacaggcaccagucaggacacgagaugaugcagacagcuaggccagaggacaagccucauucuucaggcucgggaggaaagaaaggagucaacaagauaccagcccucaaaggugaguuuacuuagaaaccuuucaggaaccuuccucuauaacccuacaccuucaaacagaauccuaaaaacagcugauaucugaccaggcacucaccacuuuccccagacucugccuuccaagcauaagcucauuaaauccaaacagccuucugugguugguacuguuuucaacccuguucccaaggcccagacaaccaagccauucagccaaggucacacagcaagggagugcugaagucaggauucaaacucaagcagaccagcuucagagcugcgccacacaacccaggggcauccaggagucccggaaauuggcccuagugaaagcgggcugcacaauggcuuuucccugcacugugccgccucacauggcccagacaaccugcaggaggcugggacuaaaccagagaggcaggcagggucccuaaaaguacaaagucccaguggcaugagguccucaggcaggacuggaugucaagugugacacccaccuauuuaaagaacuggguauugggccauaucauuaucaauuagcccccacaaaacaaaaacccugagguagggauucuuuuauccucaugugacagaugaggagacauacucagacaggccaagugacucaccuaaagucacacauugguuagcaguggagccuugauucaaacccagaagggcaaauccgaagccccuuccucucacaccucgucucaccucaccucaaggacaguucuagugggcagagaggagcucgugcuuccagaccugucccacauaguuaaccugcugcacagcaaaugccuggacuccaccuggcagaaaauaaccauggaguaaccaggauagggggcggccugagcccucaggaaacaucccagcccacauucccauugccuuuguugaggaggucaguccugggaaauccuacucccucaccccuucccaggcuccacccaaacuaagugccuccagggagggcagggagccuucucuccacacacacugagggaggagggagugugacacaggccuacaucagaacucucaccagccucugugaggcuguggucaugccagccaaaugaccacaggccccugcagaccuaguggcccugggccuugguucucauuggacuaagggaaagggggcuucaauggcagucuuguuuacuaaaggcagaagcaaguaccaccaguuccccaacccacuccaugccuggagcaaacaccaccuccuagguaguagauguaagcagcaaauauaggcccacuugggccacauaaauugaacuagcugccacacccaucuugccccagccaggcuccccauauaagcaagcaggcagguugcuuaagccccaaacauagcagcagaggugaugguggcacaggguggggcaggagguagagagccagccuggcagacaggaugggcccacaggcacagugauagcagcccagccacuagggccuguccacaggccagagcuggccaggaucaagcgaggcacucaggguccucucagcuccuuccuuccccuccaacacugaaggcucccagagggaccaggccccaaaagggagccugaagucacuuuccaagcccccagcacccaccgcagaagcagggcuaaaggcagagcaguuuuucuagucaggacccuuccccagucaugcaagggcaguauggaccaguguguguaagggagaucugugacugacauccgccuacaugugauccuuaucucugaacucauaccccaucccuugcauaccuugaagaggaauggcccacacuccaugaaugcugggcucugaggugggugaguacacccaugagccccugccagggucuguccacuucccaaaagacuucuuccccaccuucccauucccaaccaugccaaggguuucagggauggagaauggaauccuuccuccugccucacaagaaccacucacccagaccugcagccucuucccauacaggacuccagggcacaaggcuaacagcuccagcagcagcuacuaugaacagguccacaccaacugccacuguccaaucuuagugguacccuuucuugugcuacuuccuggguccacacccagccuaggugggaccagccuacucccugcccagcugaggacaggacgaggcauggcuagggagcuguccgucacaccucauggggugggcagcaucuaaagccagguggcaccucucaccugguuacucaccaccccacucacagagccugacacagccucacugccuccccacacucacagagaagcagguucuggcuccugucacucugggcuagggaaggacacagugggggugggacacugaacaggucagccucuauucucuuucucugagaaccagagcaugccacgcugcacacugcugguggaggcagccuaggggacaaaaaccuuugguucucagcccacuccaggaccaggauggggccuuuccucuaggcuccuaacacccacacacuggcagguccugguccccaugguacccuagugcccaacacagagccugguacagagcaggugcucagauauuuguuaaaugaaaacaaaaacauaugagaucagugccuuucuccuacuaucugaaucuguuucucccuccauaauauggaguguggaccaggaggccucagguccuuccggaccagucugugauagccacgagcaccugaagccuggggguccaugguucccugaaccuguuacaaucucugucaggcagagaaugcacugaccagcuccaagaguaaauggggacccaagugucccugagccaucccaggugccaagugugaccuagcucuaaauggggacacaggugucuucuggacugacccaggacugggaugggcagggucagaagggccaccuugacuuguucaucauccucugugccacccaaaugaccacagccaggccaagggucuagguuugcucagucugaccucucagcauauguuagcacaagugguuuucccacccaucuuuguuguuguuaagcaucuguugagggcuaagugcugggguaaaugccucaccuauaucacuuaacucuucucagucuacuaugaagcagguauuuuaucauuacucugcagacaaggaaauagaggcucagaaacauuaugggauaugccuaagaucacucagcaggacagugaugggacagaaucagaacucgggacugcuagccucaaggcugugcucucaggccacagucccccagacaagcacccuagucagacuaugaccaaccaacccuggagacccagggcccaccccaugggguccaccacaucucugggaaagcugcaggaggcaguggccaggccagaauaucccaugccaggcuucuuccaucucacucuucccuagaccagccuccagcacugaccccaggguacccugcugccuuagcccuuucccauccaggaauuagcaccuccaacccaagaggcaaccuguugauuccagaacaggcagacacgccaaugagaagacagccagcugcaaggacucuucuugcagaaggcucugacugggccagguguggaagggggggcagggccuuacacaacggagcccuugaaggggugagggucacacaucugcucuaggagcuccccauagcccacugucugucccaucccacucaggcuccagugcucccaacuucaguuagugccaucuccuggccaugugacugcaaaaccucaaccaacccaugucgccucucaccuggacccagcccaaucucuucuacggccuccugccucaucuccuucccuccuccaccugcccuucagcuaacuuccuaaaacaaagguggcaaauugugccacauccuucuucucaaccugcuguacuuccccaccaccuggcugggcaaacccuuccaccuuucuccacccaagacaugucuacuaaccacaauucucuggucaucccaugucuucaggcucuugcugucacaguuuucuuagccaaguaccccuucccaacaaagcaaaauucuacuuacaugagaaggcccagcugaaaucuaccccuucucugagccuccccagcagacucauggcagccucccugaaccuacagcucaaaguucuguggacaucaagcacagugucuuguuggagaaucacuuauguggggcugacaugucagccacacagagcuuccugagggcagagccaggucugauucaucuccagaguguagguguagaguagaaccuggcacagagagggaaccaguacauccuguuucaacuagugccccaguaagccggucagcacacauuggguagacugcaggacuugugcacuugagcucuccaggcaaggaaaucagagcuggggauuccaaaugcuugguuuggcauggcuuaguaguagaggcugaagaacccuugacagagcugccagcccauccagcugugggcagcaccaccccauagcauagcaguagguuacauuagcaagcucugacucaccauagguuguaagaacagccagacgcucacagggugcuagugaugcuggauuaguuuuugacuucagcauucugaacauucuaaguaacucaucuggcuccacuagcccccuuggccaucucccagcaccagcuugaggucuaaggaaaugccauaucaccagguugaggggcaucagaauggcugaagagguaagauuccaagccccauccccagggacugcccucucagcccucaagggccuacaacuauggcagaagagcugagggauggaaagcacagaaacagcaagauguaaccccaaagagugggcagaaucugaauggccuggccuuagagcacuggccccaaauggagauggaaggagggaugacaagaagaggaggcaggggaccaaaguccuggcagaagccagggauucauggugguauaguccacugcauuuggaaauccacaaguagccaugggcaaggggaaccagaccugggcaaauagaaagcccacaaauggaugccgggagcagaaguccaggcuaaaucuggaaggugcuucaagcucauagaggaggggucugcagggccagcuugaagauucucccacccuuuccucagcaaccaaaacuacccuccccaaagaagcccuggcccaccaggcccauccauggggcagaaccccauggagacuccuuaccauguggggguugucauaguagacagcgauggagcggagcuugggagagaugcugcagcucucagugaaaagccgcccagucucaccauagagccccauguggaacuuguaggccacagugacguugcggauggggggugacccagcacucacuuccaccccagccaguagcccugaguacccggcaaaggccagcagcgucagcagcaguaagagagucaggcccccaaucaggcccaguaguagcagguccgacauggcucuggauccccaacacugcaccucaaggcagcugcaaaggagaaagaagggagaggaggcugguagccuacucugacaaugugcccacuugcccgccaaccaguucuggcccaaccuccucagaccugccuugggugcucugacccagaaaggggaggggccagagguguuuacacacagagugaccuggaagggagcuacaaggaugacugaagccacaagccucuuuauuucuuaaucgcaguuggugaggaucucagagcagcucaaacugucagcuggcagcccuggucacaccuggggaaacugagucacagaggggcacaggagugauucagccagagacauacuccgggcccugacaagucuccccgaagauguaccagauaccagccagccugccuuuccuccacauuaccucuuccuccccacagcugagccacgccaccagcccagccuccccaagccucagggacgacugccagagggaggacuggcaaaugcuaggguccaaacacuuacuaacgacagggaaaccauaaggaacaaaaacuugugaggaaaaaugugccucaggaagagaauuucauaagaaacucuccuuuucuaaguacaucuggccugcagggaccuugcuauccagcaagcuuacccauccagaaccagaggaaagaccagagcaaagcggccugagcaggcagaacaaaguccaacacuaagcuucccagacuugaaccaccaauguuaacaagcuucaucccaauuuuccagcccacagaagaaacagugaguaguaagaggaaaaggcugcuaaaaggggagucgcacagcaggaggaaguaacaauuaucccuaagaggaaaagaagcuguucaagagcagucccaggaacauaacacagaggccagucugugagcuauucaaggcaggcugccuaguucuccaggcagcuuggggccagaggccuaacccucuuacacagagggcuugaccugaguugccuggcgggggggaaaaaucacagcccagagaagacuguuuaaagaggaagggagccaugugacccacuggggggacauucccaccccaauuauuuaaaaguaauauuuaacauuuaaaagguuuugaagcuaaaaaggccacgcugcaacuuuguggaauacuuagcucuguggaauuauuucuucccugugggugcuggguguugauuuuacgcuaaaaaaaaauugucuuuggagucaaugagcacacaguauuugcucacaaagaggcaaaguaaauuucuaaacuuucggugucaagaaauugagguguugcccacuagucucacccaucugugcuucuacccaucaguaucucucucuuuucugccuguccuacucaucuugucuccaguaacuuucauuccaauuuucuuugauaaugaugagaaaucuuccacugaaugcuuacuauacgccaggcacugucuaaauguugaaacacagcuacuucauucacccucaaagcaauccaaagagguagguaaggcuaaagguucaaguaguuagagguuaagagacuugcccaagguaacacagguauuaaacagagccacguggaccaaaaugcaggcaacacaagcccagacagucugauuccagccccucauuuccacuuucucucuccucucuggugacuggcuuccaaaacgccugaagcauuaaauccuuguuggacaucucugagcccaaagcuggaaaacucucagcaucuaggcccccacuugccuugggaaugacaagcccucacccugaucugccaucucagcugaacacuuccugucuccucaaggaaacuuaguaucuaccuuucucuuccucucacuucccaaacugcucagaaaacggcgggggggaagaaaacccaccugggggucucagagccuuggucggcacguggagagguaacgugaauuuccccuauauucaagagaaaaggaagaaggucugggagcucaccugaaaugccaggcucacuuuuaguaacugcuggcauccagugcggcaggggccgagcgcuccagugcugggagcugaaagaacagucaccccugcccaggaaauaaccacugagccaaccaucaugcccugauuaccguccucagggaaagccuaccggucccucuaaagcacccucgucccauucucaaacccccuguggaaaucagaagccaaaccuagcuuuacaaugucaggucucuucgcuagagcucuggucacgccccucuuccuggaguacuccaaucacacuuggcgcccagaaacugccgcugccgcugaccuugggcagacugcgcccucccucuagccucggcucccccuccgcucagaggcccgggauggacgcgugcggccggugccagcgagccucagggaaggcugcgcccagccagcuuccuggugccgcucacgugcgcggcggcggagggccgggcccuuaaacggcccccguccugggcuaaacuucggugcuagcagagggcggaaggacuauggaggguggggggccgccgccucccacuuucggauuccagccccugcucaccccgggccuugccuauuuacucagagccuuucucuucgcccaccuccucacggagccccacgcacgucuguaacuuaaaggacgcuaaaguuugcagcccaggcugcgaggcgcggccuugggggacgggggcggaguuaaaacgcgacucgcgccucuuucccucaccuccacggccccggggcaugcccugcaccgguggccgcggaagugggcugcccggaagaguaggggcugccccaaggucgcauccaggcccucggaccuggccgaggccagcugugggcaagacaagaugcaaagagcggcccgggccgcgggggucacggaggggacacggagaguccugaggucgcgccagggcggacagggggagucccagaccuacgccccaguggguaugccucuccucuggcccggcccucaccucagcagccgcccgcugcggacgccgauccgcgcaggcggcucaggguucgguuacggagccugcgcgcgcccgccgcgcacgcucgcuccgcccccucucgcggcgggacauggccg

SEQ ID NO: 16114 - RNA, 1487 nt, Homo sapiens
gguuccauuacggccagcgaggcccgacaacaccugcagaagaugccagaaggcacguucuuaguacgugacagcacgcaccccagcuaccuguucacgcugucagugaaaaccacucguggccccaccaauguacgcauugaguaugccgacuccagcuuccgucuggacuccaacugcuuguccaggccacgcauccuggccuuuccggauguggucagccuugugcagcacuauguggccuccugcacugcugauacccgaagcgacagccccgauccugcucccaccccggcccugccuaugccuaaggaggaugcgccuagugacccagcacugccugcuccuccaccagccacugcuguacaccuaaaacuggugcagcccuuuguacgcagaagcagugcccgcagccugcaacaccugugccgccuugucaucaaccgucugguggccgacguggacugccugccacugccccggcgcauggccgacuaccuccgacaguaccccuuccagcucugacuguacggggcaaucugcccacccucacccagucgcacccuggaggggacaucagccccagcuggacuugggcccccacugucccuccuccaggcauccuggugccugcauaccucuggcagcuggcccaggaagagccagcaagagcaaggcaugggagaggggaggugucacacaacuuggagguaaaugcccccaggccgcauguggcuucauuauacugagccaugugucagaggauggggagacaggcaggaccuugucucaccugugggcugggcccagaccuccacucgcuugccugcccuggccaccugaacuguaugggcacucucagcccugguuuuucaauccccagggucggguaggaccccuacuggcagccagccucuguuucugggaggaugacaugcagaggaacugagaucgacagugacuagugaccccuuguugagggguaagccaggcuaggggacugcacaauuauacacuauuuauuuauuuauucuccuugggguuggugucaggggcgagccaaccccaccucuaugcccugagcccugguaguccagagaccccaacucugcccuggcuucucugguucuucccuguggaaagcccauccugagacaucuugcuggaaccaaggcaauccuggauguccugguacugacccacccgucugugaauguguccacucucuucugcccccagccauauuuggggaggauggacaacuacaauagguaagaaaaugcagccggagccucaguccccagcagagccugugucucacccccucacaggacagagcuguaucugcauagagcuggucucacuguggcgcaggccccggggggagugccugugcugucaggaagagggggugcugguuugagggccgccacugcaguucugcuaggucugcuuccugcccaggaaggugccugcacaugagagga

SEQ ID NO: 16115 - RNA, 1487 nt, Homo sapiens
uccucucaugugcaggcaccuuccugggcaggaagcagaccuagcagaacugcaguggcggcccucaaaccagcacccccucuuccugacagcacaggcacuccccccggggccugcgccacagugagaccagcucuaugcagauacagcucuguccugugagggggugagacacaggcucugcuggggacugaggcuccggcugcauuuucuuaccuauuguaguuguccauccuccccaaauauggcugggggcagaagagaguggacacauucacagacgggugggucaguaccaggacauccaggauugccuugguuccagcaagaugucucaggaugggcuuuccacagggaagaaccagagaagccagggcagaguuggggucucuggacuaccagggcucagggcauagaggugggguuggcucgccccugacaccaaccccaaggagaauaaauaaauaaauaguguauaauugugcaguccccuagccuggcuuaccccucaacaaggggucacuagucacugucgaucucaguuccucugcaugucauccucccagaaacagaggcuggcugccaguagggguccuacccgacccuggggauugaaaaaccagggcugagagugcccauacaguucagguggccagggcaggcaagcgaguggaggucugggcccagcccacaggugagacaagguccugccugucuccccauccucugacacauggcucaguauaaugaagccacaugcggccugggggcauuuaccuccaaguugugugacaccuccccucucccaugccuugcucuugcuggcucuuccugggccagcugccagagguaugcaggcaccaggaugccuggaggagggacagugggggcccaaguccagcuggggcugauguccccuccagggugcgacugggugagggugggcagauugccccguacagucagagcuggaagggguacugucggagguagucggccaugcgccggggcaguggcaggcaguccacgucggccaccagacgguugaugacaaggcggcacagguguugcaggcugcgggcacugcuucugcguacaaagggcugcaccaguuuuagguguacagcaguggcugguggaggagcaggcagugcugggucacuaggcgcauccuccuuaggcauaggcagggccggggugggagcaggaucggggcugucgcuucggguaucagcagugcaggaggccacauagugcugcacaaggcugaccacauccggaaaggccaggaugcguggccuggacaagcaguuggaguccagacggaagcuggagucggcauacucaaugcguacauugguggggccacgagugguuuucacugacagcgugaacagguagcuggggugcgugcugucacguacuaagaacgugccuucuggcaucuucugcagguguugucgggccucgcuggccguaauggaacc

SEQ ID NO: 16116 - RNA, 11436 nt, Homo sapiens
gggcguccaguucggggcagcuucuccggcugguggguggguggggcagccuuucaggcagguaugcaugggagguggggaucggaacgggguguuucgacugcaaccgccuggagaccuggccgguaccauucuccauagugcagauggggaaacaggguuggagagagggggccucaucugggucguuaacaaugcggugcguagcugugagggaguuuacacuucugacuucgggccuuggcuccugggacggcgcacuggugcaagagccgcuucuggagucugguggacucggguucgugucuugccugggacagucuuuuuuuucuuuuuuuugagacggagucucucucuggcacccaggcuggagugcaguggcaugaccgcggcucgcugcaacuuccgccugcuugaacuggguucaagcaguucuccugccucagccucccaaguagcugggacuacaggugcgcgucaguaugcccggccaauuuuuuguauuuuuaguagagacaggguuucaccaugcuggccaggcuggucucgaacuccugaccucgugauccgcccaccucggccucccagagugcugggauuacaggcgugagccaccgugcccagcuugccugggacaguuucuaccugagugacgcugggcaagucgcuucccuucucugacccuacuuguaucugaagauguggcacuuagcaggugcuuaauaaacgcuaguuuggacuuuuaucuggaagcaaaggggaccgcugauuuuaaaccuucaguuaaacuugcuugugaccucuuuaaauauacaauuguaaauuuuuuaguuggugguuuacgcugaugucccggauuauagguuaaauuaggaggaaauuuucagcauguacauccaugacaguacacacacaaugucagauucaaagcucccaauuaaaggcaaucaucugccucuuguaacaucaguuaagaucauguaacaucuggucccugcuguguguugagcugccucccaggccuuggauauucauagacuaaugcauugcuugccauggguuuggugugauuuucccccaucuuauggauuaagaaagugaaaaucagaaauaaugacuugcucaagaucacacacgcuagguuagacacagaucuguccuguccccacauaugugcccuaaccuaccaccaacccguuuauuagcagagacugagcuaugggcucagcccacuccagcuaaaaaugugaagaaaacguaaguggccaagacaagaaugaucaaauagguggguaaggcucuaaauggagucaagggggugucagagcaagagcacaacuauucucaggcaauguauugguagaagggggggugucauacaaggcucaccugcuuuccugguuccucucacucccaggguggcaaccaacuauaucugaggaccagagccauuuuggggcaccagagcuugugaccucuccaucuccacccagcuggguccaggggccacucucagcacucaccucagcagcugacaucauaaagcagacuugggaaccuggaagcacucuggagaaccuuucccugagacauggagcuuuggggccgaaugcugugggcccuccugucuggcccagggaggaggggaaguacccggggcugggccuucagcucauggcaaccccaaccaccucuggcuggguuauccagugccauagaacuggucagccacuggacuggggucuuugagaagagggguaucccugaggcccgggaauccagugaguacaucguggcucauguccuuggagccaaaacaguuaaguuuaguguugucaagaggacaggaagagggaggagggaggacuuggggaagggauauccagguuuucuguucacuaagagugcuuagcugagacugaugggauuuuucugaaggaacgucuuagcgccuggcacacacuguaacaguuuguuggaugaaugaauauaucucugccuaaguguucugggauagacaccuggaagccugguguuagcuguguaaccuuaggcaggaugcugcccccucugggcccagaugaugagaggguugggccuccagaccagugcugggcaggcauuauccacauaagacaccuggguugggggccuugggcccagugagccagccacuuauauucucuguggggacaguuucagagccugaggccggcacuuuggacccagcccuugaccucucagcaacuacaguguauccgggagcugaguagccgucgauugcagaggugagcacccauggaucagaccugaaggauguguucagggagcagcaguccagccuccccuauccccaccaaguucagggaggaggagaauguccaaggacuagggagguguuggggugcaggaguggcaagaguggggccgggguacugaauaggaagaagggagggagggaggguuuugccucaggagucccaaggcccuggagacauggucuugccugauaccuuuggccacaagugguaucucaacccaggcaugguccuguugguccuagcucugucccugaugaccacccagcugcccccucugcaggaugccggugcaguacauccuuggagagugggacuuccaggggcucagccuaaggauggugcccccaguguuuauuccucggccagaaacagagguaggugugccaccagggcaaggcaggaucaggaugaugguggaguucagggcaccagucuuaccccaggcuuccuccagggggcacuggggccccaugacuucagggacagugccuuucuagacauguauuuccucucugacuguguuggcagagcccagaggacagaggauuccuguugguccccuugacuguuauguuccaagcuaucaacccagccucuaggucuggcaauggcccagagugccucaaauagugcugcccaaguacuuagccuguucugccauuucucugggagccaucccauggcucacccaacccacagggaacaaaugucuuccagcagcuucucaggaggcauggaggaaguggagagggcuccagccggacaccuggagaccugguaucagcugugcaaccuugggcaggucacugcccuccugccaucucugggcccagaugaugagaggguuagcccuccagcccagagaaucugguggcccucuuaggucuacugacuggucugguaaucaccuguguugucccucaaauuacuaggacuagggauguguggcgcaaguguguuaucccuugguaaggcacccugguccuggaagagacgcuuuauauggcccuucuuggacuccccucugaccuuguagaugacagagcugggagccagagggcgcagaccagggaguagagcugggugagagcuggugggcaagccagagggcgccagguucugagaaggaguguuucuagaaagaccuaggcacacaaacauuucugggaaagguuaguucccauuccccugcuguggccagggggccccaaacccuucuuucacuuucucagcuucuguccccuagccaagaaacucucugaccccucuccucuccauaucaugugguugggaggccagguccuugcuucacugcccagugucagggcagggacaguagggaaucugaggccuugcugaagucacagggcugucaaggaagggagcaugggggcagcacguggacuuccugacucccagcucagagccccaucccucacauggggcugccccaucugggauuggcaugaccuaggacacaguauggagacccagagcaggguguggccugccaccugcagacuuugggaggcuuaccuguggcuccugaaaacacgugaucucuggcgaagagaucauuugcugucuccggcuucccagggucagggcauggugacuuuugaguuccuucagagcugaccuggcaccagccauaugugccaggguucugaguaucaaguguggacuuuggcucccauguggcccccugauucuuggaugggucugggccaagagagcagcucuacugcaagggguggggugaggggagaugcugcgauugggaggccaggugcucaucuugcugugcagacauuucugagaacucaccagguucaccccaauguaaagccacaucgggggaugccuuaccaagaacucaagaggacguggccuguggcagggaguagugagaaugggugcaggggaugguuucugaugaaaggggagucugaagugcaaacuugcaggaggcaugugcccagugaguugcauuuucccuaagggugagaaggugguucagccccuggccuggcagugaauacaguaggaaacucagggcugggggugugaaccauucucacccagccugcugugaggcuguacagguugugggaggcucaguguuuugucugugauuggcuugaaggaggcaaugccaccucccugggucugccccaccagggaugccauccuaauagaggguacucaugggcacuuagguucugcccaggccuugggccagccucuugaugggguauggaguccauguuggggcagcaguucuaggcagagccaacaacugccugccccucaccucuuucccgcaugcgucugugccccacccuguucuuggauucuuaccauauucaccuggagggggugcccugagccugugaccagcauggcuuuuagucuugccgaaagagccaccagcguuaggcugagggaggcucuucacuaggaggagaagagaaaguuucuggacuccuugggcuguuaucuaccccugccccagguggcucuacaaccaagaugaguuuccggugcucuggaguguuauggcaaacaagaggccacuagugguggcaggggcucaguuucuuagcuucuuacccuccccaagguggccauccacauacguggugugugucuuugaggucuuugaguaucucugugagguggcuggccaguguggcuggcugaggggucauucuccagccagaguaggucugucuaugaccaggaaaccaagagaggcuuacacaccugacaacaacuggucacccuaccaaccucucagcuuguggccucaccacugagaccacaggcucucagccacagcccuauacugcucacucuguaccuggcccaaccuugcaggcuaagcuugccacaaguaccuuaguggucuccaguagugccuggcacagggcuggugagagcuagugaauacacacucucuccugcuggaacugggcccccucacccacaggcaaucauuuguuaggugcagaagaggcuuggaacauggaggguuggaccugcuggccaaguucugccugcuuuggacuugccacccucagggugggugaacauuguugcuggguuugggggccuggaagggugagaugcuuuuuggaacccagcacuggggaacuuauguggaaaaugggugugagugaucuggagcccucugcuccauugggccuggcugauggcauuggggugugggggagaccugggggugugagacucagaggguggugccacagagagcuugcccaucacuuagaaaguagccaagagggccaggcgcuguggcuuacaccuguaaucccagcacuuugggaggcugaggcggguagaucaccugaggucgggaguucgagaccagccugaccaacguggagaaacccugucucuacuaaaaauacaaaauuagccaggcacaauggugcaugccuguaaucccagcuacuugggaaggcugagacaggcgaaucgcuugaacuugggaggcggagguugcggugagccaagaucgcgccauuguacuccagccugggcaacagagcgaaacucugucucaaaaaaaaaaagaaaagaaaagaaaaaaagaaaguagccaagagguuugucugugggccaagcccugccagugugggacacacugcgaugagucagaccucaggucuuccuauuauggcgucuggugggagaggcacaccccauccuuaggcuagaccuuaggcucaggguggagaaagccgugguagagccuggcccaggcuugaggaaggcuuucuggaauagguaguccucuuuucagaucagggaagcacccacuugcugcccaccauccccagcucccugagccagucuuuccugagaccuggggucccaggaguccugacccucuggggggcuucucugcccacauccaaagggaugccuuugagaaggagcuacacugcccuuuccuugucucaugccuggcuacucaggugucccacuccacugcugguuagaaaaauuuuggccauuggacggcaggagccuuccacccuuuaccccuacccuauguugguuuacaggcauaguccuugcaggcaguggcuggguaggcaaggcuugaaacccucuuguuuccaaagugacagugucugaaaauguccuccugcugccagggcagguacagugcagucaggcaccucccucugcacccaugccuguugaccuaugccuguguaugccacagcccucagguccuuagucaggaccauguccccccauggcccaucuccuccaaaagagggaauucccugucccuuuggccuaggagccucccugggggccucucaagcccagcucugugaggaggcuggggacacaccagcuccugauucuuggccaccaugaaaccacaggccaggcucagguggggccuugaccccaggccucaguuuccucaugggacacuugugaggauuuaacagauuaauacaggaaaaacucugggagcagggucaggccagagggaguggacaggaacuaucagguaugguucuuagcuuuuuucuuuugagauggaguguugcucugucucccaggcuggagugcaguggcgcgauccugauccacugcaaccucuaccucccgggcucaagcaauucucccucucaccucagccuucugaguagcugggacuagagacauccgccaccaugcccaugccuggcaaauuuucacaccuuuagcagagacgggguuucaccauguuggccaggcuggucucaaacuccaaacucaagugaucuguccaccuuagccucacaaaguguugggauuacaggcaugagccaccgugcccagccaguucuuagcauuucuguaagcacagaaugggaggaugucuguaaagggcuuagcugggguugauugaacacuuaacaugaaacagguguggauuagugcauuuaauccccaccacauccccacgaggugggcuauccucaacugggcucagauguacagauggggaagcugaggccuggaggggcagggugacuuggccaugccccagcugacaugaaggucagucuggcuuuggcuaccuccccuuccuacguucacaaggguaacugcuuaggccucuguaccaagacccccaggagccacguuggcaccgacucugauccagaucccucugcuucacaggaacugguugagugggugcuggaagagguggcccagaggucccaugcugugggauccccaggcagcccccucauucuggaggugggcugcggaucaggagccaucucccucagccugcugagccagcucccccaggugagccccuccacccacucuggauagacugugacugacacucacugucccucccauuagugcuucccccacaucccucugcuaggagcgcuugaggggaagcagcuggaugagggaggacagggcugccccuagcccacugugguucacagacucuaacgccuaccacaucuaucuggcuagacuuuggccaagaagaaaaggcuguuggguauuucccuucucuucuggugggggguuggaggagggucccccaggcccaguaucuuccagcaucucucagcauugccuuccacauauccucuguuuguucuugggacagagccgagucauugcuguggauaagcgggaagcugcuaucucucugacccaugagaaugcucagagguaggugggggaguugcacuuuggggccuaaucuugacuccuuuucagguuucaaacucaccaaugucugauuucuacucccaagaaggaggaagcagugggguagccuggcaugggucccaugggguucugaauggguagugggcagugaguaucuugccaguccaagaaggguugacuauaagaccucauucuuguagugaaggguaggggucugcccccgugccuaccccuuucucccugucuguguaggcuucgguugcaggacaggauuuggaucauccaccucgacaugaccucagguacccuccccugcauguuccuugagagagggagacuagaugcaggugcugcuggguggaugaggcacuccguggagauggagggagagcucccccaacagccacacagccacacacaacacacacacauacacgugugugugugcacguuuguggcagcucaaacgaagccuuggcugaggacagacaaggugcuuuugccuccuaggcugaccugacccauaagggaccagccacagagaacuuccgaauuccucacaaccaaugaguuaagggcuugcuuguuggcaacagauaagcaaaagcuuaaaauaaugccuucaggaccaaaauacuugagugccccuuucccccugccuggcaggggaagugguccaggcacugcacagcucagcuauagccuuuacagugucuccaggccuccaacuccaguucuggcuccauugccuuacccgugggauccuugagccucagugcccccuccauggaaugugauauacuugguguagcaccuggcacagggugaaaccaguagucagagccaucaggaauuggcugaugaggccaggccuacccuccauguacucucaguccauguuggcuauaaggcuaguggagcuacagaagagaaaggcucuuuucugccuaggcaaucagggaggacgcccuggaaguggcacuugaacagagucuugcauaauaaggaggauuuuuggcaaggacacucuaugccuugaaaugaggggcugccauguuaaagcaugcacauuccccaccaggcugccagcuggggacccugggcacuaauuugcaggucuggcuuaucagauccagaggcaggcccaagguguggcauggugagagggacaugguggcagguggagcuaucauccuuuaccucccaauggguuagucccuacuguguguccucuucuuugacgacagaaaggagcuggacacaccugcccuggggccccauggaccugauugucagcaacccucccuacgucuuccaccaggacauggagcagcuggccccugagauccgcaggugcuaagcagggugggccagggaggccaggccugaaaaggccugaugggauuagucugcccucgaggaccacaccaucuggagggacaggggaguuggugcugaaaugggcaaugguguuaaguugacgcacucgagagcccacaguccuaccuagauucagcuucuaccuuccuacuuccuuacuuccuacuaaaacuacuggacagccaccgaaccucucuggaccuguuuccugccucuagaaaaagagagguagugcucugcagggccacgggaggacucagugacgacuugaaagcaucaaacacaguggagggcucauacagggugcucaguagaugggcgcaucauuuuauagaauacugaggcccagagagggaaggugucuugucuguggucgcaugggggcucagugggaaagccgggacuaaaagcuggccccaggcuagcuuugugccaggccauccugcucuuacacaggggcugagaaccaggggcagcccaggaguccuggauggggcagcagucauguuggauggggcugggguguuggcucucccuuucugggcucucaggaguggucagggcuagccccagaucucccagaccaagaagaggagcagccuguggggagacacucaugcccugacaugagucagugcaucaagagaggccaucagccagugggauucagcaagcaugccuggcgcugccugguagggugcugcccaugggaggaagagaagaggagcugccacccauuuggggcccuccuucucuggguccucagauuugcccuucagcccagaguguaaguuccacagggccccauucauggaggccuugcccaugcccuccaugcauuucagauaccccuuucucaggcugucaccucccacugcuuugccuuucagcuaugaagaccccgcggcccuggaugguggggaggagggcauggacaucauuacccacauucuggccuuggcaccccggcuccugaaagacucuggguaugaaugggaugggucuccuaggucuguccccagcaggcuccucugcuccuaauguguacugggcaggcccuggcagaggucagcacaggacccucaccucgccagcccaagcagcccagaagggcaggcgccagaccuguccugcugagcccacccauuucucccccauguaguaguaucuucuuagaaguggacccaaggcacccggagcuugucagcagcuggcuucagagccggccugaccuguaccuuaaucuuguggcugugcgcagggacuucugugggagguaagauccuagcccccuuuagcccuguagcaugcuggucuuuccacuggggccauccucagcccuggcugucaggagagugugcuguucccacuuccuguucauucccugaggcccaggugguaaccagccccugucccugucuccucaggccccgguuccugcauauccggaggucugggccauagcauggcugcccuguggaugccuugucagugccgccagccugaccagaggggagguggauggcacuuuccagagcccagguucuuauggcauuucccaggguucugugauuuccccaugcucugcauuucuaggauauuucuaggacaccuggauuggcuccaucacaucagaguggcugagggcaguugcucuguguuggugaaauugcuguggggguaucgggggauauggccaguaaaguauugagagacuaacaaauggugaccuaauguuuuguccaugacuugcagguccccugacccccuuacucccagguagcacuggggcaaggguuuccuucugccccagcagggcuggccgucaguccccugcuugguaguggugugggggugcaguguggaggaaggcacgugaguccucacuccuggccuuggauaccauggguccuggcauagagcagcucacucccagggauugauuaguccuccacugcccugggugcaugcguacacaauucccuggccaagccug

SEQ ID NO: 16117 - RNA, 4940 nt, Homo sapiens
ugcaguugaacgugaugagggggcugcacaagguggccugacaagagcccaggagucauuccucagagaacugcuuuauugauacugcgagccugggcuuggcugcccacucaagugguccuguagaaaauaccugggagcuggagcuguucugguccagaagcagucaccgccacagcagagggaaacaaauccugacaggaacagucuuucuggggaugggcagggaugugcagccccaggucggcuccugcauuugcugggcccccagaacauuuuuggcaaauccuugccuuggcucagggcucucggcaaccaguuucagaugugagggccggcccaggagcuguggcaucagugucccugcagccacuugcuuggggcugccagcugauguacauucuuaccucagaugagggccuggacuggccgaugccucagaggcuccgggccuggcauagugguugucuggaguuggaaccagguagcaagaguccuggguaguguuggcgagaaacagcagaaggccauggaaagccccagcaggccuucuucccucuccucagagcagucaggugcccuggaguagcugagaggaugucaaggggggcuugggaggggaggugccacacucaagguggucuggaguuacagcgucgggggagcugccucgaaggugauuagacuggauucuggggcagcccccuucccugggggugugggagcuuugucugagggcagggggcuguccaccuuggccccagacuccucuucaucaucauccaugcugggccagauggacuggucuuccacucucuucagccgcucauugagugccuucagggccaguugccuggggccagaggagagaggaaaggucacucuggguuuggccuuggcucaugcccucuacccuuccgcagcaggcugacuccucaccguaccaccuagacuccucccccagaauccuauguuuccccuucaccaugcagagccugggacuccccagagauugguuuaggacccacucugccaucagaaugauaacccaaaggcucuaagaaucuucccuccauagcugaggcaccuccgggaugggaaggucagcugggugucugccagacugcccacgaggccagccaccaggaaugguucugagggugguaucuaagggucaguggaacuagugcccuagggcagauggguggaacggcaaguucuggaguuuccaggaguuucugccugggugcuggcaucacauccaagggaaggguuauuaauucucccccucuccugguuagggguaucuugagccuccuggcaagggucaauggggaaggcuggaauucaacaccucccuuggcucucagcccaggaagcagggccaacuugggugagucuaccccuccuaacugaugcuaauauucucccucucagaagaacccccaaagccaccaaggcccuuguuagagcagggacuuagcggagcccuugcaagaggagaagaaggagaaacagcucacauggguaggcacaggccagagccuacugcuuccacaggguggacccuuagaggccccacuuugagggcaggugggaaaguccaacagaagaagguuuacacaugugcuugggacccugacccaccagaagguggagugcugcagcugccagggaaccguuucaacagugaccacuguggacuccuauaccucagccucucugugccaccaauguggggacagccuguguagccuuucagguuccagcugagaaccaaaaucuccaccaugucagggaacacgacaagagaggcaacaagggcacagguguagaaagcccuagcacgcuuccccccugcccgucagucucacacaugacaaguugguauagacaggacagucuuucccugcugcuacccaggcugccauccugaugaugcccuugccaguuccaucuaaagccugccaaggcagagagcuaguguuacgcuagucacuuccucacaaggaccagagagacagauaggaaacccugccucccucuccugguagcccuuuggaguugggcguggccaugcagucagaugucaaacuggcuggaggaauaaccgccacccccauguaagcuaacaaccauaaggcuaugccaagaacccgccucuugacccucccuuccuccccaccaaccugcuuccccccuguccauuuucuugggccuaggcagagguuuuugaauguccagccaacccuaacauuccaacaccucucaguggaggagggguccccacuggccuggccccaccugaauggcucugagggacagcucaauuccuaccaggcccagcucaccuggccccaucuuuaauaccagcuaagguuaagagagacuucuguccuuagggcuuaucaccuauaaagacccaagcucuagggcccagaauuaugcccugcagcaugcuguauauacuuuucaacaccuaccauaccuugggccauagugaucuguggcccuuccccagcuggaacuccuucaagaaaggagugugucccacacucaauuccauagcccaguggagaguaaauacagggauaacugcagcuaaauucauagagcuuccugccacaaccccauucacaggugagcaaaagcaggagccuuggcaaugcaaaagacaaagcccgucccagauuuuacuacucgaguaauugccucaaaacagugaggaauaauguuggaaauggagcuguggaucuuaugaaggcugggaccacucugcuggcuccacagaucugggagagagaguaagcugaauuuaaaaagaucccuccugcccuggccaaagugcauucagugaauaauucagcugggacuccugaugcuguggauagcuugguuuacagauaaugaaagggucaucgccacucccuggugucagcaggcucccucagugggucauguagccugucccugguuuuggugacacaugcuugcuggagacagagguaaaugugguaauaccccaagcuucccucucaauaaguaaguggcagagaagcacagcaucugaguuaaagcccaggaagaggacacagcauuuggaaauuggaguggcccagaucaccuuuugaggaccccaggccuccuucccugucccuuccucacaggggaaaguaccagcagguugcuucuggcucccacaggcccaaugucuaggauucugagauucugaggcaaggccaggguucugugucccuccacugggacuucacagcaccaaaggaaacugcauuucuugagacuuauuaaguggcccgaguggugagaaaagugccucguggaccccagacaccuaacugcugaguuccuuaaggccaaagacugauuuugucuuuccggaugugccccaauaccugacuguaggucuccaccuauguacagcgaacaccucaacagauggcaugugacucgaccaguaugcuccuagcuugacaagauuuuggaaaauuucacaguaccuucuccgcucggcgucuugagggucugugccuggcaggcugauggugauggaggauggggcacccacaucguagcgcuucaccgucuucuggcauaucuuuaccuucaccaggaggcugugcaccaaguucgccagcaaacccaccacaggcugcaggaucucagggaagaaaguggcgaaagcaaaguggucagccauguccccucggccccggcuauggcgcugguagaagcgaagauauacccaacuggagagcagcccgaagccauaggaagccagcgccgggcucuggagcagcguggcgagccgcagcaggagcagcagcgccagcagcagcaugggcaucacacugacgcgcaccuggggcacucgcaggaccacacagucccccaugguuugcuugagugccaccaggacgccaccuaggaagcccaaggcgccguggauacggacagugaacagguagaccagguugaaggaagccauguaggugaggagguaggcgaaggcccccagcagcccuacagacacauucaccacugagaagaagaugagcagcuccaaggccccccagaggggcuccagcaaacgcccggccaccaccaccguugucaggcugauggccacgucccacacaugcugcuccaucagcccauggguggccaggguccagauccagaaguugggaggaaagagguagcccggggugaccgccaggcagccuguguccacggcgaaggagagcagguagaggaauaguaccgccgcacacagagccuucaccaccacgcuggcgcuggccagaauggcccccaagugcuggcgggcgccuggcagggcacguugcaucuuccuggcggcugucggccugagaaaagggucugguaggccaggggccuccccggggccucguccuaguccggccccgaugggaggcccaggcccggccuagucacuggccuauggcccugguaaaggauccgcuuccgaucggguggggcucuggucccgaggggccgagucgggccuuguugccgggccgcagcguaggccccucgcccgggaccugagggaaggcccuggacggcugcggcacgcccgccuacccacccuguaggccccgugccaggcuagccugguuggcguugaccucagggcugggccuccuccauccacugcgaggcccuucgguucgcaaggggacuggugccucguucuguacccgagucaagccuggucagcucccgcucggccuggcuccuggcuucgaccguaccucuucucucggggggccgacaaacaggggugcugcgccugcgcguccccggcggcagcgggcuguccucuaagcgccugucuuccggcuccucugcaugcugggauacggaguccuugguugcagccggggaagaguugaaca

SEQ ID NO: 16118 - RNA, 3543 nt, Homo sapiens
cccccacagucuggagacuccagcacaguagacaguuggggggacagaaaggacacacagcuguaccauucacagcuacagcucuagggccugccagggcccggaguggccugggaggcucagcagcuagacccuggggauuugugugcuaggagagcuucagccccucagggagcagccaggggucgggggugggggguccccaucuugcccagcugcccauuuuccugugcugauggcauuaacaagaaccauccccaacucugggcugcuucucccaucaaucuuuucagucauuuuuuacaaauuuuuuacuuuuuucucuccuaaaauuucugaacauacaguacaaguaugagcugccuugcaggagaggcagucuugcagccccagcuucauccagacacaugaugccuauguuccucugggaugacagagaaaggggaaggaaaugggaggcacuccagcaugaggagcaggaauucacacacgggccuccaaaugcccaacugucccagugccugagguguccccugacucagcugagagaguucaacaggucccuaggcccagcuccuacauggaggggcaaauccaggcuuccccuaggcugggaagagcucaugguuggauccucuugcgguauagguaggcauugcucaccugguucauaaugaccaagcuggugaggacagggcauaauacagccagguaccaggcugcaccagugacagaggcagugaaccagagugagcacaugcccagcaagaggcuggcacuacccagcagguagcccaccagcccagaaguagcaugguauagcuugagcuucgccaggggccaucggggcagcagcuugggguagagcagccccaccccaccugagcacugcagcccugcccacagcacagccagcagcccugccugcccaugccgcguaaccaggugggcuuugccaagcugcucuuuguggaggaugacaaggccgaggcccagcagugcacacagcagggccagcagcugcagcacccaguggcagcgugcucggccuuuccgugagagggagugcagcagcgaacucucaggagaaaacaccaguagugccucggucaucaggaaggagaacugaggaaacaggggaugggaagcucaagugagggugcugccccagaagaggagaagagggcuuuauguaacccuuagcugccagugagucugggcugauuccccuuuuucuuucucuccccacugacaagacuauccauuugguggggcaagaguggaaaaccccaucugggaugauauaugugcccugaauaaucuccacacuuccuccuaggugccagucugaaaugucaucugucguauguuaccaagcaaacacaggguuugagauguggcaguuauaaaugauucacaagcuuuguuucccuaacguggggcuggauacaauuucuuggcaagagcuggccacaugggugcacuguuucagggaaaguuaggugcaucaccagaaauuaaaguaaaaagggacagagguacauccaaaugcaaugucucagcuuucugccuagaggugggugaagccucauugugcuuagacaaaucuuacccauuugaccuggguccugggucuucauuacucugauucaagucucuuuuuuuuuuuuuuuuuuuuuuuggagauagucucucucugucacccaggcuggagugcaguggccugaucucggcucacugcaaucuccgccuuccggguucaagcaauucuccugccucaggcuccugaguaacugggauuacaggcaccugccaccacacccagcuaauuuuugguuuuuugggggguuuuuuuguuuuuggguuuuuuuuuuuuuuugggacagagccucgcucugucgccuagguuagagguuagagugcaguggcgcaaucuuggcucacugcaaccuccgucuccuggguucaugcgauucuccugccucagccucccgaguagcugggacuacaggcgcgugccaccaugcccggcuaauuuuuuguauuuuuaguagagacgggguuucaccauguuggccaagauggucucgaucuccugaccucaggugaugugcccgccucggccucuaagugcugggauuacaggcaugagccaccgugcccagccucaagucugaaauauauaccaugggcaggaguaguuggagcaugcaacucuuccaaacagauauuaaauguggacaaagauucagaggcugccagggccaccaaccaugcccaugcucccaccccuaagaacugcccaggcccacuacuuacagccaaagacauaagcaccgggugccaggagaacaggccuggaaugagaagaggaggccucauggggcugaggcaagaagaaaccagccauaccaauccuuaaggguugaggaauaccagcagcccaucacccaaggaggugcugccaaacugugagccccuucuugcucugcaacaagcugaccccacaccuauccucucuuccuggccucuuccuggaucagaggccaugcuuugccacuccucuggcaguccucccuccuucccuuacaccuccugagaggcagccaaauggagcacccagagaaggaaagacaaaccaggaauucugugugcccuggccauaccuaccugcuccaccucacucaucgcuccagcacagaauucccucaaccagccaggccuguucccggaagucccacugcccuuccuccccaggaacaguggcccuucccuucccagaagucagcuaugaauucuacuuacuggagccaggccuggcaagcacagccacaaagaugguaaagcccagggccacaaggugggcggcagcgccagaagcaguacgcagagcucgguagaugugugacucggucuccgcagaaagggccaucgucagccgugcuagugguuguagccugaaagcauaguagcgugggccaggaucucaggugcccacuguucacuccucacuggagaaaaggcugcaaggcaggaaugccacccucuuccaauaaguuaugguaggaaagaacaguaccaagaccagcaccaggaauggucacaacaugccagucgacggccggcggccugucaacguguacccaugucugaacugguaccaaucgcuggcccgccuuccagguaggaggcgcaaagccauguaagacuacaaaucccagcguguaccacgccgucgccggcaguagagccagcugggagggcgcggagcacuauggaaauuguaguucccugcugcggucccaguuacagcgugaaucccuuagcgcaccgccuccccaagugcugccagcaugcugccccuccacgcuagggacuugccugccucugccgcagcgcagaucugaugcggugguuuccuccaaagaaagcgggauacuccgggcccugccgcgcgcaccgccgcuccgucacggagccgcuuuacuuccgggugcgacgucuacccacccaggacuuccugggacgagccgucccccgccc

SEQ ID NO: 16119 - RNA, 3333 nt, Homo sapiens
ucaugugcaggaucuacaaaucauuuuauugaaauugaacaaauaacacaacagucuuccuaagcuaggggccauccuccccaagccauuucccacauuauagaagcacagagcuugcacaguacuuaaaaaaaaagucaccucuauauagaaaucagacucugccacgacaucaucauggacuauuuacaaaccuucacauuauaaguauuccuuuuaugguuuuucccuccuuucuuucccuacccagggguucuagugcuuucccuugacugauccugaagggguggggguuacuguaagggagggggugguaggcuacucauaacuacuggcaccagccuuaggguguugucccuuaccacaagguggugaacaguccccucccaauuggagggguggaggauuuggugcaaagccauggagauuagacagaauagguggguuggaguaacuccccauaggcacaagcauccgcagccuguccugaccccagccugcacucucucaacuccucaacuggggguucgggguuggggggcaacaguuaguugcaguagggggaucagcccagcccuggguagagggagaagcccccacccaguccccacuccuaucaauagccagcaaacuguccauccaucugaaggcgggaacaaauggcagguaggucggaagaaucaggcuggcacugcccccagccucuguccaacacaggaggaaucgagguagcaaacggcugaaaugcucugacuagggguuaaaagggaagugaaggaaaggaaguuccuacuuguauacagugcccacagccuaggggcuggaagaaagcauaccuugcuuguaaagugcuguagccucuagcagggcuaggccccaggcaaacuuggaagaaagcagaccaggcaaggaaccagguaacgggcauuccugacugguauaugcccugcugugcugcuugcagggguggcuugggagaguggggugcuaacucugccauuagccuucaccacccaccaaccaccucuuguccacacacaaaccaacacccaaccaauacugugggaccgacccgcucacagcugaagguuaugggccaacagaguuuauucaggguuguggccccagccugggcuccucaauggaagccacaccuugauugagccugggaguuucuugccggggcagggggugcuucugucugccaccucccagggucacaccucauagaggaucacagggaaauccacguggaugcgggggugauccagcuucacgaugcccugccauggaaacagaggcuaguaagggucagcucagggccucuacuucaggaagcuuccuuguuccucccagauccccccgcaaaagcccccaccaugacaacagaucccaucuggguccaccuccacacgcuuaguguaggcucugugaccgcugcccagccccucaccugaggaaucagauucuuaugcacucgccucagcuuggcccgcuucugcccguucuuggugacgauugucuccucauagaacucgugagccagauccccauccucaucauagaacauagagcuguguagagggagaaggaaacaggcugggcuggagccccacaccugggcauggcaaaugucacaggucacggggaagucuguggucuucccaaccccaagugggaagaaaagaggauaauaugccuggagaauccuuuuuuuaaaaaaaauuuuucgagacagaaucucacucuguugcccaggcuggaggugcaguggcgcgaucucagcuugcugcaaccucugccuccuggguucaagcaauucuccugccucagccucccaaguagcugggacuacagacaugcaccaccacacccugcuaauuuuuuguauuuuaguagagacgggguuuugccauguugcucuggcuggucucgaacuccugaacucaggcaauccacucgucuucaucucccaaaguguuaggauuacaggcgugagccacggugccuggccugccuggagaauccuuugccugggguuuggggucuacuagaagaaagugggaagugaggugaugggugggcagugcuacuaugucagacccccaagaagagagcccacaccagagcacaccauccaggcagccaccaaggccaguucucauccuugauuuguucagcaagggcagccauucuaauaucaggacuuugccuucacccaggacuucuagagugggcagggugguggccugggcauguuggucucacuccagaagaugcugcuggcccagugucaaagacugaaauagcagaagccuaagcuaggaagaagcacaaaggaaugaaggcugcgucuccccugaccccacaccccagguggcuggugaauugccacuguugggucuuccuggugucuacagccaaaucucuagcacagggagcgcccaucuccaggagcccacuagagccaagccaaucugguacucuugugcgggccucugggagacugggcuggggguuggguggguaggucagcgcucuggaucuggagaacauaacugggugagggucuuuuuuccucagccucacccccaauacugaggccuaucccugcuuucccagccacuacgcucaaagguucagccccacuacugucaggaaaagcagccuaaacagaggguuauuauccccuuggaauaacugggggggaaagggaggcuaggacccuucaguaugcaggcugagccggaagggaugaaaggaagagaucuuauggaggucuuauggaggcccuagcuuagcuuuaccgugcggaagguccgaccagugacaagccucaggcccacucuucccuagggagacuuucagaguggccaggccgccaggagaccacugcccggcuuucuccacccccagcuccaaugaggcucaaaauaugggggucguccuggcuuggcuguagugggguacagcgguggaaguucccccguggcgcgggacgccuggccgcccgccuguuccccccgccaggguggaacccaugcccuuacccgcggcgcgugaauacgaaggggggcacagcucggccccgaggccgcaccaaagcuugcucagcuccugcugccucugagccgccgccuccggccgccgaggcgaagggccacaggccccgagcuuuggacccgcuggcgcccaugucagggccgccggcgcauggcgggccccguggccgcucugcucacaccgcaguccgcacuaccauaaccugccccagccgcugaucgcaggugccgccgccgccgccuuccgcaggcucggcugucuccacggaaa

SEQ ID NO: 16120 - RNA, 8636 nt, Homo sapiens
uuucuguucucccuccccaucuacuaucccaggcuugggcccaacuggucuuccacgaugucaccuuugcccuccaaggcagucuuccccagguggugccucucccccuacucagagcccagccugucuuuaagagcugaggcuggacccucacugggagcccuggcagaguuugggugauugcuaugggggcagcuauuucuagacuucagaaccugccaucugggguggccagagaguguugacaggccacaggaggagccaggaggcuggugccccuuccccugaccuugggccacccaaagcgaggcuuuggcaccagaggcuuggcuaggccuggcuugaagagaucaggagagggaggcagccauuaaguuaacaacagguucuuguacaaaaaucucaccaaggaaauaguguagauguggcagccagcaguagggaaggagagaccugcccauagccacuuuauucccccaccaacacacacccccaggccccagauccaaauggcaucucagcugggugcuugggccucacuggaguugagccuccgaagcuggcugaggcuggccaagcggaguuugaguagugucuccuccugcgugcggagcgugugugccaggaugcgcagggauucacucugcagcacugugaaugggaagugggggaucaucagaccaugugccaccccgugaccccugcagacccagcccaggaccaggggcagccacgggccucccgccccauccuucacugcugcagcaucugcaguuacuccuuccagcugcacagaagggccucccaguccccacugccuugcuuuccauuccuacuagcacccuaugcguccauaccgcucagguagacagccaggagugcgagcacuaggcaagugagcaccagcagcgcgagcagcagcaggaacccuccucgucuguacacagggcugcagccagccugggcacacagugacggcggcaaaacgcccagcagcucaucccacggucgugccucuucaguuagauaggggcgcagugugccugcuggguggaugggacauugggaggguggugggugcaccugcuuucguccccucccccagcacaucauccaccccacuguccccacucaccuccacuauguaggucgcugauggacuccaccuggugcaggcauaccucaugcacgugguugggggccaauggcccccugcuccucuggcugggcaucauuggcgccacggagucugcaggggcagcgcaggcugauuuagccaguggugggucaacccccuuccuucuaccagguggcuucaggcagcaaggacuugcggaugauagggauagugggacauuugguuccaaauccccuaaaacugacucaggaauuacccuugauuuggauccaggaugaucccagacccuuacaggcuuauucuguauacaggagcaacagguacauuugauuuguuuccuuccaagcaccccagggacucacucaggcauuccucugccugcuuauuucuagcaguuuaucagccuugaaugcuaaaccugcagcaaauggaauucaguccugccucuuuugucaguucucccugcagacccaaugccuggcaucuucuggucagaaagcccuauuguagccacucuggugccuuucccuccuggccuugguucuguguuuguuaacauacucagugugacucugcuguacaugugugaacccugcuguuuucauucaacauuuacuguuggggagacccuucuuuguuauacuguugcacaugccucugaggucucucccuucacacaucucccugaggcugccugggcaucuagguuguuugcaguccccgccccccuuuuuuuuuugagacggaguuucgcucuuguugcccaggcuggagcgcaauggcgcgaucuuggcucaccgcugcaguucccuuuugaaauuaacccccaggacauccaccguugaauaugaagguuuuuucccaauuuccugauaguuuaauucccagaaguggaauuacuggauccaagagcagggauuuuuguuuguuuguuuguuuuuugagauggagucucccuguauugcccaggcuggagugcuaugucgugaucucgccucacugcaccuuccaccuccuggguucaagcgauucuccugcaucagccuccugaguagcugggauuacaggcgugugccaccacgcccagcuaauuuuuguauuuuugguagagaugaggauucaccauguuggccaggcuggucuggaacuccugaccucaagugaucugcccgccucggccuuccaaaguccuggcauuuacaggcaugagccacugcauuuggucguuuuuuguuuugguuugguuuuuuuaagauggagucucccucugucgcccaggcuggagugcaauggcaagaucucggcucacugcaaccucugccucccggguucaaucaguucucugccucagccuccugaguagcugggauuacaggcgccuuccaccacacccagcuacuuuuuauauuuuuaguggagaugggguuucaccaucuuggccaggcuagucuugaaccccugaccuugugauccacccaccucggccucccaaagugcugggauuuacaggcgugagccaccgugcccggccuguuuuuuuguuuuugagacagagucuugcucuguugcccaggcuggagugcaguggcgcaaucuuggcucauugcaaccuccaccuccuggguucaagugauucuccuguuucagccucccaaguagcugggauuacagaugugugccaccacgcccugcuaauuuuuguauuuucaguagaaaccagguuucaccaugcuggcuaggcuggucucaaacuccugaccucaagugauccgcccgccucagacucccaaagugcugggauuacaggcgugagccaucgcgccuggccugagauuuuuguuuuguuuuugagacagauucuuacucuuucacccaggcuggaguucaguggagugaucacaguucaccgcagccuccaccuccugggcucaggugauccuccugcaucagccuucccaguagcugggacuacaggcaugcacuaccaugcccaguuaauuuuuuuuguauuuuuuguagagacaggguuuuacuauguugcccaggcuggucucgagcuccuggucucaagagauccauccugcuuggccucucaaaaugcugggauuacaggugugagccaccaugcccggccugauuuuuuuuaaagcuauuaccaaacuguccuccagaagcacuguccacagcucccccgcaggguauaauauugccaccauuaggcauccccauaggaaaaaaauuauauuuacaugcacacgugcacacauauauuugcuaacuugagagaugagaaauggucuuucuuauuuuauuggguuucuuagccuagggagugugacuaauacguguguggcgcuuuuuuuuuuuuuuuuuuuuuugagacagucuugcuguguugcccaggcuggagugcaguggugcgaucucagcucacugcaaccuccaccucccagguucaagcaauucucgugcuucagccucccaaguagcugggacuacaggcaccugccaccaugccuggcuaauuuuuguauuuuuaguagagaccagguuuugccauguuggccaggcuggucucaaacuccugaccucaagugauccacccgccuuggccucccaaagugcugggauuauaggcgcaagccaccaugcccagcuguguguggcuucuuaauuaucaauuugaagccucugcccauuuagucacuugggucuguguacuuuucuuuugauuuuaauuauguacuuucacacucauugaaguuuuugcuuuuuguuuguuuguuugagacagagucucuguugcccuggcuggagugcaguggcacgaucugggcucacugcaaccuccgccucccggguucaaggguuucuccuaccucacccuccuuaguagcuagcacuacaggugugcaccaccacacccugcaaauuuuuuuuuuuuuuuuuuuuuuugagauggagucucgcucugccgcccaggcuggagugcaguggcacgaucucggcucacugcaagcuccgccucccagguucgugccauucuccugccucagccucccaaguagcugggacuacaggcguccgcugccaugcccggcuaauuuuuuguauuuuuaguagagaugggguuucaccauguuagccaggauagucucgaucuccuaaccuugugauccgucugccucagccucccaaaguucugggauuacaggugugaaccaccgcgcccggccaauuuuuguauuuuuugauaaagaugggguuucaccuucuuggccaggcuggucuugaacuccugaccucagguaauccacccgccucagccucccaaagugcugggauuauaggcgugagccaucgcacccagccgguguuucguuuguuuguuuguuuuugagacagaaucucccucucuugccaugcuggagugcaguggcgcaaucucagcucacugcaaccuccgccucccagguucaaccgauucuccugccuuagccucccgaguggcuggaacuacaggcacgugccaccacgccuggcuaauuuuuguauuuuuaguagagacgggguuucaccauguuggccaggauggucucgaucucuugaccucgugaucugcucaccucagccucccaaagugcugggauuacaggcaugagccaccaugccuggccuuuuguuugucuguuuuuuuugagacagagucuuacugugucacccagacuggaguacaguggcaugaucucagcucacugcaacuucugccuccuggguucaagugauuuuccugccucgucuccccaguagcugggauuacaggcacgugccaccaugcccagcuaauuuuugcauuuuuaguacagcugggguuucaccauuuuggccacgcuggucuugaacuccugaccucaagucaucugcccaucuuguccucccaaagugcuggguuuacaggcaugagccaccguaccuggccaauauuuaauuauauuuucuucuaguuguucuuuaacuugaugucuaaaaauccugguccagaugccaagagcuccagauacccaccuggaagcugauaacaguagggaagagcauugaggggacaccuccagauaggagcaaggguggccuugcacucugggacugucauucucaggacaguaacucaaccuccaugauuuacuugaaacugccucuugacgugcucaaaagcaaguacaacaaaaacaagcaagugcugccagucauuaugucugggugguggguugaaggucauauuaaauucucucuuugggccgggcacuguggcucaugccuguaaucccagcacuuugggaggccaaggcaggaggaucauuugagucuaagaguuugaaaccagccagggcaacguagggagaccccaucucuacaaaaaaaucaaagauuagggccgggcaugguggcucacaccuguaaucccagcacuuugggaggcugaggugggcggaucacgaggucaggaguucaagaucagccuggucaacauggugaaaccccaucuguacuaaaaauacaaaaaauuagccgggcauggugaugggcgccuguagucccagcuacucaggaggcugaaggcaggagaauagcuugaacccaggaggcggagcuugcagugauccaagcucaagccacugcacuccagccugggcgacagagcuagaccucgucucaaaaaacaaaaaaguaauuaaagauuaguuuggugugguggcaugcuucuguggucccagcuucucaggaggcugaggugggaggguugcuugaguccaggaagucaaggcugcagugagcugugaucaugccauuguacuccagccugggcaacagagugagacccuaucuccaaaaaaaaaaaaaaaaaaaaaaaaauucccugcugccgggcgcaguggcucacaccuauaaucccagcacuuugggaggccaaggcaaguggaucacaaggucaggaguuugagaccagccuggccaauauggugaaaccccgucucuaccaaaaauauuuaaaaauuagccagguaugguggcaggcgccuguagucccagcuacuugggaggcugagacaggagaaucacuugaaccugggaggcagagguugcagugagcagagaucgugccacugcacuccacccggggcgacagagcaagacuccgucucagaaaaaaaaaaaaaaaaaagggccgggcgcaguggcccaugccuguaaucccagcacuuuggaaggccgaggugggcaggucacgaggucaggagaucgagaccauccuggcuaacacagugaaaccccgucucuacuaaaaaauucaaaacaaaaauuagcugggcaugguggcuggcgccuguagucccagcuacucgggaggcugaggcaggagaauggcaugaacccgggaggcagagcuugcaaugagccaagaucgugccacugcacuccagccugggcgacagagcaagacucugucucaaaaaaaaaaaaaaauuucccucuuuguacuuuguugugcuuuucucacacuuucuaaauugaaugugaauuguuuauuacaggaaaaacacacaguaaauguuauuguuaagaucccaaaagaggguaggcacaguggcuuaugccucuaaucccagcacuuugaaaggccaagguggcuggccgggcgcgguagcucacaccuguaaucccagcacuuugggaggccgaaguggguggaucacgaggucagaagaucgagaccaugccggcuaacacagugaaaccccaucucuacuaaaaauacaaaaaauuagccaggcguaguggcgggcuccuguagucccagcuacucaggaggcugaggcaggagaauggcgugaacccggaaggcggagcuugcagugagcugagaucgcgccacugcacuccagccugggcgacagagcgagacuccaucucaaaaaaaaaaaaaaaagaaaagaaaggccaaggugggaggauuggauugguugaggccaggaguucaagaccagggagacccuucucuacacacacacaugcaugaaaguaaacauuucccccuaccaggggcaaggccccucuccugcaauguugaaaauguuggcaguggcucacgccuguaaucccaacaauuugggaggccaagguggguggaucaccugaggucaggaguuugagaccagccuggccaacacggugaaaccuugucucuacuaaaaauacaaaaauuagccgggcaugguagcacaugccuguaaucccagcuacuugggagccugagacaggagaauagcuugaaucugggaggcagagguugcagugagccgagaccgcaccacugcacuccagccugggugacaaaaaaaaaaaaaguugaggccaggcgcgguggcucaccccuguaaucccaacacuuugggaggcugagguggguggcuuacgaggucaggaguucaagaccagccuggccaagauggugaacccccgucucuacuaaaaauacaaaaauuagcuaggcaugguggcaggcgccuguaaucccagcuacuugggaggcugaggcagagaauugcuugaaucugggaggcggagguugcagugagccgagaucacgccacuguacuccggccugggugacagagcgagauuccaucucaaaaaaaaaaaaaaaguugaaaaugugauaagaggagcuugcuagcugggccaugcucugucaugggccauaacauggagccauggagcagacaguccuacguccuggccaguacuggaccuguagcuuccuagauuccugcugcccuggccccucugagcaucaguacuucuuauaugcaguggugcaguuaggugaguggccaccaagcucuugacuagcugagucucugucugaccaggccaagggacccccaacccuaggcaguuggggauauuuagacccaagucaggggaggccagaggccuaacuacuuuucaguccaugggacagguacccaaaugcuuucuggaaccacuacccaccccaaucccagcuuccuuccuuaagagcugaaccggccaggcagcugaccggaugcccacacccaccugagcacagccuguaguugacccacuccuaacuggguagcuucucccaucccuccuugauguccccagcaggggaaacugaagcagggccugaggugacaaggggcuccaggcauggcaggcuuuuccucccugcacagggggcagguccuuuuacuggagcuggagcaugaaaauggguaacuaacuacucaagacagugaggucagugggacagagggugggucucuccaugguccacaaggucacaggacugaggccuugcccucccucauggucacccucuccuaccuucuugggucuccucaggcauggcaagcagugggcagucgggggccaaugauggcauccaguagcaggacuggacaaaugcagcagu

SEQ ID NO: 16121 - RNA, 2506 nt, Homo sapiens
ucucuaauccaaguuuuucuguuguaccuauugucagguuucagguagaagggcugggagggccaggagccagggccuucugugggugcacggccaucagccccuuuucuuucuuucuuuuuuuucagacggagucuugcucugucgcccaggcuggugugcaguggcgcaaaucucggcucacugcaagcuccgccucccggguucaugccacucuccugccucagccuccccaguagcugggacuacaggcggcugccgccacgcucggcuaauuuuuuguauuuuuaguagagacaggguuucaccguguuagccaggauggucucgaucuccugacuucgugauccgcccgccgcggccucccaaagugcugggauuacaagcgugagccacugcgcccaaccucuuucuuuuucuuuuuugagacggagucuugcucuguugugaggcuggagugcaguggcgcgaucucggcucacggcaacauccgccucccggguucaagcaauucucugccucagccuccugaguagcugagauuacaggcaugcgccaccacgcccggguaauuuuuguauuuuuaguagagacgggguuucaccaucuuggccagacuggucuugaacuccugaccucgugauccacccgccucggccucccaaagugcuaggauuacaagcgugaggcacugcgcccggccucuuucuuucuuuccuuuuuucugagacggagucuugcucuauuguccaggcuggagugcagugacacagucuaggcucacugcaaucucugccucccggguuuaagugauucuccugccucagccucccgaguagcugggauuacaggcgccugccaccaagcccggguaauuuuuuuuuuuuuuugcgacagucucccucugucgccuaggcuggagugcaguggcgcuaucucgacucacugcaagcuccgccucccggguucacgucauucuccugccucagccuccugaguagcugggacuacaggugcccgccaccacgcuccacuaauuuuuuguguuuuuaguagagacaggguuucaucguguuagccaggauggucuugaucuccugaccucgugauccacccgccucggccucccacagugcugggauuacagucgugagccacugcgcccaacuucuuucuuucuuucuuucuuuugagacggagucuugcgcuguugccaggcaacagugcaguggcgcgaucucggcucacugcaaccugugcuucccggguucaagcaauucucugccucagccuccugaguagcugggauuacaggcaugcgccaccacgccuggcuacuuuuuguauuuuuaguagcgaugggguuucacuaucuuggccaggcuggucuugaacuccugaccucgugauccacccaccucggccucccaaagugcuaggauuacaagcaugagccacugcgcccggccuuuuucuuucuuucuuuuuuucugagguggagucuugcucuauuguccaggcuggagugcaguggcacagugucggcucacugcaaccucugccucugccucccggguuuaagugauucuccugccucagccucccgaguagcugggauuacaggcaccugccaccaagcccggguaauuuuuguauuuuugguagagaugggguuucaccauguuggccaggcuggucuagaacuccugaccucaggugguccacucgccgcggccuaccaaagugcugggauuacaggcgugagccaccgcgccccgccaaccagcuggagauggcuuaaacuuacucccgaagaagcucccuuccauuucucucacacuaacggacaauaaggaggccucgagcuaggcaggccagggccguacccgagcugcuggcagggagcaaaccucaggaaagucaagccaccaaaaaacuguaagccucaaucaacugagaggaaagcacaagaggaccaggugucacagggcagaggccaaaccacaacucccagcaggucacgcggaguagggcggguaagcgcgccuucuuauuggauggcgauggacagcgugcucuuacgacccaccccagaaggcaaguccccugcgcgcggggcacggcgggaguaagagucugcgggaccggcagcuguacuucaucucccagcgggccgagcgcugaaggcagcggcgcggcgccuuugugguagcaguggccccgcgcggaggaaguuccgguguccgcggcgcugggucgguggcggaggcugaggagaaggaggagcgggccguggaggcuucgccgccuagguaagggcccgggacuggaggggaggcgugccagagccugccagggaauagccagcagacaggcccgcucuagacaucgcaggcccgcgcagccugaaagcuguggcuucagugucgcggggcggcugcggccucgcucgggaagaagaccaagcaacggugagaugagggaggcgccgcccguggcaggaacg

SEQ ID NO: 16122 - RNA, 16887 nt, Homo sapiens
ugagcgcuaagcgccaguguacagcggcggcuggggcggcaggugaggcggcuggggcguugcugucgugcguccgcaggcgucaggugcucagacccgagggccgggaagggauuuggguuucacaggaaccuggggcggggguccgcuaucuuggggcugucgggaccgcugcuuaaauuuggcccaguccagaccucgagucgggcccccagccaggcccacgcccagguccaggcccaggccgguagggauccucuagggucccagcucgccucgauggagcuccucccgccgcugccucaguccuuccuguugcugcugcuguugccugccaagcccgcggcgggcgaggacuggcagugcccgcgcacccccuacgcggccucucgcgacuuugacgugaaguacguggugcccagcuucuccgccggaggccugguacaggccauggugaccuacgagggcgacagaaaugagagugcuguguuuguagccauacgcaaucgccugcaugugcuugggccugaccugaagucuguccagagccuggccacgggcccugcuggagacccuggcugccagacgugugcagccuguggcccaggaccccacggcccucccggugacacagacacaaaggugcuggugcuggaucccgcgcugccugcgcuggucaguuguggcuccagccugcagggccgcugcuuccugcaugaccuagagccccaagggacagccgugcaucuggcagcgccagccugccucuucucagcccaccauaaccggcccgaugacugccccgacuguguggccagcccauugggcacccguguaacugugguugagcaaggccaggccuccuauuucuacguggcauccucacuggacgcagccguggcugccagcuucagcccacgcucagugucuaucaggcgucucaaggcugacgccucgggauucgcaccgggcuuuguggcguugucagugcugcccaagcaucuugucuccuacaguauugaauacgugcacagcuuccacacgggagccuucguauacuuccugacuguacagccggccagcgugacagaugauccuagugcccugcacacacgccuggcacggcuuagcgccacugagccagaguugggugacuaucgggagcugguccucgacugcagauuugcuccaaaacgcaggcgccggggggccccagaaggcggacagcccuacccugugcugcggguggcccacuccgcuccagugggugcccaacuugccacugagcugagcaucgccgagggccaggaaguacuauuuggggucuuugugacuggcaaggauggugguccuggcgugggccccaacucugucgucugugccuuccccauugaccugcuggacacacuaauugaugaggguguggagcgcuguugugaauccccaguccauccaggccuccggcgaggccucgacuucuuccagucgcccaguuuuugccccaacccgguaagcugaaagaaggggcccuuacuugugagcugcaugcacauggcugaacacaggcugcuucccuuccaucacugaggggaucugggggcgcggugggggggcaggcggaaagaagcauucucucucacccaguuccuaagugcugggguggugugagaaaccagccagacaaaggcuacacuggaggcuuagcucccaggcuggcccuuguggcugccucaucuugcucuuuccccuaccugcccaucauggccucugguuuuuuagguaguuucccuggcuaugugaggauaggguuacauaaccgugucucuguuagcauagcuccugaaugcuggguagaaugaugggcauucccuccuacuuguccaccacccauauccucagggacacacgcagaaaaauagcacuccccccuccccucccccacccccgccaccaccaccaccaccacgcacaaauacacagggagaugcucacagauucacagacucacagcugcuugccaacaguuucacuuucccuuguuuugcucugcuuuccaaagggggugggacgggaguugucagagaaucuccccuuccuccacacccccuccccccacccacccccauccuucugccagccaccacguuccagggagccuccugggccuuggaaguugggagcuuguuagggagccugcauguccugggcuucacuaacguuuuugccaugauugggggugauugggggaguacccagaacucauggaauggcagcuugguucuagaagguucugggagccucacucuagucuugugcaagcaacuauaaacaucuggggauaaguaaaggccuaggaagggcugguuggaauugguccaucccagacuuuuuuuuuuaacuguauuuggagcccuaccccaggcaggaagucucaaagccugugcugaacugggggcuccuuccacagacucuaucuagguucucuccagccaucguguaggcaacagcaguaagauuggaccaaggaaugggacccacagcuacuguucuuagauucucuagcuaucauccuguggcccugggccugcugugacauucucgaaagacuccuuuccgcuccuauugaugccucggagaugggagaacuuacacccaaugugagguugggggucuuuagccucccucccucugcugaguacaucuggguugagaggcccuaggguuggggacuccuugucugggccugggcaggccugccuggccccuucuccuucccaauggggagucagaaccucuccccagcuugccuaguggucagugggucagaagacacccagcacggcugggcagugccaggcuccaggaagacuaaucuuggucccugcucacaggcuggccaggcccccaggaggugugugaaucaccccgugcaguguuugcccagcaacucugggcaugcagccacuagggcagcacccacauagugguuggccucaggaggccugagggacucagagcuggugccuguccuccaugggacauuggacacuuacguguuuucaggagcugggggccccuaccuaagccugggaacguagagcuaagguccuggggcuagggacaagcaggcuagggugugggccugacuaagguagggcucuauuccccuucagagccccaccugucccugagucaugcuagaaacaccuggcagccuuccggcucgggccaagccaagccgauuuccugccucaagugaggacaaaaucccaguccccacccaccccaagcuguaggcacaagguguaugggguuucgaggcucagcuccacaucuacuuuugccuccagggcuacuaaucagugcugaggucucaggacuggguuaagccucuguggucugauggagccuucagaggcuccugcuucgaggagugcccuccgggcuggugagagagaguccuaagcaccuagggcuggcuacugagccccgucugcaccucgcacucagcuccaacaccgcgaguucauacccugguguacugguuucccagagcuuccacaguccuccccuggagcgugauugcagcccccaaaaacacccccuugcuaaaagcaggggagagguuaguacccccuagcuuccagaacuuaguucuggcacccaggcuguagggguuugguuuaucccuuuuguacccugaagggggguauaggaagcagccaggaguacaggcagaccuuuggagucuagggagaaggaccauguccccaaccuugugcuggccaauuaacuccagcauucagccccuuaugcaaguggggaaaccgaagcccagaggagacaggguuugcugaagugcacacagagagucagagaagagccagcagggggcaggagaagacucuugcggagcugagacuuccaacugggcucuccucuugagggucuaugaugccuuggaccagagaccaaaccucuugagccuguuuccucaucugugagauguacggggugggccaggcaccguggcucaugccuguaaucccagcacucugggagaccaaggcggacuaaucacaaggucaggaguucgagaccagccuggccaacaucgugaaacccccaucucuacuaaaaauacaaaaaauuagccaggggugguggcgagcaccuguaaucccagcuacucgggaggcugaggcaggagaaucucuugaacccgggagguguugcagugagcugagaucacaccauugcccuccagccccagcaacagugugagacuccgucucaaaaaaaaaaaaaaaaaaaaaaaaaaaaaaaaagauguacggggugguugugaggauggaauggggguaacucaccaucaggaugggcauggcaggguggggcagggagaaugaggaguggaccuuccagccugggccuucucccugcccuugcuacacugagagcccugugggggcaaugugggaugguaaccggcaggcccagggccuucuccagucaggccaggugaggggugagaguguugggcugcuguggccacugacaaaggccccagagggucggggcacaaggcugaacccugacuccuucccuucccugaccuuucccagccuggccuggaagcccucagccccaacaccagcugccgccacuucccucugcuggucaguagcagcuucucacguguggaccuauucaaugggcuguugggaccaguacaggucacugcauuguaugugacacgccuugacaacgucacaguggcacacaugggcacaauggaugggcguauccugcagguggguccucauccccacaguccccuagcccuggguccuugucuccauccccauuuugcucacaucugaccuguccuagguggagcuggucaggucacuaaacuacuugcuguauguguccaacuucucacugggugacagugggcagcccgugcagcgggaugucagucgucuuggggaccaccuacucuuugccucuggggaccaggugaggugggcaggggcagggccuggggccaggguugugggaucacagacucuccauccaauccagggaggcauugacauacaggcccuaccacccuagccuacuguguaccgggagggucuauagggcccaaucucucccuccaggcaccccugagucaccugucuuucacccacagguuuuccagguaccuauccaaggcccuggcugccgccacuuccugaccugugggcguugccuaagggcauggcauuucaugggcuguggcuggugugggaacaugugcggccagcagaaggaguguccuggcuccuggcaacaggaccacugcccaccuaagcuuacugagguauggcuucccuggcagggcacagguaagagugggacaggcugggccuggggugguggucagcaagucuugaucacaauuuuucucaggucugggggguguccuucauaucuacaaggagggcauucuugucagaggggaugccacaugcaaagacuuggaggcaggaaagugcuugaaugcaagugacuccaaauggcuggagcguggggaaggcaagggguauggcaggagacuuuggggaagcagguggggcugagagagcccaaccccacaugaggacucaggcuguuucccccauuucaguuccacccccacaguggaccucuaaggggcaguacaaggcugacccuguguggcuccaacuucuaccuucacccuucuggucuggugccugagggaacccaucaggucacugugggccaaagucccugccggccacugcccaaggacagcucaaaacucagguacaaucuggucccuccccucccuuucccugaagggggaaaccaagcagccccuuccccaugagacccuguucucugcuuaucagaggcaaggggggaugggggaagcugcagugguucugacugcuuuuugagagucaaaaaggucucugucccuuuuugagcuuucaugugcccuuccugucuguucacucauggaccagccaagguuaaucucugccccaccagaaccuuccuuccauggagggaggcauggguggagaaaugccauucucuggcucagaggagcccuguggcuuguggcaggcaugcaucuaggccuguguaauuccuggcugaccucagggguuccccuggugccccagaccagugccccggaaagacuuuguagaggaguuugagugugaacuggagcccuugggcacccaggcaguggggccuaccaacgucagccucaccgugacuaacaugccaccgggcaagcacuuccggguagacggcaccuccgugcugagaggcuucucuuucauggugaggcuaccuugcccugucugugcccuuggccagugcaugguacgggaagggaggggcuuggaguggaggaccugccuaagccaccucuauguccucuuaggagccagugcugauagcagugcaaccccucuuuggcccacgggcaggaggcaccugucucacucuugaaggccagagucugucuguaggcaccagccgggcugugcuggucaaugggacugagugucugcuagcacgguaaguaccaccaggcaggcaugggaggccgcaggguucuauccagguggggacccggauucugucaggauggagggaagagugcuuguuacauggucagugugguguggagagcagguccaggaagaaaagacuacugcccucuucagcccagaggcaagagagcccaucacagaguccaauggcuccagccaaggcuguggggaaccuguucccuccuuacccucuugggaugucuuccugggaccaccuuauuuucagacagaccauggaguggggcaggugggagagauaacagacgaacugggagaggucaacaggccccuggaagaagugggccuggccaucacaaagaggguaaccuugagcccaaucucuuguuccuguagggucagugaggggcagcuuuuaugugccacacccccuggggccacgguggccagugucccccuuagccugcagguggggggugcccagguaccugguuccuggaccuuccaguacagagaagacccugucgugcuaagcaucagccccaacuguggcuacauguaagcacugccucuuugcccacucuggccucuggggaaugagagagccagcuuuggagaacacccaaagccuaccacccuacccucuuccacagcaacucccacaucaccaucuguggccagcaucuaacuucagcauggcacuuagugcugucauuccaugacgggcuuagggcaguggaaagcagggugagugagugcuggccaggagggaggaaggcuggaugaguucccugagcugcagcccaaccucgugcugggcugaggcgaggagcaaucacaggugggguuccuggcuaaucacucucauauuggucccagcagugugagaggcagcuuccagagcagcagcugugccgccuuccugaauaugugguccgagacccccagggauggguggcagggaaucugagugcccgaggggauggagcugcuggcuuuacacugccuggcuuucgcuuccuacccccaccccauccacccagugccaaccuaguuccacugaagccugaggagcaugccauuaaguuugagguaaguguaagggauaggggcagggacaguuggggaucugaaaguaggggccagccuacuggcugguccucaugacccucucugcaguauauugggcugggcgcuguggcugacuguguggguaucaacgugaccguggguggugagagcugccagcacgaguuccggggggacaugguugucugcccccugcccccaucccugcagcuuggccaggauggugccccauugcagguaggcagcccagcuggaccucccugggaaacacgggcagagggccuacaggcugggccugaguugccaccugcccccaggucugcguagauggugaaugucauauccuggguagaguggugcggccagggccagauggggucccacagagcacgcuccuugguauccugcugccuuugcugcugcuuguggcugcacuggcgacugcacuggucuucagcuacugguggcggaggaagcagcuaggugaguucucugcuccuaccuuuaaucagccccuacccccaaccaauggcaucuucaagucccuacauccucucucugcccaggacuuagggaucuaaguccuccccagaggggucggccccuaggagcuuggaaagccaagccaccaaggauucucuuuccacaguucuuccucccaaccugaaugaccuggcaucccuggaccagacugcuggagccacaccccugccuauucuguacucgggcucugacuacagaaguggccuuggugagauaguggaggcaugagaagcuaaagccacccccugucccuacaagcuccucauucccucuccccacagcacucccugccauugauggucuggauuccaccacuuguguccauggagcauccuucuccgauagugaagaugaauccugugugccacugcugcggaaagaguccauccagcuaagggaccuggacucugcgcucuuggcugaggucaaggaugugcugauuccccaugagcggguggucacccacagugaccgagucauuggcaaaggugugggggccagguggggcuggggcagagauggagucucaagaugacauaggcuaggccaggcgugguggcucacuccuguaaucccagcacuuugggaggccgaggcgggcagaucaugaggucaggagaucgagaccguccuggcuaacacagugaaaccccgucucuacuaaaaauacaaaaaaauauuagccagccaugguggcaggcgccuguagucccagcuacuugggaggcugaggcaggagaauggcaugaacucgggaggcggagcuugcagugagccaagauugcaccacugcacuccagccugggcgacagagcgagacuccuucucaaaaaaaaaaaaaaugacaugggcuaaagggacaguuggaacagauacugcucuaaccuucucaccaaccugugugaccuuggguauaccacuuaaccucucugagccuccauuugcucaucuguaaaauggggaugagaaaaguucugucuucaguggguucugguguggaucaaucaggcauaggaagauuguagccucugccaucaaguggcugcuguuuguuuuugguuuuauuuaugguuuuguuuuuguuuuugugacagggucucacucuguuacccaggcuggagugcaauggcacaaucauggcucacugcagccucgaccuccccagccucaggugauccuccugccucagccuccugaguagcugggauuacaaucaugcaccaccaugccuggcuaauuuuuuguuuauuuuuuguagagaugggccucgaaucauguuguccaggcuggccucgaacuccuggacucaagcaaucugccugccuaaccuucccaaagugcugggauuacaggcaugagccaccgaacccagccuguuuuauuauauuuauuuuauuuuauuuuuauuuuuauucuauuuuauuauuauuauuuuuuuugagacagaauuucacucuuguugcccaggcuggagugcaauggcgcgaucucggcucauugcaaccuccuccucccggguucaagugauucuccugucucagcuuccugaguagcuaggauuacaggcgccugccacaacacccggcuaauuuuuaguauuuuugguagagauaggauuucaccauguuggccaggccggucucgaacuccugaccucaggugauccgcccgccucagccucccaaagugcuaggauuacaggcaugagccacugcccccagccuauuuuauuuuauuuuauuuuuuuuuuuuuuuugagagggagucucacucuuucacccaggcuggagugcaguggcgcgaucucgacucacugcaagcuccgccucccagguucaugccauucuccugccucagccucccaaguagcugggacuacaggcgccugccaccgugcccggcuaauuuuuuguauuuuuaguagagaugggguuucaccguguuagccaggauggucucgaucuccugaccucaugauccacccgccucagccucccaaagugcugggauuacaggugugagccaccgcgcccggccuauuuuauuuuuucaagauggagucuugcucuaucacccaggcuggagugcaguggugcaaucuuggcucacugcaaccucccccucccagguucaagcaauucuccugccucacccucccuaguagcugggauuacaggcgcccgccaccacaccuggcuaauuuuuguauuuuuaguagagaugggguuucaccauguuggccaggcuggucucaaacuccuaaccucaggugaucugccugccuugaucucccaaagugcugggauuacaggcgugagccacuguauccagccuauuuauuuauuuauuuauuuauuuauuuauuuauuuauuuuugagacagaaccucacucugucacccaggcuggagugcaguggcaugaucucagcucacugcaaccucugccucccggauucaagugauucuccugccucagccuccuaaguagcugggauuacagacgugcaccaccaagcccgucuaauuuuuguauuuuuaguagaaauggaguuucaucauguuggccaggcuggucucaaacucccgaccucaggugauccgcccgccucggccucccgaagugcugggauuacaggcgugagccaucgcacccgacccugcuuuauuuacuuauuuauuuauuuuuauuuuuuugagacagagucucacucuauugcccaggcuggagugcaguagugcaaucucggcucacugcaaccucugccuccuggauucaagcauuucuccugccucagccuccugaguagcugggauuacaggggccugccacugccaccacaccugucuaauuuuuguaguuuuaguagagacgggguuucaucauguuggccagacuggucuugaaccccugaccucagcugauccucccgccccagcaucccaaaguauuaggauuaaaggcaugagccuuuuuuuuuuuuuuuuaauuuaaaaaaaagacagcaucucacuauguuacccaggcuggccuugaacuccugggcuuaugcgauucucuugccucagccuccugaguaacugggauuacaggcgcacugcgcuuggcuucugcugcuuuucuuugagggggauggagucucgcccugucucucaggcuggagugcagugacacgaucuuggcucacugcaaccucugccucccggguucaagcuauccuccugccucaggcucccaagcagcugggacuagagaugggguuucaccauauuagccaggcuggucucaaacuccugaccucgugauccacccgccuuggccucucaaagugcuggcauuacaggugugagccacugcacgcagcccugcugcuuuuuuaaaaugucagauugggccgggugugguggcucacaccuguaaucccagcacuuugggaggccuaggugggugaaucacaagaucaggaguuugagaccagccuggccaacauggugaaacccagucucuacuaaaaauacaaaaaaauuagcuguguguaguggcaguugccuguaaucccagcuacucaggaggcugaggcaggagaaucacuugaaccugggaggcagagguugcaaugaguugagauugcaccacugcacuucagccugggcaagagugagacucggucucaaaaaaaauaaauaaaaauuaaaaauaaauaaaaugucagauuggccaguuuagugcucugaggucugguugccaaugagaauguguggugugagccuugggcccuggauccccucucaucgacucauuaugcaccucacaccaggccacuuuggaguugucuaccacggagaauacauagaccaggcccagaaucgaauccaaugugccaucaagucacuaagucguaaguggggcagaagaugggaaggcagagggaggggccucaggcugggaggauucuuuuucucuguguucccaccuuacugagugacccugagcaggagaccuucauuucccauuuccccaucugagccuuauaaagggacgcccugcccugugccugacuugcgcugcucugcaggcaucacagagaugcagcagguggaggccuuccugcgagaggggcugcucaugcguggccugaaccacccgaaugugcuggcucucauugguaucauguugccaccugagggccugccccaugugcugcugcccuauaugugccacggugaccugcuccaguucauccgcucaccucagcgggucaguguucaucuggcucuggguugggggcugggcagcagcuggagaaggagcugcugugcccuugcccaccaacccaccugugcccccagaaccccaccgugaaggaccucaucagcuuuggccugcagguagcccgcagcauggaguaccuggcagagcagaaguuugugcacagggaccuggcugcgcggaacugcaugugagaguccagaguagcuggggugaagcaaaaggacagggcaugagggugugcggugcucaaggccgccucagggaagggcccacuccagccuuguccuccccucucugcaccuuacuuuuuuugucugcccagugcagacuuggacuggacacuguggcuuugaaauuuggccaggcgcgguggcucacgucuguaaucccagcacuuugggaggcugaggaaggcggaucaugaggucaggagaucgagaccauccuggcuaacacggugaaaccccgucucuacuaaaaauacaaaaagauuagccaggcgugguggcgggccccuguagucccagcuacucaggaggcugaggcgggagaauggcgugaccccaggaggcagagcuugcagugagcggagaucgcgccacugcacuccagccugggugacagagcgagacuccgucucaaaaaaaaaaaaaauucuguaagggccuagaacagguggguucagggccugguaagggccaguccuaagugugauccucucccuaccccuaaggcuggacgagucauucacagucaagguggcugacuuugguuuggcccgcgacauccuggacagggaguacuauaguguucaacagcaucgccacgcucgccuaccugugaaguggauggcgcuggagagccugcagaccuauagauuuaccaccaagucugauguggugaggccccaccugcccuacaguccacauggcuuuggcacccaagaacacugggccucacccauucagcucugaaugaucugagcccagggaguccccaggguagaugacccccacagcccaucugcucaccucuugggcagauguaagauggaaucugacaccugccagggcuagaggaggcugggaacucacuggcuccucacagauaauccagggccugcccagccccaacucuggguaggaugagguagugggaggagacagaggaaagacacaggugauguauugaggaaugagcucucaguggaggguagggucuuccauuuccagcugaaggacucugggagguagaagcccugggggacccaccugcccccaaauuuggggugaguugaguccccucaccucccccuuuccacaguggucauuuggugugcugcugugggaacugcugacacggggugccccaccauaccgccacauugacccuuuugaccuuacccacuuccuggcccagggucggcgccugccccagccugaguauugcccugauucucugugaguauguggaggugguaguggggagggaacugggccccagagacauggaagagacaggagacagagcuccugccuggcuuccugacugaacuucugguugacuaggaaagggacucucgcugggccucaauuuccucaucugugaacuggucccacccucaugcagaguaggacccugggaggaccucacaguugccaugguaacagcauucugagcucagaguugggguugaggcccgugguuugauuuucccagugcuccuccuacccgacucccacuaacggggucugcuuuccaccuuuuccucucauuuaaucucgaggaaagauuccauaacccccacagcaacccccucuggaucuccaggucagguuuuuucacuguaugugguuucagauuccccauuccuggagggauggcggcagcugcauuguccucagugccuacgggguggguucggugcugagguucagcuucauacguagcaggugugccugagcuguggcuaggucugcuggguuagaacagagagaaccaggacauagguaaaaguaguuaacgccuccugucucaggcugugcuccaagaaggaugcgaguagcccuuccucacaguccuaccugccuuggguuugcucuuacuauucacuucuuuaauucacugccuacccauauccagauugggcuccuggaaacagacucagcuggagauuuauguacggggauuuacugagagguugggggcaagggaagaaggacugggcaggagaaaugucacagaaacugcagcccaucccacagggacugcuugaacugggaugacccaccacaguuuucugaaauugagaccaacaggccaggucuuuguaccaggcauuaaucaguuacuagucacaggcugucccuggugaggggaugugagcuuggcagaggcaguucucuucugccuagggcaauuccuagagagagccucagucaagaaccaucagcaggcaacacuccuagccacugggaaaguaaagggguaucuggguggcacaccauaggguccacuucagcaguccagcccuucuccucucugggccucaauuuccucaucuguaaaguggagacaacaguaccaccuuccgagagucugagaauuauaugagauauuguguguaggguagaguauuauuucaggcaggaaugacauccccaagauaauggggcaggcacuaggacccagcagguaaaccuggggaaccucugcuucaggaccagggugccacuggugcugccccaaaugcucuugcuucagaauuuuuuuuuuuuuuuuugagacagagucucacucugaugcccaggcuggagugcgguggcgcaauguuggcucacugcaaccucugccucccagguucaagugauucuccuaccucagccuccugaguaacugggacuacaggcgugugccaccacgcccaguaauuuuuuuuuuuuuuuuuugagauggagucucgcucuguugcccaggcuggagugcaguggugcaaucucggcucacugcaagcuccgccucccggguucacgccauucuccugccucagccucccgaguagcugggacuacaggcgccugccacgacgcccggcuaauauuuuguguuuuuaguagagacgggguuucacuguguuagccaggauggucucgaucuccugaccucgugauccacccaccuuggccucccaaagugcugggauuacaggcgugagccaccacgcccagcuuugcccaguuaauuuuuguauuuuuaguagagaugggguuucacuauguuggccaggcuggucucgaacuccugaccucgugaccugcccaccucagccucccaaagugcugggauuacaggcaugagccacugcccccggccacuucaggauuuuuaauuccugcuuugcuggacccaggcuuccuuccuggaagaacugugaugaugaccauuguaccucgugagcugggccuugugccuagcacuucacaggcaucagccuauaugccuacuucucugugaucagaggaggacccagaggcacagagaaguuaaggaacuuauccaagaucacauagcccaggccacagggcacaggagcccaagcucuuaacaccugagguaguucgaccucugccagggugggaaggcaggacuggaacaguaaucauagggaugagaagagcugccccugauuggguagugcuagguacuagguccugucaucuauccucaucccuguguggccugccagagguuuaacagcaaguggguggcccagaauccuuggguggaaauugccuuaaccugacaucccuuucccccaacagguaccaagugaugcagcaaugcugggaggcagacccagcagugcgacccaccuucagaguacuagugggggagguggagcagauagugucugcacugcuuggggaccauuaugugcagcugccagcaaccuacaugaacuugggccccagcaccucgcaugagaugaaugugcguccagaacagccgcaguucucacccaugccagggaauguacgccggccccggccacucucagagccuccucggcccacuugacuuaguucuugggcuggaccugcuuagcugccuugagcuaaccccaagcugccucugggccaugccaggccagagggcaguggcccuccaccuuguuccugcccuuuaacuuucagaggcaauagguaaauggggcccauuaggucccucacuccacagagugagccagugagggcaguccugcaacauguauuuauggagugccugcuguggacccugucuucugggcacaguggacucagcagugaccacaccaacacugacccuugaaccaauaaaggaacaaaugacuauuaaagcacaaa

SEQ ID NO: 16123 - RNA, 1509 nt, Homo sapiens
cauggagcaggaggacuauggaagccaccaagaagguggggggcccugauccaucggguccccaggaccaccccucagccggcagccagcagcuggggaguggccucagagggucucagggaccacggauaagcucagaaucccuauacuucaagcagggguugucauugucuaccaagaccaucacugauggugccuguggcccagccucccaggccugcaucccuggguccauuugccagcuacuccaggauccugcuuggguuagcucccagugcugcugugagcaggccucccaggaugccccgagacucuccuccacuaguguaucuucaagucccauugugggagcccaacaacaucucaucauggaggaugucacccugaccuuaccagagugcaugcacagugacagcaccagugacauagcccaguguggacccugccaccuucgguuucaggugcagaauuugggggaaggcaagcguccagcuaagguccugguaggcuggggcaaaggccccugcagcuccgaccagauagccuccuugggcagcaggaagagucgguggcugcccuuccuccucucaggagagaauggugcucccgaagcccaaggugcucuucuggcuccagcucaggaucuagcccaagaucaggaccaggguaaguguccagcucaggcugcugcccuaguuacacauucuuuuuuaaaauuucuuucuuucuuuuuuugagauggaguuuugcucuuguugcccaggcuggagugcaauggcgcgaucucagcucacugcaaccuccgccuccuggguucaagcgauucuccugccucagccucccaaguagcugggauuacacgugcccgcuaucacauccaacuaaguuuuguauuuuuaguaaagacuggguuucuccauguuggucaggcuggucucaaauucccaaccucaggugauccaccugcuuuggccucccgaaguguugggauuauaggugugagccaccgugcccggacuuacaccuucuuuucugucacugacuccuccaauuccagcuugggcuacgacuccagcucuggauguuaccccaacccccacugcaguugaaacugacauccauaccauugaucaccugacugacaccacugcagucaccaagggcccaucucaagaccuccuucucaggaaguguggcaaucaguggucaacugucuuggagucuuccaaaauaguugcaucuugccaggacaaagugaaucuccacucuaaagaggaggcucccaucccaaagccuacucuagaagagcgcccagaccaugcccaggaggaggagguuaccagaaggaaggugcccagaaggaaggugccaacugaggaggcugagaaccccaugaagaaacuuccagucucuaccuccaggccaggcagcccaaugccaggcccagagcccccaguuaucuccaagucccagaggaguagccaggagaucuguagcucucagccacag

SEQ ID NO: 16124 - RNA, 42307 nt, Homo sapiens
ggaggccccgcccccagcccgcccccggcccggggugcgaauccggugccggcaagcggcuggcgaugcuggagguucgcuagccgaagcggcugcaucuggcgccgcgucugccccgcgugcucggagcggauucugcccgccguccccggagcccucggcgccccgcugagcccgcgaucacuuccucccugugaccaaccggcgcugcaggugcggggcgggccgggcugggggcgcuucccgaacgcagguuguggggccuugggggauuguuucccuggcucgaggugcgggaugcagagugcgcgggggcgcagcgagggcucgagguccuggcggggucagagcgcgcgggcuuugcagauuugggggagggagugcggggucgggcuaaaguuccccauuaccucggacggcuuggggguucuggggggaagcuucugcggcucggaauugugaaaagauuaacccucgaagauucguggucccccgugaggauaggggccgagagcugagccgucccuccccguucccagagccgccuccagccccucccaacuguccccgggccccuucccucccgcuuagcagucacuaauuuccaugacaacggagaguucuuuaugggcgacaacccggagggggcugggcggggcugccgcggggugggggaggaagcuccaagccccuggggaccagcagccccccagccaaaauucagcuuccaagccuucaccugggugccagcuggggguccagugcauggacccacgugcacggugggggugggggcgcacauguuccugcugggaggugcggggcuuggugcucacacgugugcuuuccgcauguguguugcugugccagcgggggcgagccagcagcacuugggaaaggggucaggguggcagcacgguggggagcagggccccuggcuggagguggcugggauagugacagcaugagcuucugccuuccccagcuuguacuguuuggcagagacccugggcucuugagccccagcccccuccccgcauagcucugccaaauugcuuuuguccgcaccucccaggcagauccugcuccaccagguuccuuccuaaggaucagggcccucugucccacacuaaaagcucagagucugcaguaguccagucccugugcuguacuccccuuacccccaaguccaggcuuugagcccccaggacuaccuuuagagaccuggugcccucccccacccucagaguugauuccuggcagcuccagcgacuucugagccucaguuuccucaacuggggaacuggugucuccacucagagucagguugguuuccaggguggggcaagggucucccuuuucuaauauuugguguggacccuucaggugcucuccuaggcuggcuguucacauaucucugauggcccuacucuccagccccaugcccuggccaccauucacaggcaggcaagcaguccucugcccugggagaaggccagauuccaugguuuccauuaggggaaacugaggcauggggaggugaagggcugugugguuauccuguuucuggguugcuuguggugccguuucuggcacucauggcaggaucugcuguuggggguuggugagaggggauuaagcagagcuguaagaggggcucuggggacccaaagccuggaaaggauagcagaugggggagggguuggcugggagggucuaaguacagcugggccaacugagaagagggacuauaaagggaagcagccaggcauccgagccucauuuccauaccccuaugcgucugccuucaacauguuggaccugcuuuaccuaagcugccgugauggcagagagacgggcugggaacuguccugacuggggggcugcagcagcuggccucuuccccaccaacaugcuccaaggagcuggccuccuuuuggcugugccuccuacaccaaguucaguguauguuugggggauacaggagggugcagucucgaaggucccaguaccauggauagcuccuggcccagggauuuagagcacaucgccauggaggccuuagggcucugcugggcacccauccgcccccuucagaacucccguccaccuccccuuuccugcccuuugugccugugucccuuuuacuuugucaucuccuugcuccucuuccaucacagguucugucuuugucugugucucugccccauucucuuuuuucuaaauucucuccaucuccccaccuccccuuucuugauggggaccugggucacagaaccuugaagaagcagccaggcuaaggucucaggaaauucuugaagaagggaccugaccaacacaucuccccucccccuccccuuguuuuaaaacuuccaucaccauagcaacccuuuacucuagugccuuccucugcauuuccccuccuccacccacagggaagcagagccuccaguggauucuccuucagggguucagagauuuggaccccaagugcuugggaggagacagcuggccuuuggcuuugccugcauguugacagcuaaacuuucgggauguagcacuggacugcaugcccacccccaaaacuggagagaccuccccacaauacucccucauuagaugggcaaaauucagcuguaggaacuucuaccaugauuuagcucgagccggaggcucagucagggcagccccuugaccgguccccugaagcaauuggaugguggucuagaagcuuggcccuuguucuuaacagaccuugagggaggucuucagcuccccugguccugugggugacaccucagcugugaguuaagcagggcuugggcuucagcauguucauugcagcaggaaacccagccccagcccuugagagaguagagcagcagagaggagggggugccugcaggcugguguucacagcugccacuaaauuaggagguguugccuacaguuguugggaggcagcuggaggccucuugggccccuccuggccucccuagauuuacugcaagcucuggagccccacguggcaggggaccaagguagcaggaaacucuguuuaugucuaugaaagguagggccugaaccaggaugaucucagcggaggaggggacaggaccccaauguggggccuccggaccucuuggccuuugucccguuugggcuuucccugggccagacuuaccuaaagaugcagcagagucccugggggaccauuuaucaccagggcaccaacagaggaccccucaggauugcuggaggcucaauucccugaguccaguggucaggcccugggagcaggccauaacuggggagugcuuggcucucaggcuccaugagagccagcuggagggcaauggccgcaccagggccugcacuccccacaagcucccucugggcagccgguagugcauacuguucaguuccucugcagagaguggagggagccaugucuccagggaaauggcuguuguggagcucccaugcccuuccauggccuaaguguaccugaggaagagcucagauccuguguugcugagaggagagcucuccauuguuggguguugggucugggccaugggggugaaaaauacaaaccccuuccacuuggccuccucucuuucugagagcugucccuuggcuguuccucccaggucuccuuuguugcaagcaggugcccagggcuuggugcacacacccgaaaccucccagggagcaacaguggauagcagaugguggagugggugugggcagagggaaccaaggugcuaauugaaagccaggccccucuuucuccucucuuugcccuggggccaaguccagggccccaagccaguauacuuagacuggugaggaggaggaggaggaggagugacuggcugaaauuugggcagccauaguagggggcaggggagacagaucuguucccaucucagccuugaggcuucaggacauggcuccaggcugacauuacgggguggaggcccaguuuucugugccuuucaugggacagacccccaugaccagcccuggaccucagugggcacgaaugcauaugcagagccgaaagcuggggccaggaucaaggacaggcaugcacaaaaccucccacccacgccacacuggcaaagcugggagcuguuggaguggggugggggguggggcauggagguuguggaagguaucucagaaaagggccauuuugagucuggccuucgagcaucaggauuguuuuggacaauguguugcacaaaccaccuuauaaugucagaaaucacaaugaaagaagagauucaguucugcucucagcaccucgcucauguggcagcugcuccacaggaaagccaaggugggcagagcucuugccagugcccacacuuccuaccauugaguggacacaguugagcuggcgagucaccuguuguuggacauuuagguaguugcugaauuuuuuuuaauguuauaaauaacucugccgugacaaauaggaaucugacgggaggcuuuugggggaagggcacucuugccagagggaaugguguaagcaaagcaacagagccagggcacaggucccucccagccuucuugggagacugcaggcuaagguaccauccuccugcccaguacacggcccucagacugagaugacuguugcaggcccccuccugcagcuguuauggugugaaaauguguagccggcaaugguaacuggcuaugccucugcucucagcugugaggaugggauucuggccacaugcuucuccccaguggaggagugcaggguugugcccaugguggcagacaugcagucagugacgaucuucaaagccucuccuuugucucugcugugccucgcaagauggcuuaaacccugucuggaauaaugcugaugaaaugcauuuguauucccugagcccaagcaacccagaugaaggaaugauagaguuuguucccuaaugcugaaggcaaaucugagggagaauuuccagggcugugacuccugggaaucacagccugguggcuggcuucugccugggaggaagcaaguagcagccaggguuggcuauggggcucguuuggguccuggucuuugacuuuggcuggcagaguucaucuugccaagcugccuccuuugccuccucccuucuccacuaccuugaggcugugagugccuucaggucggggagcaucuagguacccccaggcccuagcucaggcccugcacacagcaagugcuaauuggcauggagggaaaacaugcacagucagcagaggcagagcaauuucagcgcagccucagugcagagcuugcuguagccccagugucacacugaccggguauuauggaggcacacccuggcgucagaucugugaaggucuagucaguaaccccccacccccagcuuugagcaugggcuaugagugccuuuuccuuuggacacuggagucagccccccuagcacuacagaugaggauugggcuguaauuggcaggauugcagaccugugggacaccgugccccagguggaaagagugccuagcgcucacugagccagcuauaucuguucuguuugggggccuugcaccuggaccugacagcccagguccccugugggccccagugggcaugaaugcauaugcagagccgaaagcugggaccaggaucaggcuuguuuugcucuuccugaccaguacaccugcauaccuccuggcaaaucuuuuccuacugaguccuaaugcugccuccaaagcuuuaccuugccucuccacccagauuaucccucugaggaaucccccaagcacugugccugagugcaguauuuacuaaauucaucgaagucauuauaguaaaauaguaaaaauucgcacagaaaauuaguaaacaaaagauaugucugccuuuuugacauccaauucuuugcccaggagagaacucuuauuuccuucaguauucuuccagaaaagaguuugugaggguacaucaguauguaaacuuuaaaaaauuuacccaagccagguaugguggcucaugccuguaaucccagcacuuugggaagcugaggugggaggaucacuugagcccaggaguucaagaacagccugggcaacguaaugaaauccuguaucuacaaaaaaauuuuuaaaaauuagccaguugugguggugugcaccuaugguccaguccuagcuacucaggaggcugaggugggaggaucgcuugagcccaggagguugaggcuggaaugagcugugaucauuccacugcauuccagccugggugccacugcauuccagccugggugacagaacagcugggcauggugcgggugccuguaaucccagcugcggugggaggaucguuugaguucaggagcucugggcugcagugcgcuaugccaguugggugucuacacuaaguuuggcauuaguauggugacuuccugggagcuagagcucaucagguugccuaaaggaggggugaagcaaccaaggucagagacgaagcaggucaaaacuccugugcugaucaguagugggcuugugcccaugaauagccacugcacuccagccugggcaacauagugagacuugucucuaaaaaaagaaagaaagaaagaaaagaaaagaaaagaaauaggucuuccagaauccccccauguguccugaaucaaucauaaccccuccuuuucucuuagaagggaccauuaucugacucugcuuauuuccuagcuuuucuuuauagcucuacugcuguguuuguaucccccuuacggguuuguucugccuguuugaacucuaucaauagacucauacuauauguauucuuuugugucuuuuugcacuuaacacuguguaagagucaccaggugguuggguauagcuguagcuccuuuguuuccauugcuauauaauauuccauugugugacucuaccacaauacauccuguugguggugguauuuggucuguuuucaauuuuuggcgauuauguauauggcuacuaugagcauuguaugacuguccugaugcacgaauaugugcacuucuguaggcacguauuuaggagugcaauugcugguucauaggguauguuuguuugacuuuagugguuuuaccaaacugcuuuacaaaggggaguuugcccucuccuagcagugcucacguucuucauauauccacuaacacuuguuagcucuagaccuucagagaugacuagcaggugggugggugguuauagcccccuucaucuguaaaauagcugaaauuuaaauaaacuguuugauaagccuuuuuuuugaauguauagaauacaaaacuauucccuuauauaucagcuuaauacauuuuuucauauguaggcuguugcacuucaggcagccaagcugaguagcuggaugucuagccagaaaagcagggguaggaucuaagccugccuauccucuagccccuccugguauggucucugccccuagcuuggccugagccagguuggggucucccaaaagcagccccuauguuguggggaaguggagaguaguacagcuaagccagaccccauugugcccgcagguuagagccuggcaaugccguuugggugugugacucugggcgacaagaagaacuauaaccagccaucggaggugacugacagauaugauuugggacaggucaucaagacgugagugccgggccugucaggcaaggcugggugggcuggugagcaggggcuagggaaguggcaguggagugcagcugaugcuaaggccaggccugagugggugccugucggcugcagugaggaguuuugugaaaucuuccgggccaaggacaagacgacaggcaagcugcacaccugcaagaaguuccagaagcgggacggccgcaaggugcggaaagcugccaagaacgagauaggcauccucaagaugugaguuugaggccugggauuggggcggggugggaggcagcagggaagggcuuagagggcaaguggccucaggcagucccagccucuggccaauuagucugcuguggccacuguggugaccacagccucucccagggguucauccagcccuaacuacuggcuccccucccugucgccagggugaagcaucccaacauccuacagcugguggauguguuugugacccgcaaggaguacuuuaucuuccuggagcugugagugugggucuggggacccaagauuccccagcgcccagggcuuucaccugucccacccucugcagcuaaggaaacccccuuucuggacccuuggcgucccaggucccugugccuugcucagccagcugccuggcguaggcagcucacccaagugcuccugcccuaccccugauucugcccacgccaggcucaggggcuggugucccucagggccacggggagggagguguuugacuggauccuggaccagggcuacuacucggagcgagacacaagcaacgugguacggcaaguccuggaggccguggccuauuugcacucacucaagaucgugcacaggaaucucaaggugagggcagagccagagucaaagggccaguuggcagcugggcuggugcuggggugggcagcaccucagggccuuggucuagccuccaagguccucauggugucuucugcucacccacaugcuauucucacaccacagcuggagaaccugguuuacuacaaccggcugaagaacucgaagauugucaucagugacuuccaucuggcuaagcuagaaaauggccucaucaaggagcccugugggacccccgaguaucugggcaagcaggggguggggcaggggcagggggauaauggggggcagccuucagggagcugcucugggcagggggaaaaugugcucaucucaggaagcugguguggaugguacuggaccuggcuaggccugauacugaccagcagaugggcgcuguguuuguagccccagaggugguaggccggcagcgguauggacgcccuguggacugcugggccauuggagucaucauguacauccugugaguggacagauggacaagcaggcuugcagucagauggggugggggcaugugucuguggccuuucugugugacccuucccccaugcaggcuuucaggcaauccaccuuucuaugaggagguggaagaagaugauuaugagaaccaugauaagaaucucuuccgcaagauccuggcuggugacuaugaguuugacucuccauauugggaugauauuucgcaggcaggugaggaggugccugcccagcacuugguagaacgcaagggaguggggaggguguccugcucucaucuuccucugugguauucugcuucugucccccagcccauuuaucaccucuagacauugagauggggugcccaugacuauccccuucuugguuuuguccacagccaaagaccuggucacaaggcugauggagguggagcaagaccagcggaucacugcagaagaggccaucucccaugaguggugagcaggguccaggggagggugggagaggccagggucccccucacacccagcagccccaucuuugaggccuggaaggggugcagguaccuagagcucagggcagcccagaggcucugccugguagucccuggaugccacauagaagggcugagcagagucuccacaaaggcucauucucucagauccagacacacuugcacccuuuccaggauuucuggcaaugcugcuucugauaagaacaucaaggauggugucugugcccagauugaaaagaacuuugccagggccaaguggaagguaaggcuuggauaacucccuucuuggcucuaucccaaguauugcuucuggcacucaguuucuugccugcaucacaccccugcagccacacacaagcuuuucucaggccaucagguguggguguagccacugugauuaccuuaaguaggagugcugagcagcugaguacuuggcccugggguggauggagguggccggggguacuauggaaggaguuugguuuggucacugccaagcaauggauccagcaagccucacccuuagccuuucuccacugugcuccuuucagaaggcuguccgagugaccacccucaugaaacggcuccgggcaccagagcaguccagcacggcugcagcccagucggccucagccacagacacugccacccccggggcugcagguggggccacagcugcagcugcgaguggagcuaccucagccccugagggugaugcugcucgugcugcaaagagugauaauguggcccccgcagaccguagugccaccccagccacagauggaagugccaccccagccacugauggcagugucaccccagccaccgauggaagcaucacuccagccacugaugggagugucaccccagccacugacaggagcgcuacuccagccacugaugggagagccacaccagccacagaagagagcacugugcccaccacccaaagcagugccaugcuggccaccaaggcagcugccaccccugagccggcuauggcccagccggacagcacagccccagagggcgccacaggccaggcuccacccucuaguaaaggggaagaggcugcugguuaugcccaggagucucaaagggaggaggccagcugaguaggcagccuggugagggggggcaggggaugggcaggagggugggagaguggaugaggggcuucucacuguacauagagucacuggcaugaugcccucgcucccccaugcccccacaucccaguggggcauaacuaggggucacgggagagcagucucgucuccuguguguaugugugugaguggugggcaggccaguggcagggccggccccagccccugcauggauuccuuguggcuuuucugucuuuugcuagcuucaccaguuucuguuccuugugggaugcugcucuagggauacucagggggcuccugcucuccuuccccuucccuucuugccucaccauuccccuaggcaggcccugcaggucccacacucucccaggcccuaaacuugggcggccuugcccugagagcugguccuccagcgaggcccugucagcggucuuaggcuccugcacaugaaggugugugccuguggugugugggcugcucuaggagcagauacaggcugguauagaggaugcagaaagguagggcaguauguuuaaguccagacuuggcacauggcuagggauacugcucacuagcuguggagguccucaggaguggagagaaugaguaggagggcagaagcuuccauuuuuguccuuccuaagacccuguuauuuguguuauuuccugccuuuccgaguccugcagugggcugcccuguacccugaaccucaugagccucuaagggaaaggaggaacaauuaggacguggcaaugagaccuggcagggcagaguacaagcccagcacccagugucccagccuuacuggguccuuacccugggccaaacagggagggcugauaccuccuugcucuuccuagaugcccaccuccuacaaucucagcccacaaguccucuccacccuagggggcuugcugcauggcaauaacucauaaucugauuuggagguuugcccuuuacaggggcagauuuucugcucaguucaacaaugaaaugaagaggaacucccucuuucuacagcucacuucuaucagaggcccaggugccucagagccacauugaguugcuuuuucugggaugaggaaguaggguuaaacuccccaguuuccugagggaggcuccugacaggugcccuuugucagacccuaccacagccuggauaggcagccacauugguccucgcccuugcucggcacuccguggugguccugcccuucucccugcaugccugugggucugcucuggugugugaaggucgguggguuaacugugugccuacugaaccuggcaaauaaacaucacccugcaaagccucuggccacccucucgccuuugcuuccucuguccuacuggggaggagccccuggaaggcaguggggaagggagaggcugggagcagguucacaaguaguggcugggaguaguagugaacagugcccuguggauuucuugggcugagggugaagaucauccucaccacaguguauuccucaauggugguggugguggggguccucugaacucuagaaauccaugugaguagugggucuugggcugcauuuggaccaaggaauacucccugggcugagagcucaaguaagggcugcuguuuuugacuccuguugaccgaggagccuuacucuugauuuaggcauagagcuggaaucuaccugggccagccaccgcaaggacagacccugcucauagccaaagauagcuucccugagcuagggagaggguguagggugagcaaugcacaaagauucuaugcugcucuguguugauuccuucuuucugugaacaccugugcuuuccaccuaugccccaaaugaaaucucacucugggucuauuucagcuggagcagaucagcuuuauauuaugggacuaugcacaggguuucuucuggguagagggaguaacacugccacagauacuaagccuaaaaacccaaaaguugacuuacuccagcccaggugggccugggugaacucaccagggaugcugcucucugggaggaccucaaagauaaccuccucaaagauaacuucucugaugugggaauaauaaaaaggauuuguuagucucuagucuuugaagcaucugggccuccaaaauuccaacccuacuacagucucaagcauaacugauccuccugagagcuaagagcuaaagucaggguacuggcccuagugucuccaaacucaaggauagucauaucuuacuuggaugaagccaagguuggccuggggugaccugagggacuggggccuauguguccaucuuucuagaaucgcccggaacugaggacugagaggguaggguauuguggucuaugggaacuacagaccauagcgcaugguccaucacuguccagagcccaagggacccaucgggaccauuguucuauucccuugcggcugcgguuuucucugccuuggcccagccugccucgcgccagcucuggcaugggaccacaaugcgcugccuugcccuggaaaaggguccagcuggcagccucgcugcuccccgccuugauauaaugcugcgcucucaaguggcaggucgagucuccccagaggacgccugagagcgaccgcgcuccgcccaggauucucuacggccucggggccgcuaagccccgcccauaguuccgcccauccgagaauuuguccaauccaggcgaaguauucacgcuccgcccaaaguuuuguguugucacuuccggcccgcuccaggaagucgugcugcggagccaaauuugaagcaagcggaggcgcgggggcgcgucuacgaagccggaccuguagcaguuucuuuggcugccugggccccuugaguccagccaucaugccuauccgugcucugugcacuaucugcuccgacuucuucgaucacucccgcgacguggccgccauccacugcggccacaccuuccacuugcaguggugagugacugcaguguuggggcccgguguuugcccggguaccgcuucagggccuugagguguugggccuccaggcgguccaaccccggaauccagacaagugaugagaaccuuccuccuagacgaggccccacgggagcuucccaaccugggcagaagugggucaggacaggcuuucugguagaggugauagcugagcuaagccugagggggacuaagauggcucagugaagauagaugcuuccuugaucaccuauacaaacagaugugauuucaaaaccguuagccugggcaagggugagcuuucaccacaucaacaaguccuuuuauuucuuccagauagaaaccugcuaggcuucuggcuacccaagagaguuugcugugccuuacuugaugguuuggaauuauucuacccagagucaucucacuguccagacaccccaauguauucgccaugucagcaaacccguuuaacauggggaaggcaaggagaugcuccccuauccagggguccugcugaccguguagggccauucuguugaguguacagcuaguggggaaagauuccccuagcagauguggacaggccgguuuggaccuccuagcaaaagagauaaggcagcguuaccccugggaauggugggugauaauaaucacagggucuuguggggcuaaaggcccuaggaagcagaaaggcaggcaugacacugauggcugcuggcuuacuugcaaagcuuuguuuaggccuguguugcugacagccugagccccaugcugagggagccacugcuguuugguuagacuagaaauuaagcucgccucuaagcguacucuauuuucuguuugccuacucuauuuucuucuauccuuuuacuuuauuuauuuauuuuuauuuuauuuuauuuuugagauggagucucgcuccugucguguaggcuggagugcaguggcgugaucucggcucacugcaaccuccaccuccugaguucaagugauucuccuuccucagccucccaaguagcugacauuacaggcgugcgccaccacgcccagcuaauuuuuguguuuuucauagacaggguuucuccauguuggccaggcuggucucgaacuccugacuucaggugauccacccaccuuggccucucaaagugcuagggccuauccuuuuacuuuaaacuuuucuguguccuuguguuuuacauguaucccuugaaacagcauuuauuucuuuuuuuguauauuaaaaaguacuuuagcuuacugcaaagaucuuuauuuuauuuuauuuugagacagggucucacucuguuacacaggcugcagugcaguggugccaucucggcucacugcagccucuaccuccugggcuaaggugauucucccaucuuagccucccaaguagcugggacuacaggcgccugccaccaugcuugacuauuuuuuuuuuuuuguauuuuuaguagagauggggucuugcuauguugcccaggcuggucuugaaccccuggacucaaguaauccacccaccucugccucccaaagugcuaggauuacaggugugaaccaccgcacccagccuuggaaaacaacauuuaguuggacuuuuaaaaauccagucugauaaucuuuguauuuaacuggaccauuuagucuacuuaaaauuguugcaauuacugauuaaauaaagaguaaacauauugucuuuagucgauucuguuuugccuugccuauuauaucuuauugucuccuuucuugccuugguaggaauugguuaaauauucuguauuucuccauuuuucccucaguuaguugggucguuauauaccccauuuccauuuauaagugguuauccuagaaauuaagguauguauccuuaacuuaccaauuucaagguuaaucaacaccuuucucauuuucccaggcaacucaaagagcuuagaauacuaacauucuuuucccacuucuacguuauuguugaauauuuuaauuguguguaugugugguauuuuuuucguugguguuauuuuugagacagaguccugcucucuugcccaagcuggucugcagugguacaaucucugcucacugcagccuugaccuccuggacucaagcgauccuccugccucagccucacaacuagcugggacuacaggugcaugucaccaugcccagcuaauuuuuguuuuuuguagagacaggauuucgccaugcugcccaggcugguuugaaacuccuguacucaagugauccacccuccuuggccugccaaagugcugggguuuacaggcaugagccaccacgaccggccaauuguauguuuuuaaguaaaguuuuuguuuggaauaauuuuuuuuuuuuuuugaaacaggaucgugcugugucgcccaggcuggaguuuauaauuguuucuucuugcaggauugaacuuuuuuuaaauguucuucuuuguccuucuuugucucuuguaacuuuaauucaaagucugucuugccuaauuuuuuuuuugagauggagucucguucuguggcccagacuggagugcaguggcgcaaucuuggcucacugcaaccucugccucuuggguucacgugauucuccuaccucagccucccgaguagcugggauuacaggcacacaccacugugccuggcuaauuuuuuuuguauuuuuaguagaggcagaguuucacuauguuggccagacuggucucaaacuccugaccucgugauccgcccaccucggccucccaaagugcugggauuacaggcgugagcuaccgugccuggccuaucuugucuaauuuaaaguccauuuuaucugcuauuaguauagccacuucagcugucuuuuggugacugcaugguauaucuuuuuucaucuguuuuauuuuauuuuauuuuauuauuguuuuuagagacaaggucucgcuauguuagccaggcuggucucaaacuccuggccuaaagcaauccuccugccuuggccuuccaaagugcugggaauacaggugugagccaccacacucggcccuuauccaacuucuagcuuccguuguagcuauugaagucagauuuuaguuuaucaguuacuccuuuaagcauacuuuggaacuuuauccucagacucucauuaccuuuagaauuuucucugauuuuggcuuucugcaguuuugguauaguguauccaauaugaauuucuuuuuaccuuuuucuuuucuuuuuuuuuuuuuugagacagagucuugcucuguugcccaggcuggagcacagugggacaaucucaacucacugcaaccuccaccucccugguucaagcaauucuccugccucagccucccgaguagcugggacuaaaggcacgugucaucaugcccggcuaaauuuuguacuuguagcagagacaggguuucaccauguuggccaggcuggucucgaacuccugaccucaggugaucuucccaccuuggucucccaaagugccgggauuacagccaugagccauugugccuggccgaauuucuuuuuacaaauucugcucgggauucauuagauuucuuuaacguguagagcaauuucuuucuuucuuucuuuuuuuuuugagacggagucucgcugugucacccaggcuggagugcaguggcacgaucuuggcucacugcaagcucugccucccggguucacgccauucuccugccucagccucccgaguagcugggacuacaggcgccugccaccaugcccagcuaauuuuuuguauuuuuaguagagaugggguuucacuguguuagucaggauggucuugaucuccugaccucaugaucugccugccucggccucccaaagugcugggauuacaggcgugagccaccgcgccuggccguguggagcaauuucuuuaaucaguucuggaaaauuaucagccauuaucucuucauauauugccucuauuccauuaacuuuuuuauccuguguuauuauuuauuuuugagguagagucucgcucugucacccaggcuggagugcaaugguccgaucucggcucacugcaaccuccaccuccuggguucaagcaauucuccugcgucaaccucccgaguagcugggauuacaggcgcucgccaccgugccuggcuaauuuuuguauuuuuaguagagacgggguuucaccauguuggccaggcuggucuugaacuccugaccucgugaucugcccgccucggccucccaaagugcugggauuacaggcgugagccacugcaccuggccuaccuaaagucuuugugggcauuucuucugguuuguuuucauagugcuuuuuuuucuuguguaccuguuuacuuaaaaaaauguuuuuuuggcugggcgcgguggcucacaacuguaaucccagcacuuugggaggccgaggcugguggaucacgaggucaggagaucgagaccauccuggcuaacauggugaaaccccgucuuuacuaaaaauacaaaaaaauuagccgggcaugguggcgggcgccucuagucccagcuacuuggaaggcugaggcaggagaaucgcuugaacucaggagguggagguugcagugagccgagauugcaccacugcacucccgccugggugacagagcgagacucagucuuaaaaaaaaaaaaaaguguuuuuuuggcuaggcaugauggcucaccccuuuaaucccagcacuuugggagguggcuggauugcuugagcccagggguccaagaccagucugggcaacacagugacaccccaucucuacaaaaaagugaaaaaaauauaaauuaccugggcaugauggccugugccugcagucccaacuacuugcaaggcugaggcaggaggaucgcuugagccugggagguugaggcugcagugacucaugauugugcugcugcacuccagccuggaugacagagugagaccccauuucaaaaaaagaacauuuuaaaauugaaguauaauauaguucagaaaaguacacauauucuaaguauauggcuuacagaauguuuacaaauugaacauaucuaugcagccagaauucagaucaagaaacaggguauggcugggcguguugauucacgccugugaucccagcacuuugggaggcugagguaggcagauugcuugagcccagaaguucuagaacagccugagcaacaugaugaaaucucuacuaaaaacacagaaaauuagccgagcauaguggcaugugccuguggucccagcuacccaggaugcugaggugaucaucaccugagccugggagguagagucagcugugagccaugauugcuuuacugcauuccagccugggugacagagugagacccugucucgaaaguccccccaccaaaaaaaaaaaagaaaacaggaaaacgcaggcuauuggccgggcaugguggcucaugccuguaaucccagcauuuugggaguccgaggcggguggaucaggaguuugagagcagccuggccaacauggugaaacccugucucuacuaaaaaaauauaaaaaugagcugggcaugguggcgugcacccguaaccccagcuacucgggaggcugaggcaggagaauugcuugaaccugggagguggagguugcagugagccgagaucgugccacugaacuccagccuggcugacagagcaagacucugucucaaaaaaaaaaaaaaaaaaaaaaugcagacuauuaucagcucuagaaaccuucuagaaaccuccuuauaugcucuuccaaccccuaccaacaccucccuccaccuccccauauuaagauagcuacugucuugacuuugagagcauagaugaauuuugccuacuuuuuuuuuuuuugagacagagucucacuaugucccucacgcuggagugcaguggcgugaucucggcucacugcaaccuccaccucccagguucaaacgauucuucugccuuagucucccaaguagcugggauuacaggcgugcgccaccacacccggcuaauuuuucuauuuuuaguagagacgggguuucaccauguuggucaggcuggucucaaacuucugaccugaugauccacccgccucgaccucccaaagugcugggauuacagacgugagccacugggccuggccugccuacuuuuaaacuguguaaauagaaucauacaaaauauaacuuuuuguaucuggcuucucuuccucaguguuauguuuuugugauuuauucauaauauuguucuuagcuguagacucauuuauucuugcuguguaguauuccacugcgccugguuacucuugauuauauguuguacaugguauuugaaaacuuaugggaauuuuagcugggcaugguggugcacgccuguggucccagcuacucgggaggcugaggugggaggauugcucgagccugggaggcgaagguugcaguaagccaagaucacaccacugcgcuccagccugggugacagauugagaccccaucucaaaaaaaaaaaaaaaaaaaaaaaagaaaagaaaagaaaauguacuuauaggaaucuuugaggccaggaugaugguaucauuuuccagagaggacuuaguuucucccuggucccuaggaguaggggagucuacuaguaggagacuaauuaaaguuuaaggcuugagcuuugcuggaccaccugcauagaugaugcaaagcucagcuguguuuugcuuuuaccacuacuuacuuuuuuuuuugagauggagucucgcucugucgcccaggcuggaguguaguggcacaaucucagcucacugcaaucuccgccucccagguucacaccauucuccugccucagccucccgaguagcugggacuacaggugccugccaccacguccggcuaauguuuuguauuuuuaguagagauggaguuucaccauguuagucaggauggucucaaucuccugaccuugugaucugcccgccucggccucccaaagugcugggauuacaggcgugagccacugcgcccggccacucuuuuuuuuuuuuaauuaaaaaaauuuuuuugauugggcacaguggcuuauaccaauaguuccagcacuuugggaggcugaggugggaggagcacuuaagcucaggaguugagaccagcuugggcagcacagugagacccugccucuauucuguaaaaaacaaaaaaacaaaaaauuuaauuuaaaaaaauuuuauggcuggguaugguggcucauaccuguaaucccagcacuuugggaggcugaggcagguggaucacuugaggucaggaguucaagaccagccuggccaacauggugaaacccugucucuacuaaaaacaaaaauuagcugggcguggucgcgcaugccuguaaucccagcuaccugggaggcugagguaggagaaucguuugaaccaaggaggcggaguuugcagugaaccaagaucgugccacugcacuccagccugggcgacagagcaagacuccaccucaaaaaaaaaaaaaaaguuaugaguacauaguagguauacauauuuauuggguuuaugagauauuuugaugcagggauacacuguaauaaucacuucaggguaaacagaguagccaucaccucaagcauuuaucauuuuuuuguguuacaaacauuccuauucuuuuaguuacuuuaaaauguacaguagauuauuguugacuguagucacucuguugugcuaucaaauacuagauuuuauuccuuauaucuaacuuuauuuuuguacccuuacuuacuuuuauuucugguugauccuuaccuugaaaguguagucuuugggauuccagcuuaaaauggggguguuaucagaguccucaucucugagggccccugagcuucgacuaucaucucucccaaccccagucaaagcccagaauguugccuaaaggacagcuuuuggccaagccaacagggccaaaaaaagggccagcugguuggaguccugaguacccaucaggccuugcgggaggugcuguaacugccuaugcuacuguccucuuauuugggcaggcauugggucaaggaggagcagaacagacccuuucguggucagaauguuugccuggcuuauguccccagacaaaccagggcucaucagucuauuguucugcuuuucauuccagccuaauucagugguuugagacagcaccaagucggaccugcccacagugccgaauccaggugagaguauuggggugggaccaccucaacugaagagaucuccuuagcagagagcaggaaugugaaaagagcucugaaacugcaauaucucugaccuuuuuuggacccuccugguuuaaggccaguugagccucacuugugcccuugaguguuugggaggucugcuuacacccacagguagcuggcagauggacuuguugccugggccaguuuucacuuggguagauuuggcuggccuccuucccugucuuuucaucagugacuccgcaccuagaguucagguaucuuuugagcacuuaaccguguaggucuguaguaauaugacuucagugaccacgaaaccagcagccccaacuugggguaccugcaggaguaaagaggucuuuugacucuaaaggauguacuuugaaaaauuaggucugagaacaggccugacaugcaugucaggcagguagucagacccauguacaacacucuccuccuugcgcaugacccagcuacacaaucauacucuuaccuuguucucccauccagguuggcaaaagaaccauuaucaauaagcucuucuuugaucuugcccaggaggaggagaaugucuuggaugcagaauucuuaaagguacccagaauuuaucugauucuacugaacuccaagccuugugcgaguucacuuuucuuuuuucuuuucuuuucuuuuuucucuucucuucucuucucuucucuuuucucuuuucuuuucuuuucuuuucuuuucuuuuuuuagagacagggucuuacuuuguugcccacacuggagugcaguggugcaaucauagcucacuauaaccucaaacuccugaguucaagggaucuccccaccucagccuaccuaguagcuaggacuguaggggugcaccaccaugcucgguuaauuuuuuuauuuuauuuauuuauuuauuuauuuauuuauuuauuuauuuauuuugagaugaagucucacucugucacccaggcuggaguguaguggcgugaucuuggcucacugcaaccucugccuccuagguuaaaacaauucuccugcuucagccucccgaguagcugggacuacaggcacgugccaccauacccggcuaguuuuguguuuuuaguacagacgggguuucaccuuguuggccaggcuggucucgaacuccugaccugaagugauccacccaccucggccucccaaagugcugagauugcaggcgugggccaccgugcccagcccuaauuuauaaaaaaaaauuuuuauagagauagggccuugcuauguuacccaggcuggucuugaacucuugggcucgagcaauccucccaccuuggccucccaaagggcugagauuacaggcaugagccacugugccuggccugggaguucacuuucuauuuccacauaaguggaggguuccuggaauauggagaugaaguuauagaggugagacuugguacaguuuucaagguggggacacaaaaaucagaggacaacugaugagacacagucaucagagaaaugcacugugagggaagaggggagcugcuugacuguaaacccucccuuugggauuucaggucaauuccaaccugaauucucuccugcggucuugucuccucaucuuuuaaagaaccuacagccauccuguacagccuacuuugcugcuuggacaguuagugacagauuagaaaacucuucuacuccccagccacgggagauuuuuggauucaguguucccuagccugccugugccucaaaauugccuggggaggcugggcgugauggcucacaccuguaaucccagcacuuugggugaccaaggugggcagaucacuugagcccaggaguucaagaccagccugagcaacaugggaccccaucucuauuaaauaaaaaaaguuaaaagaaaaaaaauugccuagggagcuugguauaaagucagaugccugggccuuccccagaccagagcucuuggaaucaagaguugcagcucaggugggaauggauauauuaggggaaaguggguaguuucccuccuauacgucuaacugcuuccccuccuaaucuaaaauuuagcuuuuuuugugugcaagcaggcugcguuggcagagaacucuugaggaaguuggauuuggguucacaaaugaucccuggacucugaggguuaauuugcuggauaucugucagaucagaguucauuuggcucuggccccagggugucaugauguccuuggaaccucacugcuucaggaacauggagcuuuugugcuuagagcaagcauguucaucgucaugguaacugcucccaguuuuaaguagugucuucccugugaugaaggcaacaaaggcaguuucauuuauuuccagcuuucaaagccagguuugugagacagguagcaacaucuuggguaguuuggagcaagggcuuggaagccccugcuggaguguggaagaagucaggggacuauggguaguggugcagcagccauguccugguaucuguucucaggcagcccuugcgugcucuuccuuacccaccaccuccacucccagcuguucagccuaugcuaaccagcccagccaccagaagcucuugcccccagaguccuagguggagaguuugacaguaggggcuuguuuacccacugggccugggccauacuauuggucacaugugaaauucugagucuucuguugaucuuagacaagugaucuacaguaagguuugccuggauuccaucuagcuaccaccauggacccuuggucaagcguuucaguuuuguaaaaccuuggauuucuuuguuauggagcaggcaccucucuugcucauggggauguugaguucuguggcauccugaacaggaacuggguucaauucugccacagcuucucaaugauucuguggcauggcugugaaacauuugcaggggcuuugagaggcucacuugauccucacaauagucuaguuagagacuagacacaugggagguuucauccagggguacaaagcuguccuggcauagcuaccuccauuggauacuaggucuggaagguuugugguacacagagccaguucagagcuuggaggaaagucgacuaugaaucaggaagacccaggguggagaggaggaguagucgcccaagguccuuggccauuccuauugugugucccuggugagucagcugaugcccagagggaaugagaccaacauagagcgaugaggccaaggaagugauagaaacuucugcuauggagacugaucacaggggcccuacuuuaacuucccuuccacuauucuaccucuuuaccuguccuggggccuugccccugagauuguuuuccuccaucuuaccuacuuuucaaaagggcacauagagcuacagcagugcuuaucuuuccauuguuagcuuagcuuggccuugaggcacugcaggauucaugcccuagaaggccucauuguucaauccuggggcuccccacagccuuaugggagaccacguggaggucagcuaugaugcuuuccugcugcuuauuguggguauugccuuucagaaugaacuggacaaugucagagcccagcuuucccagaaaggugaguuagcaagagacgaggggugcugggaagccccugacuuggaugcuggaggaagggggcccuaggaggaagguuucaaaccguuugggagagccagggccuuucccugcuuuguauguccaagaguccugcuagcuguuguggugggcagaaaaagagagggaagggaggugacugaagcuguucaccuagaccaggugagccucuugucucugagugcagcuucuugcccaggaaccaagaugggaggggguuaccugaugggacugaauaucuucgggagagggcucagcugcugaguuuggcuggaaccugcuugaguccuggguugaugaacuaacuggacccauggcagguagggaaugggcaguaaaauauuuuccuaaguaguucaagcagcagaaggugggcuuuucccugaaugaaggcucuggcucagcuucucugguuuggcacaucccagagaaagaagcgggccacccagcuuucaggccugagccuuguuucucaccugccuaagggaugaggcacugaauccaagggcccaaguucuucugcugauggauggacaggccuuucccuuuccuccgcccucuaccccugcuccagacaaggagaaacgagacagccaggucaucaucgacacucugcgggauacgcuggaagaacgcaaugcuacugugguaucucugcagcaggccuugggcaaggccgagaugcugugcuccacacugaaaguagguccucagguuuuauggguacagaauucauagggagguauugccccagaacuggacuccccauucugggcuuaucuucugguucugcuccagucaucaccuugguuuggggaguuguaaaauagaggcaaaucacuucuuccccuugcccuuccauacuguacccauccaucccauaagaaaagggccauauuggcuauacuuguggguuuuguacuagguaguuugaagagucaaggccuucccaguaccucacagaggggaugcucaacuaagaccucagugaggcugggccauauuuccgaaagugguucauacucuacugaugaggccagccugaagaaccuuccauuagcacucuaguccuuggcugggcugcucuccugagccagaucaaacagcauccuagggaggagcaagggccuuugaagucagcugugcugagcugaccaaccagaucaaagucugcagagugaacagccuuagacccagaugaauuuugcaucagccuggguuggugagccucuugcucuccaaggggcaugagaggcgauugaucugaacccacgauugauauucuggccuuguaggcaggagcaguccuugcuggaugccauuugaaagggaaagggagccauccuugugaacagacaaggccccaggauauucauugucucuguuccugcuugggggcugggcuggaucacauggucuggcuggugggagggagcaaacuggcaccuggcugcagagcaggagucucucaugguauucucaggucagagacaaguggucuuaggcugaaggcagccuggccagcuuccccuggcucaauuauucauucuuggcaacuguccaugggucuggguguuggauggugaggccuggguuugugcucuggacuucuucagccaccugcacaacauguaccaugaggcccagaccacuggaccuuggcagcccacagugggccuguaaaugcuggcagugggcugugucuacuguaagauaccuuucaggaggaagcaggcagggaggugaagaagcagcuggcuuagagccuuuuagaagaagaagcacaagcgagagugggacccaggagcuuuaccuccugggguuugggaguacaugguuaucagcauuuucaaaacauaagcugcagagaguucuggagcagaguuuuccuagugacuuuagcaauggcuccugagggccuccaagcaucagguauggguguauuugcucuucagaagcagaugaaguacuuagagcagcagcaggaugagaccaaacaagcacaagaggaggcccgccggcucaggagcaagaugaagaccauggagcagugaguuuggagcuggguccugcacugugccuuugcccccagggccugcaagugguacaguucuuaggacugcagcagggagugggauugggucauguccgaggcucaaaucuccauaggccauggagggcucaggucagcugggugugggcacagaucuuagccucuaugaacucuucccccauuccaaggaaugggagcccuugccacauuccucccugucucugcugccuguggccagaugaccuggugggucuuuccuuccagaaaccucucuccaggaaaucccugaccuugagacccucuuucagcaccucuucuuucucagcagcauccuuggagcuaugcucaucucugccacagggccuuuccuugggcacacccaccuacuaaagcauccuggcagccuagccuguuaccuuagcaacggcagcaaaggaaggcagagcggcacuggguaccuacccaucagccuccagauugcaaaugccgugggcuggguguauuuuucaggauugagcuucuacuccagagccagcgcccugagguggaggagaugauccgagacaugggugugggacagucagcgguggaacagcuggcuguguacugugugucucucaagaagugcguacuguggccccucucagcaaacacaggagauaggccauggggccccagccgugucauugcuccccaucucuuguaaagcagauggaacuaaggggcaaacucuggagccaugcugccuuuguuugaacccugauuccaccuuucagcaacuauguggccugcugccaguuucuuggccucuuugacccucaacuuccugaauggaaauaguaguagaccugccucauaggauuguugaggauuuagugugaaucuuaagugcuguuucuaagggaguugaccuagcucucugggcuauaagccccauugugauugauauguagagccuguuccccauuagcacuaugauccugccuggcugggaucaaacucuacucauauucuucacucugguggguguaagguuggcaggaaggguggagggccacuuagcugagaggcauagaggguccaagaugccuccuuuaagaccaggugguuuagggagcccccuagugagacuggggcuuucugcaugcccucucaagucaccagugccugcaggacaggcaggaggaaauagucacuuccuugcauucucugcaggacccuccacagugccaccugguacuuguugggcucaggugucaaaguaggaaugagagugaguugagggguugggcagugcuuuguguuagauuagugcuguggcucagucugaccugcagguguucuuuucuggcaucucuuuccauggccacauugcagagaguacgagaaucuaaaagaggcacggaaggccucaggggagguggcugacaagcugaggaaggauuuguuuuccuccagaagcaagguaacuuagcagugaacagagguugaaggagaaguggcucuccuuuugucauguucacucuggucuccugagcaaggccaugggaccugauggcacagcugacucccuggggcagcuggaggacuuacagaaauuuguuaccaguccuuacugggcauuggccugaauauguggcuuguccacuagggguggacagaucacagagguaucccccaacauguggacacugaugcuccccucugcucuuccuggcuccuggguaccucucagcuggcuggagagcacaggccucaaaugugacagcaucagaggccuauuuuuguaccacaucuggaguagaagggcuccuggaaccugauucggucagcacagcugcuuuuacuucuggcauggugcauccacaggcugcaggauguaggaagcagccuuugcuucuaggcagcuccggaugugcauugccagacugaggccuagccucagagagcugggaucucugcccauaucucuagucucuucugggcuaccuugaucacucccuggggagcagcaggagggggcagggcacaaggcuaccacuuggcuugucuuucauucccuacacuuucuuauaguugcagacagucuacucugaauuggaucaggccaaguuagaacugaagucagcccagaaggacuuacagagugcugacaaggaaaucauggugagggacaucccuggcuugacaggaaugaggggugguuugugugcccucccagagcagggcugggcuaucucugcccaggacccuugcaccagucaguggugguucugggccccugcauccuccugggucagggugugccccuuggcccugguccggacuggagccugggccuccucaacagagggcagacagaaccaugagucuucccucauagucuguccugcacuuacaucccugaggucccuuaucagaggaggggcucuaccuggggcuuggccuccugagccuaaugaugagguaucaggccuugcucuguucccagugggcuggccuuucaugcaugcugcucauguccucugcauuaucuccggacuugaugccucagccuuucucucacacacuuuucuuucccuccccaagagccugaaaaagaagcuaacgaugcugcaggaaaccuugaaccugccaccaguggccagugagacugucgaccgccugguuuuagagagguuuguugagccuugggcgguacaggggucacaaggugggagagcuuucugguaacagucuuuacuccuccuggcuuugguggggugggugaccucuguggaccugaugucugcagacagccugcccugggagccagccaagauuuagcuggcaagcagccuugaagcaaauuaggcucugacacggagaggccagagaaggccagaggaccuagaaguggucugagaauagggcagaagcacugacugucuuggggcauccuguuuauggaguagcuccccacauuuaucuguccaccccagauuuugaaacaaauaugaaaccacuguaaaauaauucccuuagugccaggagugcgugcuuuaaagcugccagcagagggagccacgaggcagaaggauuggugucccugcaagcaugggcauccauuucugcuccugagaguuucacagaagcagacuagcugagagcauccucaaggcuaccuccugccugccaaaaguccccagcaaggacccagacagaaagcacacaacuccugucaguggccccagucuuuuuuuuuuuuuuccuuuuucuuuuuuuaauggagucuuacucuguugccaggcuggagugcaguggcacuaucucggcucacugcaaucucugccuccuggauucaaacaauucuccugccucagccuccugaguagcugggauuacaggcgcgcaccaccacgccuggcuaauuuuuuguauuuuaguagagacgggguuucaccauguuggccaggauggucucgaucuccugaccucgugagccaccugccucggccucccaaugugcugggauuacaggcgugagccacugcgcccagcccagucuuuaaucuuuuuuuuuuuuagauggagucucacucuguuucccagacuggaguacaguggugcgaucucggcucacugcaaccuccgccucccagguucaagcgauucuccugccucaaccuccugaguagcugggauuacaggcaugugucaccaugcccagcuaauuuuuguauguuuuggcagagacggguuucaccauguuggccaggcuggucuugaacuccugaccucaagcaaucugcccacuugggccucccaaagugcugggauuacaggugugagccaccgugccugguugcuuuuguuuacuuucuuuaccucuucagggugcuggaaggccuggacuccuacagcagguccuugaugagugcccacugcauggcagaccuucucuguucucuuggagcuuauguuccagugggauagaugagcuuggagcuuagauggcuaagcccacagccaaccagcuauauacuacauuauagaaucuggucuguagcucccaguuggggacgggcccaccucauucugaguaagcuucaugccagggccugcagcccaucuugguacagggaggacagcaauggucucccuuggcuuucaggccagcaggacacuaaacuugacaagccuucuucuguaagcugggcugggcuucucaucaagccacaugaggaugacuucauucauuuuugucuccaguauuuuucugggcauaaauauugaagugguuggcugggugcauugacucauaccuguaaucucagugcuuugggaggccaaggugggaggauugcuugaguccaggaguucaagaccagccugggcaacauagugagacccuguaucaaaaaacuuaaaacuuagccaagcaugguggcacacacuuguaguucuaguuacucaggaggccaaggcaggaggaucacuugagcccaagagucgagcuaugauugugccacugcacuccagccugggagacagaguaagaccccgucucucuuggaaaaaaaaaaaaaguccgggcgugguggcucacaccuguagccccagcacuuugggaggcugaggugaguggaucaccugaggucaggaguucgagaccagccugaccaauauggugaaaccccgucucuacuaaaaauagaaaaauuagcugggugugguggcaggcgccuguaaucccaguuacuugagagguugaggcaggacaaucgcuugacccugggagguagagguugcagugagccgagaucgugccacugcacuccagccugggugacagagagacuccgucucaagcaaaaacaaaaaaaaauuacgguggcaggucuguuuguuuuuagcaaaagcccuucuuuuaacuaggcauuaggcagcaccagcacagucuauucuuguguuuguuuguugguuuguuuguugguuuguuuguuuugagauagggccucauucuguugcccaggcuggagugcaguggugugaucacagcucacugcagccucaaccuccugggcucaggugaugugauccugccucagccuccuggguagcugggacuaaagugcugggauuacgagcgugagccaccaugcccagccuaggcacagccucuucuaaacucauagccucaaacucucaaaaauaguuguugaauccucagcaacggcauugcccugucuucuuuguguucugauggcaagacccucagaacuacaagugaccucaaagacucugccucuaccuuucuccugugacugcuaauguguuacuacagaggucuggaagaagucuuaaguuuucuugggccaccuacucgggaggcugaggugagaggaucacuugagccugggaggucaagacugcaguaagugaugaucacgccacugcacucuagucugggcgacagagugagaccugucucaaaaaaaaaaaaaaaaaaaaaaaagucaugucaaggaagauggaagaguagaaagcuccaggaauccaucucuccauggcaacaguugaucugguugaaaccaucugaagcaaccacuuuggaaaucuggucuaguagaacauuuccaguauccaggggagagggugaugaagaagcugguaaacuucaguaaauuuucacuguucucauagcagcuccaccuccugggcucaagugguccuccugccucaaucuccugaguggcugggauugacuacaggcaugcaccaccacgcccaacuaauuuuuuguagaggcagggucucacuuauuguccaggcuggucuugaacuccuggccucaagcgauccuccugccugggcuucccaaagugcuggguuacaggcgugagccaccgcuuugcuuugcuuugcuuugcuuugcuuuuucuuuuucuuuuuccuuuucuuuucuuuucuuuuuuuugaaacagugucuugcucuguugccuaggcuggaguacaguggugcaaucuuggcucgcugcaaccuccgcuucccgguugaagagauucuccugccucaaccuccccaguagcugggauuauaggcacgcaccaccaugcccagcuaguuuuuuguauuuuuaguagagauggggcuucaccauguuggccaggcuggucuuuaauuccugaucucaagugaucuucccaccucggccucccaaagugcugggauuauaggugugagccaccacacccagccaccaccauuucuuaauuuaaaauuaggaaaauuaauaaaucucuggcuggauaugguggcuguacuaaaaauacaaaaauuagccagguguggugguacacgccuauaaucccagcuacuugggaggcugaugcacaagaauggcuugaaucugggagguggagguugcagugagccagaaucgugcuacuguacuccagccuggaugacagagcgagacugucgcaaaaacaaaaacaaaaaaaaauuaagaauuuuuuuuuuuuuuuugagauggagucuugcucuguagcccaggcuggagugcaguggcacgaucucggcucacuucaagcuccgccuccccgguucacgcuauucuccugccucagccucccgaguagcugggacuacaggugcccgccaccacgcccggcuaauuuuuuguauuuuuaguagagacaggguuucaccguguuagccaggauggucuccaucuccugaccuugugauccacccaccucggccucccaaagugcugggauuacaggugugcgccaccgugcccggccaagaaguuucuuaaguuuuuuaagaagcuucuuaauuuuuauaacuuuuuacugcagcaguauuuuuuauuguaguaaaauauaaacaaaacucaccauuguaaccauuuuuaaguacauuucuguggcaucaaguacauuuaauugcugugcaaccaucaccaccaucccacuccagaauguuuucaucuucccaaagugaaauucuauacccauuaaacaauaacuccccuuuccccuuucuccucagcuccuucacuuaccauucuuucugucucuaucaauuugacuacuuuaggagccucauauaaguggacucauacaauauuuguccuuuuauuacuggcuuauuucacuuagcauaaugucuucaagguuuauccauguagcauguauuagaauuuucuuccuuuuuagggcugaaucaguaaucauauuuaauuuuuuuuugagacagggucuugcucuguugcccaggcuggagugcaguggcacgaucucggcucacugcaaccuccacccccuggguucaagggauccucccaccucagccuuccaaguagcugagauuacaggcaugugccacaaugcccaguuaauuuauuuaauuuuauuuuuuguagagauagagucuuaauauguugcccaggucaguauugaacuccuggccucaagccauccucccaccucagccucccaaauuguugguauuacaggcgugagcuacugugccuggcaguauucauguuuuaaauuugcaagcauucuuucuugcucuuugaguaugucuguuuugcaaagcaucauguucuuguuuuauggucucauauuucuguuugucucagagucaguauuugugcaccauggacuuuuuccugggcuccccucccauaccuggugguccuuggcuacuuuggaggccaaccuauguggguaggguuugggggggaugugcagacugcuggcaucauguugagucuuaccugaacccaggaugcagaaggcuuuacuguuggguccaauaauauuggcugcccuaggucauuguacauaguuuguuuagugucuuugagaaaagcucuucuauuuauuggcccagggcagcagccuaacugccuaguguucuaccaaugcagauuaggaugggguggagccaagcucacaauuucaucaguguuccaguuuucaggccuguuuaaugcuuuugcaaggcccucccuuuccuucauggacccccuccuuguggguucuggcugcugugucagucucuuguccccuggccaugcuuugucucccagaauuuuuuggaaaucucugggggcugauggugguugccccuucuacuuguugcaguaggauuacccuucauaccugucauuuuagggaggcaucagcauguagccaccacccccaacuacagagucaauguuaggaagaucucucucaugggccccaagggccccugaacuccaggcuagagacagccagggagaccuuuccuuaggguaggguaaggccgccaggagccaugaguucauggaggagauguugacuaaucccaugccacgcaggcaaugggcugcucaaggccuuagcucuguucuggaaaggggagcuuugagugucuugccuggcucccugaggccucuggcaugaagcccuguaacuugaccaugggugggugucccaagggugauagugucacucaggagggccucaagccagccucaaccagugagggaaggacuacuaagcccuagguucuuucuccuuguaggacaaacagaaagugggaaggaaagaaaguggaccccuggcagaaagggaaauaggcuucaagcucaugaaggaagaagaauauagaaacagucuaagacaaggccgggcgcgguggcucaugccuguaauaccagcacuuugggaggccgaggugggcagaucacgaggucaggagagcgagaccauccuggcuaacacgguguaaccccaucucuacuaaaaauacaaaaaauuagcugggcgugguggcgggcgccuguagccccagcuacucaggaggcugaggcaggagaauggcuugaacccggaaggcggagcuugcagugagccgagaucgcaccacugcacuccagccugggugacagagcaagauuccgucucaaaaaaaaaaaaaagaaacagucuaagagaggaagaaauguguccauaugauccagauguggauauggggagugagggaggcaccgugagaaccuccugagucuugaguuuaguguuguggaugaccaggaggugcaagugaauaagccuggcuugccuugagcuugggcaccacuaggcaacgccuuaggggauggcugggaguagaaaguccugccuugagccaccuggaggguaaaauuuacaggacccagcgagauccugccuuccucuugaguuuaccuuuccuaaccugagccucaacuugcugggguugguaaaugguggcagaauauggauacugcaaaaaaguuggcaugagugguccuggcugcugugguucccagaggaggaagcaaagcagccagccuagaguugguuugagguggguuugugcagucuucauuuuaacuugcaggcggggacagagguagagcuucuaggguccuggacagggaaaggaagaaauaguccaggcugccuggauugcuuagccacccaaaucaaugcagguaggcuuccucccucugauguguacaccccaguggaagugggauuguggugcagcucugaaaaguuccugaggaaggaaagagagaaggcaucuuuggagcuacccuugccauuccccaggguucuccuuguaugacaggagguggggagcccugccaggucugggugggcuggaagaauccugucggcuguaguuuuaauagaauaaaacuucacuccccaccccccaccccccccccccccccguguuauaaaaguaaaaacacacucauugagaauuuggaaaauagggaguuaucauagagguacuuaugguugacauguggaauauuuccuucuccuuuuucugcaugugggaguggugggggggugccaaaucauguaauugcacuauacauggaguuuugugugcuuuuuaaauuaaauuaaauuuaaacuuuuuuuuuuuuuuuuccugagacggagucuugcucugucgcccaggcuggagugcaguggcgcgaucucggcucaccgcaagcucugccucccgaguucaagcaauucuccugccucagccucccgaguagcugggacuacagacacaagccaccacacccagcuaauuuuuguauuuuuaguaggaugggguuucaccauguuagcccggguggucuugaucucuugaccgcuugauccacccgccuuggccucccaaagugcugggauuacaggcgugagccacugugccuggccgagaguagggcucucuugagggguggccuugagucaggagugggcuccaggucccuggagcugaguuaucucugaugcuucaggagcuguuguccuggguuaccacuguggccccaaguaaccaggucaucucugccuucagcccagccccuguggaggugaaucugaagcuccgccggccauccuuccgugaugauauugaucucaaugcuaccuuugauguggauacucccccagcccggcccuccagcucccagcaugguuacuacgaaaaacuuugccuagagaagucacagugagugauagucgcuggcacuguccaugggcugguagggggauagcuaagacagcucugcaggcccugugcuguuagcucugaguggcugauggggcagugaggguugccuaggcuuggccauggcuuugguuccagcuaccucuuguucccucaccugagcacucaaucugugcaaaccccuucucuuuucucauuauuccucaccaucaccuuucaaggcaaacguauuggaaugcaaguuagagagaaugcagugaugccagaaggggugggucugggcuggagagggugcucccaauaccuugaaggccugcccaccagaguccugagcgagggacucugaacuuccucuucuauguuugccucugaggcucaugccugagggaggaucaucucaaaccacagagcccaaggccuuaccacccaagggggugacccacaggggcaagcaugagaagcugucuggaauuccaguggggcagguggaaccugcucugggguacggugggaccagaaaaagggaggcugucuccuuggccagcuuugccaaguguaauucacuguggagacaaggacuauacucauucauacagguacuguucaggugaggcuggucaagggcugggcagguuuccucuuuuucaaagacuuuguacagagagaaagaagagaaagagaaagaaacugagaugcuagacaguggagguggaagggagcaagagggcaagccagcugggcuguccuaccucccaaaccucagggggcaugggcaccccuguuguagagggcgaggccugguagcaaugagaaacaaaccuaggacccgugggcuguaguccucagggauccugucagugucugcuguguacucuggcuuccucccauugcccuucuuccgcuguaaagguugaagguggacaccuggggucuucaggcugccaggccuuucagagacauuuccaccaccuucauggccuguggagguagugaaggagguagugaaguucugagucccuaacucagcucguccuuccuggagccuugguugucauguagccuuaccacaggccguuagggcaggagcagaggagucagucaucaggcccugaucccacucuuguccuuauggcuugagaagccacagggccagccuuagaucaccaucuucucacccaccagggaaaaugccaggagaggguauccagcugcuggguuccccaggaauuggauggaaauacaguuucuggcucuggggcugggauugggagaccagggccuggggccaugcgcuauucugccccaggcccuucuuagacacacucucuagggagauggcuuggcccuguguucugagaggauuuugugggcuacuuuacugaaaggcuaacuuacugaggcucucguggagguaguguccccucucugggaagacaggacuaggccugagcucauuaaauuucuuuugcucguaucagggcaugacuggcuuuccucccguggguggugaguugauugggcucuucagccccauauagagccugggacauggugaggugcccgaggacuugaggagcguuggaauuuggccuugaguggaagccacaggauugggacaugguccagucauccccagucaucccugucucugccacccuacuggcuguggcuguccagcuguuaacagaccugcacuuggggugggaucacugaggugccuugcccagaaugcaggcauggcagcagcagugccacaugguaacuccccaaggggcgugugcugagccugguucaccugcccccaugucuugcuuaccuaccccuugccuucucucucauucuuguagcuccccaauucaggauguccccaagaagauaugcaaaggccccaggaagguaagagcuuucuagaagaagcacagucuaaccuuuggcaggacuggacuuuugggagggcacggucuugccagagccuugucacuccugguccaggacugagguacuucggagccacccuugggauucuacucauuaucccuccugccuccuagugaggcaucagagauccugaucuuguuccaccaccacuacccucccuccuuugcugacauccagcucaucaagucuggcccuggggucuucccugcaggagucccagcucucacuggguggccagagcugugcaggagagccagaugaggaacugguuggugccuucccuauuuuuguccggaaugccauccuaggccagaaacagcccaagaggcccaggucagaguccucuugcagcaaagauguggugaguguggcuucccacaguggcaggagccagcccucuuggguagaaauggguggccagccccccagcccauuagccuggcccacucaucucuuccuuccacccuagguaaggacaggcuucgaugggcucgguggccggacaaaauucauccagccuguauccuuuuccugugauguugagcugagcugaacuguggagcccauacuaugccucaccuauacccccagccugccagugccaacagccucaggugugcagugcugggccucauucuguguaucagcgccgcccacccccggcucugagccuuucuugcccugcauugcaguccuuucucgcccugcauugcaguccuuucuccaugccucuuccuugacagcuccuccagacugacacagucaugauccgcccauugccuguuaagcccaagaccaagguuaagcagagggugagggugaagacagugccuucucucuuccaggccaagcuggacaccuuccuguggucgugagaacagugagucugaccaauggccagacacaugccugcaacuuguaggucaaggacuguccaggcagggguuuuguggacagagccccacuuucgggaccagccugagguguaagggcagacaaacaggugagggugaguguggcacccagagacugcucuuccugcccucacccugccccacuccuacgacugggagcugacaugaccagcccacugauccugucagcagguccugcuccuguugccaggcuccuguuuauagccaugaucagauguggucagacucuuucugggccuggagaccacggucacuuguugacugucucuguggaccagagugcuugaggcaucucaggcagccucagcccaagcuucuaccugccuuugacuugcuucuaggcauagccugggccaagcaggguggggaauggaggauagcaugggauguauggagaggauggaagauuuucauguaaaauaaaauuaaaaaaaaaaaacaaucucuucuuccugguucugagaguguaaauuugcaccaacacuuuagaaaacuguuuggcaugacuuucuaaagcaggaacaucgccaagccucagauccagcaguuccuucccuaggcauaugccuucucauggggcacaggaagacucuagaaagaaugagaucacugcagcuuuucucacagucucuaaccugggcacagccuaaaggccauaaguaggaaagugaacgaguaaauggaaaucuaucuauacaguguacucacagcaaauaaccagcgaccacuaccuuccguuccuacccacguuuaaacgcuaccagccaaauugcuagcuuuugacuuuuggcugcaaaggcacuuucuuucuuuucuuucuuuuucuuucuuucuuuuuuuuuuuuuucuuuuugcaacagggucucccucugucucccaggcuggagugcaguggcacaaucacaguucacugcagccucaaccucccaggcucaggugauccucccaccucagccuccugaguagcugggacugcagguacaugccaccacgccuggcuaauuuuuuuauuuuuauuuuuuguagagacaagguccugcuauguugcccaggcuggucucaaacuccugagcucaagcgauccuccugccuuggccucccaaagugcuggaauuauaggugugagccaccacgcgcagccaacggcacuuucuucuaaagugcuucccuucuugacccccagccugggugaaguccccuaaauuucccucucccacuauuagguaggaguucaccuguuuuuccaggacccagcaugggccuggcacggggaguaagaggcacagggagugagugagugcugcaguggagguugcccagcugaucucuagcauaucuggaggaguauggggcuuuguggcaaggaggugccauucuug

SEQ ID NO: 16125 - RNA, 1799 nt, Homo sapiens
cagaugucggggcggcggcggcgggagcuacggagagcgaggagucgcgcaggcaggcggaggcugagggcgccgcuggccggcccucccagcccucuccgcgcggcuccgccgggguuccaagaggagcuaguagguucggugggggcccuggcauggacaugcacagcgcucggcuugacagcuuccuuagccagcuccgcugggaacuggugaggcucgggagcgggugugguuagugaggacgcgugcgggaugccaggcugccgcccggccggaacaacagacgggugcgggguggcuccagcgugccgguccgaggcggggugggggcggcguggcgcauauggcucagauggcccgcgucggguuucggacgguugggaacugagcugagcaucagauaacagcauccagcuggccgugcugcuggaacggcgcgggaggagagaguggaagggggacuucuuugggggcggggcauggggcggcaagggacuaacgaggugcuggcgcugcugugaacgcccccuacuucaggcuggccuaugccucccuucucuaccccucaccuagcaagcgcucuuucugugaaagacgcuuugggcuuugggagcugaaucccccaauaggcacgggaugccccuccaguccugggcaggaccuacuuccccguucaggcccgcaacccugccugccugcccgcccgcccugguggcgggugccgacuugcccggcccugcaugcugcagccugccagacugccaccaggucgguggaugagaaccacaccagcuucgagugccagcaccccuaugccugcccugugcucacuaacacccugcugcccaggccagcaggccuaucuaaccuuccuggacccucuguucucugggcuggccuggugacaagugauaccucuccgacuucugcccucucuuccccucaguuguguggucgggacacaggcucacccucaaugccugguccccugcagccaaccucccaaacuggcccagaugugcagcccagccaccagcuuagggccucgggugccuuggaagaggacucagucugcuguguggaggaggaggaagaggaggaggaggaagcaguggugacagaagacagggaugcagccuugggaggccccagggagcaugcccuggacugggacucuggcuucucggaggugucaggcagcacauggcgagaggaagaacugccuguaucccagcgcccagcacccucagcacagccccuucguaggcagugccucucagucaguggccuccccaugcccagcagggccccuguagccaguguaccaccuguccaccauccacggcccaaguccaccccagacgccugccuggagcacuggcagggacuggaagcagaggacuggacagcagcccuacugaacaggggucgcagucgccagccccugguacuaggggacaauugcuuugcugacuuggugcacaacuggauggagcugccugagacagggagugaagggggugacggaggugggcaccgugcccgugcucggcccccucaguuccugcuuggccucucugagcagcuucggcgccggcuggccagggcucggcggacagcuauggcaggaaagcggcugucaugcccaccucgcccagaaccugaacugccugcggaugucucacgcuuugcagcucucaugagcugucguagccgccagcccaucaucugcaaugaugucagcuaccucugacccugcccuccagccugggacaauaaaagccuuuuuucuagac

SEQ ID NO: 16126 - RNA, 3999 nt, Homo sapiens
cguacgcggcagccgauuggcccgcgguggucgcgucacugcccgcgccggguccggccugaguucggggccagcagccgucuacccggugucgcguucuguguuguggcggcccuggauccggcgucagggcgaccgggcggacgagguggagccagagucugucaggcggguuggugaagggcgcggggccgggcacggcguugggagugcgcggcagggaccggccaggcgggcugcaggcaccucagagcccgggacacccccucaacguccgcaggcgcgaugaaggcacugaucuuaguggggggcuaugggacgcggcuacggccgcugacgcugagcaccccgaagccacugguggacuucugcaauaagcccaucuugcugcaccaaguggaggcgcuagccgcgguaagacccugggucgggaucagagucgcguucggaucuggcgggacuagggauggccagcgacuaggggucaggggcucccguaccuucugacugagcccgcccgucggccugcguucugacaggcaggcguggaccacgugauccuggccgugagcuacaugucgcaggugcuggagaaggaaaugaaggcacaggagcagagggugaggcacagacucuuggcccuuauucucgguccccgcccaacuucccauccugguagaaccugacugggggggccucuuccuuccagcugggaauccgaaucuccaugucccaugaagaggagccuuuggggacaggucaguagaggcagaaaggucccuugggggaggguuuaaggccaggaaaaggguaagacccagccuggagugggccugcugagccugaauccagggacucagaccuccagcaagguggugaccuguccccuucccccagcugggccccuggcgcuggcccgugaccuacucucugagacugcagacccuuucuucguccucaacagugacgugaucugcgauuuccccuuccaagccauggugcaguuccaccggcaccauggccaggagggcuccauccugguaaggcgccaggucuucucucucuugacacuuucacccuccaugcccagccucccaugcccccuagccuucaucugccuucggauguuauggauacagagcugugcaguauguaucuuuaagcacuuggggcagagucucuugagaucuggaacggcauguguaucaaggcuuaggaacacuggacuagguccgagguccccuuccuugcauucaggugaccaagguggaggaacccuccaaguacggugugguggugugugaggcugacacaggccgcauucaccgguucguggagaagccacagguguuuguguccaauaagaucaacgcaggcauguacauccugagcccugcagugcugcagcgcauccagguguguaggagacagcuguuggugggcugggguggggcaggccaucaccgccaugacccugcucacaagcugcccacucccacagcugcagccuacguccauugagaaggaggucuuccccauuauggccaaggaggggcagcuauaugccauggaguuacagggugaggcagggaggccacaggguggggguggucuguggcugggcugaggccccugaugcaucccucccuacaggcuucuggauggacauugggcagcccaaggacuuccucacuggcaugugccucuuccugcagucacugaggcagaagcagccugagcggcugugcucaggcccuggcauugugggcaacgugcugguggugaggcccuugcccagcccaucauuaacccccucagucuugggagacaaguggcccacuuguauuuuucccaccgcucucaggacccaagugcccgcaucggccagaacugcagcauuggccccaaugugagccugggaccuggcgugguggucgaagaugguguguguauccggcggugcacggugcugcgggaugcccggauccguucccauuccuggcuugaguccugcauugugggcuggcgcugccgcgugggucaguggguaagccugugggcugggcuggguggggagaggggcggggagugugccugccucccugacaaggccuauccucuccuggagguacgcauggagaacgugacagugcugggugaggacgucauaguuaaugaugagcucuaccucaacggagccagcgugcugccccacaagucuauuggcgagucagugccagagccucguaucaucaugugaggggaugcaguggggcuggccgagccccgguuuucccaucagcaaggggagugcuggccugacacaucagaagacccuggacuugucauuauuugucuggggggcacugggugaagcugaagcuguuggacaccugccuucucauguggacaucaucuggcaggaucccugcugggcacaccccacaaaccccacucccucaagaagggccagggccagggcuguauggaauaauaauuuaaugcucacuguggcccugacugaaagucaagcucaggcacaauuagggccauggcugggcucccaccaaugaggauacaggcaggcaaggagguuggaugugguggugugggauacaggagaagggcaaagggagcucauaaauagggcccagccuggcucuggguucaaagguggagguuccaggauggcacaggcugugagggcuaggcagcugaggagguaguacucguauuggcucccuucucccaguccucuacagacacgauggugguuuugcagaagaagcaguccuuguuguucaucaggugcugguugauacaggcucuacaacaggggaggggaugaggacugcccugcauguaccuacugcucuccccaccaccaagcuguggggcccacuuacuugcaggacuuguggccacagggcuggaacacagcagagauggggugggcauagcagauggggcagagguccuccucacuggugggcugcagggaggagagugaagggugggcuggaguuggaugccuggcuauguggauguccguugugccuguguaggagugcacacauauucaaguggcauggaccugugcaccguguucccacucaccagggaggcagcugcugccugggcagaugcagaggucaggugcgccagcaucuguuccacuugggccagcucaucggcacugauauaauccgcaucuggggagugguagguagugucaagucagagguagcugaggaugugaugccucuugaauauucccagccuaggacuuugcuguucuuaaggcuccugacccgacccagccccagauuucccugaccugccccaccagcccacucacagcucugcagggagaagcgcuuccggucaggggcuggcagagcagugccaggugcugggggcucuggcugucccaggagauagcauauugagcguagcuggaagcagggaucugccaggagcacugauguggcuugcucucuccuagguaggggagggugcaagggcagucagaaggcuuggggccuggcuaaaagucucucuugggauugccaaugaggagugccauggcucguacaugaucacccccccugcauccuuuccgucucccugcuucccaaaccccaaguccuguauucuaguaaggugccacacagccuguuuuuuuuuuuuuuuucuugagacgagucucgcucuguugcccaggcuggagugcgauggcacgaucucggcucacugcaaccuccaccucccggguucaagugauucuccugcuuuagccucccgaguagcuggaauugcagacgcccaccaccacgcccggcuaauuguuguauuuuuaguagagacaggguuucaccagguuggccaggcuggucucgaauuccugaccucaggugauccaccugccuuggcuucccaaagugcugggauuacaggcgugagccaccgcgcccggccugggguaccacuuuaagaagg

SEQ ID NO: 16127 - RNA, 3999 nt, Homo sapiens
ccuucuuaaagugguaccccaggccgggcgcgguggcucacgccuguaaucccagcacuuugggaagccaaggcagguggaucaccugaggucaggaauucgagaccagccuggccaaccuggugaaacccugucucuacuaaaaauacaacaauuagccgggcgugguggugggcgucugcaauuccagcuacucgggaggcuaaagcaggagaaucacuugaacccgggagguggagguugcagugagccgagaucgugccaucgcacuccagccugggcaacagagcgagacucgucucaagaaaaaaaaaaaaaaaacaggcuguguggcaccuuacuagaauacaggacuugggguuugggaagcagggagacggaaaggaugcagggggggugaucauguacgagccauggcacuccucauuggcaaucccaagagagacuuuuagccaggccccaagccuucugacugcccuugcacccuccccuaccuaggagagagcaagccacaucagugcuccuggcagaucccugcuuccagcuacgcucaauaugcuaucuccugggacagccagagcccccagcaccuggcacugcucugccagccccugaccggaagcgcuucucccugcagagcugugagugggcugguggggcaggucagggaaaucuggggcugggucgggucaggagccuuaagaacagcaaaguccuaggcugggaauauucaagaggcaucacauccucagcuaccucugacuugacacuaccuaccacuccccagaugcggauuauaucagugccgaugagcuggcccaaguggaacagaugcuggcgcaccugaccucugcaucugcccaggcagcagcugccucccuggugagugggaacacggugcacagguccaugccacuugaauaugugugcacuccuacacaggcacaacggacauccacauagccaggcauccaacuccagcccacccuucacucuccucccugcagcccaccagugaggaggaccucugccccaucugcuaugcccaccccaucucugcuguguuccagcccuguggccacaaguccugcaaguaagugggccccacagcuuggugguggggagagcaguagguacaugcagggcaguccucauccccuccccuguuguagagccuguaucaaccagcaccugaugaacaacaaggacugcuucuucugcaaaaccaccaucgugucuguagaggacugggagaagggagccaauacgaguacuaccuccucagcugccuagcccucacagccugugccauccuggaaccuccaccuuugaacccagagccaggcugggcccuauuuaugagcucccuuugcccuucuccuguaucccacaccaccacauccaaccuccuugccugccuguauccucauuggugggagcccagccauggcccuaauugugccugagcuugacuuucagucagggccacagugagcauuaaauuauuauuccauacagcccuggcccuggcccuucuugagggagugggguuuguggggugugcccagcagggauccugccagaugauguccacaugagaaggcagguguccaacagcuucagcuucacccagugccccccagacaaauaaugacaaguccagggucuucugaugugucaggccagcacuccccuugcugaugggaaaaccggggcucggccagccccacugcauccccucacaugaugauacgaggcucuggcacugacucgccaauagacuuguggggcagcacgcuggcuccguugagguagagcucaucauuaacuaugacguccucacccagcacugucacguucuccaugcguaccuccaggagaggauaggccuugucagggaggcaggcacacuccccgccccucuccccacccagcccagcccacaggcuuacccacugacccacgcggcagcgccagcccacaaugcaggacucaagccaggaaugggaacggauccgggcaucccgcagcaccgugcaccgccggauacacacaccaucuucgaccaccacgccaggucccaggcucacauuggggccaaugcugcaguucuggccgaugcgggcacuuggguccugagagcggugggaaaaauacaagugggccacuugucucccaagacugaggggguuaaugaugggcugggcaagggccucaccaccagcacguugcccacaaugccagggccugagcacagccgcucaggcugcuucugccucagugacugcaggaagaggcacaugccagugaggaaguccuugggcugcccaauguccauccagaagccuguagggagggaugcaucaggggccucagcccagccacagaccacccccacccuguggccucccugccucacccuguaacuccauggcauauagcugccccuccuuggccauaauggggaagaccuccuucucaauggacguaggcugcagcugugggagugggcagcuugugagcagggucauggcggugauggccugccccaccccagcccaccaacagcugucuccuacacaccuggaugcgcugcagcacugcagggcucaggauguacaugccugcguugaucuuauuggacacaaacaccuguggcuucuccacgaaccggugaaugcggccugugucagccucacacaccaccacaccguacuuggaggguuccuccaccuuggucaccugaaugcaaggaaggggaccucggaccuaguccaguguuccuaagccuugauacacaugccguuccagaucucaagagacucugccccaagugcuuaaagauacauacugcacagcucuguauccauaacauccgaaggcagaugaaggcuagggggcaugggaggcugggcauggagggugaaagugucaagagagagaagaccuggcgccuuaccaggauggagcccuccuggccauggugccgguggaacugcaccauggcuuggaaggggaaaucgcagaucacgucacuguugaggacgaagaaagggucugcagucucagagaguaggucacgggccagcgccaggggcccagcugggggaaggggacaggucaccaccuugcuggaggucugagucccuggauucaggcucagcaggcccacuccaggcugggucuuacccuuuuccuggccuuaaacccucccccaagggaccuuucugccucuacugaccuguccccaaaggcuccucuucaugggacauggagauucggauucccagcuggaaggaagaggcccccccagucagguucuaccaggaugggaaguugggcggggaccgagaauaagggccaagagucugugccucacccucugcuccugugccuucauuuccuucuccagcaccugcgacauguagcucacggccaggaucacgugguccacgccugccugucagaacgcaggccgacgggcgggcucagucagaagguacgggagccccugaccccuagucgcuggccaucccuagucccgccagauccgaacgcgacucugaucccgacccagggucuuaccgcggcuagcgccuccacuuggugcagcaagaugggcuuauugcagaaguccaccaguggcuucggggugcucagcgucagcggccguagccgcgucccauagccccccacuaagaucagugccuucaucgcgccugcggacguugagggggugucccgggcucugaggugccugcagcccgccuggccggucccugccgcgcacucccaacgccgugcccggccccgcgcccuucaccaacccgccugacagacucuggcuccaccucguccgcccggucgcccugacgccggauccagggccgccacaacacagaacgcgacaccggguagacggcugcuggccccgaacucaggccggacccggcgcgggcagugacgcgaccaccgcgggccaaucggcugccgcguacg

SEQ ID NO: 16128 - RNA, 9325 nt, Homo sapiens
ccucucaccgucaaggcccgcccccugccaacgguccucacccauuagccgaaggccccgccccucacagauugccgcagggcaggggcggagacagcccgggccgucccaggcuccgcccccggaagccucacuuccgggcgcgagcacgccccgccucgccccggcggcagagaggagacuauggaacgucaggugagggcucggcccgcgguccccguggucccugcagcccgggccgggccugacccugguguguccccugcgcaggugcugcugagcgagcccgaggaggcggcggcucuguaucggggccuuagccgccagcccgcgcugagcgccgccugccugggcccggaggucaccacgcaguacggcggccaauaccggacggugcacacuggugugugugcgaaggggaacuggcuggcgacggggucgcgcacuggggugggaaggaaggggguguggagggcucgcugcuugacagugcguaaggguauauagggagccggccuggacuuggagguuacacucccacaggucccugcacacagguguguggagggggggagggggcgugcggggcguuaucgaauggcggccaugagugcacgagaugacggcguagggguagaagucaaaccugggcucagggcguggaccuuguagggcucuccaccaacacgccaucccauacacaugccaggcugcccucaagauuccaggguggaugcugggguuacuaggggguucucucaaagaggcugucagcucaggcucuggaggccuggacuaggguuguggccaaguguuguccagccugcagccagggugucagugucuggagacagauugagagauuggggaagauagaucuaggccuuccugggucagguggggcugggggcaguagccaggaguagccaagacaaggugagcagucucaugccuccccucacagaguggacccagagggaccuggaacgcauggagaacauucgauucugccgccaauaccugguguuccaugacggggacucagugguguuugcaggaccugcaggcaacaguguggagacccggggggaguaaguuugagggaggaagcuugugggcaaggccacagccguccgcaaugcaagccuuuuaugaaugcucaccaugugccuagaagggaggccagcagccagguucuugcccccuugggagcucauucaguuucuggugacauggccugauaagcacuggaagcuugcuccaaacucagccuggacuagagcccaugguggccuggggaguugcagagaguagagucucugccucagggaggaaaggcaagguggggcuagaggugcuccagaagcugguguggggccagagccucaagaaucucuccuaagaggugugcccaguagggagcaggaagggguuauugcaagauaauccugaccugugcuaccccauguccacagacugcugagcagagagucuccuucaggcaccaugaaagcugugcugcgcaaggcuggaggcacgggcccuggggaagagaagcaguuccuggaggugagucugcaugggaccagguagugggugacaagagagaggcucugccccacagauaaggcucuguuagcgggcaaacagccuaaugcccagauguccucaggucugggagaagaaccggaagcucaagagcuucaaccugucagcgcuggagaaacaugggccuguuuaugaggauggugaggcaucuggcuggugagcaggcaggguggacaggagggguagccguagcccugggcccccccugauuggcccucccugcacccagacugcuuuggcugccuguccuggucgcacucggagacacacuuguuguauguggcagagaagaagcgccccaaggccgaguccuucuuucagaccaaagccuuggacgucagugccagcgaugaugagauagccaggcugaagaagccagaccaagccaucaaggugcucguggucaauccacgaaggcccggcagggcagcccuggggcucagugugcucccuucccauacugugccugucagaccuggggaggcacuagcuuuuaggaagcagagcagguccuauagacaggcugggcauugaguaucuuguguucucagggggaucaguuuguguuuuaugaagacuggggagaaaacaugguuuccaaaagcaucccugugcucugcgugcuggaugucgagaguggcaacaucucugugcuugagggggucccugagaauguguccccuggacaggucagcagcaacagccuguguccccccuggagucugggacccuucuugagcuaccaccccuugcucacuccugcccuuugauccuguuuacaggcauuuugggccccuggagaugcuggugugguguuugugggcugguggcaugagcccuuccgguugggcauccgcuuuugcaccaaucgcaggugagggaguggggcaaggcaaggggccuugcagcccagcuggccuugagacugagugucugucucgugguuccaggucagcccuguauuauguggaccucaucggggggaagugugguaaguggcugaugcccaccugugcuuugcugacacauguuggcccugccagccugcgugaugcucauguuuccaucuggcccagagcuccucucggaugacucccuggcugucucuucuccccggcugagcccagaccaaugucgcauugucuaccugcaguacccaucucugaucccccaucaccaaugcagccagcugugccuggugagcuggagguggcagggaugggaggguggucagcaagaagaugggaugguggaugagagcugaagggccaguaucaucuccccauaggcccucaguaggugcccuucuguccucaaugcagcagcggugugaguucugccuguccucucaaggagggccuagagguugagagugcugccauggagagcuuugcacuguuggggcauuccaccuugagagaaugcucgucugcaagaaugcuccuccccuuggcucucaacugcauguagccaggcucugcaaggggcugggauauaguggggaguuacacaaucccagacccuccccaggaagagcucugggccccugguaaaagucagagggacaugccuaucugaggccccuugggcaucugguccaggucaccagaaaagagauacaucaggcuuauuccaguucccccaucuccuggggcuaccugaggcaaaaggggauaggcacagggcacugugcccuaagggaacugccuguccccuacuggaccugaccauuguguucucuugcaguaugacugguauaccaagguuaccucaguggugguagauguugugccucggcagcugggagguaaggcauaccuggcugggugggugcaguggggccuguagcucugcuuuccugccgucuguugcaucccugccccguucuucuuuccuagguuccuucugagggcccuaccucccugcugggccagccuuaugcccagcauccucagggagcggggcugucaccauagggagcggggcugucaccguagggaacaguucaauagcaaggagugguaggaccaagcugagaucagaguggcccaaguugaugauguauuauuuccugugcugcaggucauaauuagaguuuucuuauuuuuccaauggcugguucaaaccaaaaccaugacuccuucaagugggucucaggaagugcacuagguuggaaugucacacucgagaggcucuggacccgagggcaugauauuaucccauccaccauccuaaccccagcaaccuuuguccagucuaagcccugaagucagcugggucuucaggaggguggcucuuggcugagaggcucccgucucgaguguugauagcucugcuuggauccuccuggaccaucucaaggaugagucucuuguuuucucaggccacccggucaguuccaggaguucaguggacaagggauagccucuuugucuucucuuuggguugcagggaugcaguggugggaaccuaguaugaaucccagcucugcccuaaauuagcuguguccucagacaggguccuggccucccugagcucccauuucuucauggaggggugauugugucugccugccucauaggaucauagugaguguuaagugagugaugauauuaaaggguaggauuuacugagcccccugugccaagcgcugugcuaagcaccacaguggagauaagacggacagaugauaucuugguuaaagcaccugguaccuaccuggguucaacuggaauuacucaggagagcaagugcuuuuccucugagcacccaugguuucucucuggagcucuugagcucugccucucuggguccucucugggucccaagaggccucugccccucagccaccuacucaggcagcuccucaucgcguagcgugcccccaugugugcuacaagcugcaggggccugacuggugccugaguagggcccugggugaauuccccaguacccuagccuuccuuguagacuacccucccuaccuccacuccuggaugcagccucagcccuccuaucuuuacagagaacuucucugggaucuacugcagccuucugccuuugggaugcuggucagcugacagccagagaguggucuuugacucggcucagcgcagccggcaggugagggacgcugauuguguugaggggcagccccuguggucaacccccaggagcccuggggguugcaugugcaugccccuggguggaaugcccagccacaaagucucaucagccccuuaaaacccugccugcccauccuggacucauuucuccuggaggggacuggcugcccuggugcaccacagcagaacucaggccuuuucgucugaggcagagaugcaaccccucccaggcauuucuagcugggggucaaggggacugccacucgggugggucccugaacacucuguaauggcagcugauggggacaggacugaggccuucccccagggauggaguaaagccacucacagugugccaggcuccuuuugggugugauauuugguccuugugccaacucaaaggggcucaaagccauuccuuaccuugcccagggucacccagcaaguugugauggugcugggauuugaacccaggcccucacacuacucccuacugcacugaguaaccaucaccauagcuguccacagccuuggucuggccagggcucuccaagaggguagagaggagguaggggagggacccauagguagagggaguacucuuggauguggucgcaccuguggccuugccucugcuucaggaccuguuugcuguggacacccaagugggcacugugaccucccucacagcuggugagcaaggcuuuggggauggggguaagggcagggcuggugagcaagccaaccaggcagcgggggacuggagcuccaacauguggggcagugauggcauucucagccacucagcaccacugacuguuccacagccuuuacuaacagguccccaaggccccugucugugcagacccuuacccaaccaacagacuagcuucccugcucuacugcccuuuagcacucaacucuguuccauguguccuggcccagccucagcacggcccccaccucugcuccuaaaacccacaaaacucucucuuaucaagaucugccagacucauccuucucgcucugcaaaccuugggugccugucucaggcagaggcagcucugccaccugagggcccaggaaaagcccaguguugacucccccgucuuccccauacuuaggccuggugauucugccuuugaaauguguuuugaguccuccaccugaccugacuguauccgcuccuccacaaagcuaccaaaguaucauuccaaagcuacaucucauuguacaacugcuuggacaccacugccccaaaucagcacgcuccccgacccccaacuucccggucccagcugccacccugcacacagcagccaucgagggacaggcagaugugccugcauggucugaugugucuuaagguuuggcaguucccagcccagccagugucugucagaugaacaacagacugagagcaggaggcucacccggggccaugugcaguuggguguuugugaaaggcacuucucggggagaaaagggcaccuuuccauagagucuccagccugggacucuguuacagagaagcagguaagaaaggugauggcuccugcuaagcacuuaauggcaucugccuuuuccaggagggucaggugggagcuggaaguugcucacaauugaccaggaccucaugguggcacaguuuuccacacccagccuaccuccaacccuggugagugucggugggucccaggcuguggaggcagggguucugggcaggcagagcucaccaggucagggaauuggccccagagucugaccuggcuggucagcauacagacgggccaagacacaggcccagcuuggcaugguccaugaggguuuggcacucacagggacgaacuacuaggcuagaaucugcuccguacaaaacaaggugccuggggaagugcucugucuugguauuacagagcaaaggagacagcagagccuagaagcugaggagggaggggugugccugugugugauuguaugaguaugaauaccuugguauauaccaucccacaacaggaagccaugcuguaccuucuggagguggguagagggcccagcauagugagagcugccuauuucccacugugggcagaagggaagggcagggaggcagccaggccaccuaugacacauucuuuccccuuggcagaaaguuggguuccugccuucugcagggaaggagcagucaguguugugggugucccuggaggaggccgagcccauucccgacauccacuggggcauccgggugcuacagccacccccagagcaagagaaugugcaguauggugagcugggccaggggcagagggaugccuucuccagguuccccagcacaaagccucugcggugaccuuugcuaccuccucucucacauugugggguuucuggugaugaccucuaagagguuuucuguuccucuuguggaugggcaugggaaguagcaucuagacaucugagcgccugcucuggauaucaccugggcuucaccaggccaaaucaucugugguuggaagacccagguccaaagaaaauaggccucauacaagccucagugaccacaccucaucccgaaugcuguugcugcaggaugggguucccugacgagggcagaagaaguaugagccuucugggguccaugugucaugguguggacuaccuuggccaggucucugacccagaggucagccccacaccugcagcuagagauggggccuuaguuggggaagccccuaggcucacccugcugacugcugcccucucccugcagcuggccuugacuuugaagcaauccugcugcagccuggcagcccuccagauaagacccaagugcccaugguggucaugccccacgguaggcaucuggcguuaagagcccuugcccucccagcccucuuccuagcuggcccuuucacccuccgcucccugucugcaggggggccccauucauccuuugucacugccuggaugcuguucccagccaugcuuugcaagaugggcuuugcgguacuacuaggugagugagcagggacccacaguucuguuaggacuacaguggagugacggggguggaccugguuuguauaaguaccaugggugccacucuagucuccaggacuuucucuagccuagaccuaguaaccacuaccaggaacugcuggggcccagccucugguucuguggcauagugauaacaaggacuaacucgggacuuccaaggaaagggcgcuguggucacuggguggcagccucaaaucucugagucccuuccccuugaccccuugacagucugugguauagcuggccccagggccuacuucacagaugugugaaaagagcgucgagggggcugggaauguugccugacuacacugucuggucccucccugcccucagugaacuaucguggcuccacgggcuuuggccaggacagcauccucucccucccaggcaaugugggccaccaggaugugaaggauguccagguagcaggggcuggggcuucuggacaggcugaaacaugggcugccagggggaugccuccauucagcugagcgggcagcuggcugcagcaugcuuugucccacccugcaguuugcaguggaacaggugcuccaggaggaacacuuugaugcaagccauguggcccuuaugggugguucccaugguggcuucauuuccugccacuugauuggucaguacccagagaccuacagggccugcguggcccggaaccccgugaucaacaucgccuccauguugggcuccacugacaucccugacugguaggcauacaccacaggucccugcccuucccuccucuaccucaaauucucauggagccccguagccccagaauuccuggggcugcaacagcucggugucuugcaggugcgugguggaggcuggcuuuccuuucagcagugacugccugccagaccucagcgugugggcugagaugcuggacaaaucgcccaucagauacaucccucagguaugcagcccccuccuugcccugugugcugcccauccauccagaauccagggcccagcucaacacagcuccccacucuuccccaaacacccaggugaagacaccacuguuacugauguugggccaggaggaccggcgugugcccuucaagcagggcauggaguauuaccgugcccucaagacccggaaugugccuguucggugagugcagcaugaaggcccuggcagcuggugggcaggugagcacaggaggacccuccaaccuuaaauguugcugacuaaucccuacaggcuccugcucuaucccaaaagcacccacgcauuaucagagguggagguggagucagacagcuucaugaaugcugugcucuggcuacgcacacacuugggcagcugaagcccugccauucugcaugagcugaucagccugugccacacuucgcucuugaggagcucaacggucuggcagggcagcaggaggcuuucugggcucuggacuccacggaugcgugggcagaggaaugugggcuauguagucauaauaaauuaggacacagagccugguuccugcugguacuuuguaccaaaccauccccaa

SEQ ID NO: 16129 - RNA, 6395 nt, Homo sapiens
ccgggauuuguaguucuugaggcucggcugaggaugccgggaagggcugguggucgggggccuagagcggcgguugcacuuaguugcggcugcugucaccaugucccgcguuuuggugccuugccaugugaaaggcuccguagcccuccaggugggcgacgugcggaccucccaaggccggccuggcgugcuggucaucgaugucaccuuccccagcgucgcucccuucgaggugagcaagccuggugggcgcgaccgaggcucccgggcggggccgaccuggaaucucggucguuucccaggcauuuaaucuuuuaugggaaagccucugccgucuuccuugcccuugcaaauuaguuaaucauucauuuauuuaguccuucaguuaacacauuuuuccuagaauugagcuuccugucuuguucucugcuaugucucuugcccacauccaggacagcgcuggcaugcagguggcgagagugggcuagguuuugcuggaaauaccaaauagugaaccaaaauagaaguuaggggucauuuugucccuggccacaguuggggaucgcuaagcaaugauuuaccccaaaaccugccuccccauuuuuuuuuuuuuuuuuuugagacggaguucacucuuguugcccaggcuggagugcaauggcacgaucucggcucaccgcaaccucugccucccggguucaagcgcuucuccugccucagccucccaaguagcugggauuacaggcaugcaccaccaugcccagcuaauuuuguauuuuuaguagagacaggguuucuccauauuggucaggcuggucuggaacucccgaccucaggugauccgccuaccucguccucccaaagugcugggauuacaggcuugagccaccgcacccggccaccccuccccauucuuauagucccucccagaggucacuuaccucaucaccauacccccaaugacucgaguugccaaucuccaguugcacuuccacaucaguugauagagugacuggacacuguaugacucaacaaagagggcaaaacccaccuccaauggcguggcauugagagcccucugugucugugccccaccuguuucugucucuuuuuuuuuuugagauggagguucacucuuguugcccaggcuggagugcaguggcgcgaucucggcucacugcaaccuccgccuccuggguucaggcaauuauccugccucagccucccaaguagcugggauuacaggcacccaccaucacgcccggcuaaauuuuuguauuuuuaguagaaacgggguuucaccaugugggacaggcuggucucgaacuugugacgucaggugauccacccacggcaugagccaccgugcccagcccugucucucuugucucaggagcuuugugcuguggugugugguucucccccaagcuguuccuuaccaucaaaugggaaacuuaauuaaagagcccaaccuuggaaauccugacuuaguagacuaaggugaagccaggacaauuuauuugguaacacauuuucuuggguaauucugaugaguauccaaugacaagauccacugcaguagucaagcugaaucacuggcuguuccaguggcacaccagguucucucacccuuugguaauuauuuguauaugcuacuuuuacauuaucuacauuucuuuuuuuuuuuuuuuuuuucugagagguagccucguuuugucacccaggcuggaguacaguggcuugaucuuggcucacugcaaccuccaccuccuggguucaagcaauucuccugccucagccucccgaguagcugggauuacaggcaugcgccaccacgcucagcuaauauuuuuguauuuuuaguagagauuggguuucacuauguuggucaggcuggucucgaacuccugaacuuaaaugauccacccgccccagccucccaaagugcuggcauuacagacagauguaagccacugcacccagccuacguuuucuacaucucuuuuuuuuuuuuuuugagaccgugucuugcucugucgcgcccaggcuggaguggaauggcgcgaucucagcucacugcaagcuccgccuccuggguucacgccauucuccugccucagccucccgaguagcugggacuacaggugcccgccaccaagcccggcuaauuuuuuguauuuuuaguagagacgggguuucacuguguuagccaggauggucucaaucuccugaccuugugauccgcccgccucggccuccgaaagugcugggauuacaggcuugagccaccgugcccggccacguuuucuacauuucuuaguccacuuggugaacucuuccuccuucaggccucauauguacauuuucugccucuuccaggguuagagcgcugcucucuagcagcaucuuggacguguggcaagaucugcagucgugguuuguuuccaggaccuacucauuuagacugugagcaccuuuaggaaggcagaauugucuuugggcccuagugauacuuguugaaauuguuaguuuaguagaagaguacauugaaaggggaagaggcagguggaucaccuaaggucaggaauuugagagcauccuggccaacauggugaaauucugucucuacuaaaaguacaaaacaauuagcugggcgugguggcacguaccuguagucccggcuacuagggaggcugaggcaggagaaucgcuugaaccugggagguggagguugcagugagcugagaucacgcuacugcacuccagccugggcaaaagagcaagauuuccucucaaaaaaaaaaaaaaaagaaaagguggggagaaggaagagguggcaccuuugaucuuugagcuuuucaggccccugggccugggucugacuuguuguaauggguuguauguguucuaguugcaggaaaucacguuuaagaauuacuacacagcuuuuuugagcauccguguccgucaguacaccucagcacacacaccugccaagugggugaccugccugcgggacuacugccuaaugccugacccacacagugaggagggagcccaggaguauguaucgcuguucaagcaucaggucagcugggccucaggauggccagggcagcccagaugaggacuuaccagagguggggggauuggaucaauauaccaagagggaagagggggccagucuggccugaacugugacuuccagggaagugccuuggagggacuacuguuccuuccuucccaaggccuguggggugggcagcauucuggcucauugcugguugggaggcuucugggcagugagcuggauccuugcuggguccuugugugugugugucagaugcugugugacauggcuagaauaucggagcuacgccugauucugcggcagccaucaccacuguggcugucuuucacaguggaggagcugcagaucuaucagcagggaccaaagguaagugacuagcucagcugcuggcuggcccuuuccccagaaagcuucuaugacugggaaagcuagguggugggguggguaaugggugaagauugugaauggggccuucauggagguuagcugggugugaaugcuggaagcucacaaugagaggugaggccauguccccauauccccugaccuuuggggccaccugcuacuuucagagcuggagccuuuaggugcugggagacacuuuugagcuuguguuucugaggacuccgucugcacagcaggagaacuuagguagucugacugccucuuuaggucucugugggcucccuaaacaggguuuucccagugucugaggcccagcggcccuucucucugcuccuaggaccuuggaaucuggucccagagcuguccacuuugucucacucagggcaguacaucuuugcuuugcagagccccuccgugaccuuucccaaguggcucucccacccagugcccugugagcaaccugcacuccuccgugagguaagcccucacccuagguaagaaccaugugugaauggcucuaguguccaacacaggccagguagaccccuuccuguaaaauucuggggcugggcccagggcccuuggguguuaucuuccuccuggguauucugugggauuugaggcaucucuguuguggggcuacaucaggcccuaaccucauguuucauaagccaucugagaauguuguuggucucagcuggagggccccuagcccagguuggccucucuggagccugaagggcacugcuggggagagacccauggccacugaccccuccuucuggagcagggucucccagaccccagcaggguauccuccgaggugcagcagaugugggcacugacagagaugauccgggccagucacaccuccgcaaggaucggccgcuuugauguaaguaaucgcuuccuucugcuuggcuugcuuugcccugagcagaucagaccugauggucuuuuguauuucagguggauggcuguuaugaccugaacuugcucuccuacacuugaaugguugcuccuagccaagauguuggccuuucugugcccacccagacuugguuugggccaccagaggcugaaguguauuuccugugcauuccaaguguugccugcaugccuguucugucugggccacauucacagauucaggauucucaggggcuuaccguguuacuucagcaugagcuccuggcaugggggugcucugucuucgccuggcugcaacucaauucuuccuucuacccaaaaacacuccagucaguuguacuuacugagaaucccugagugcccucugccccuucuggcaacaugcacauuccugucuucugccugcucccucaugucagugcaguugggcugggcugaccuacuaaaaccugcuccauguauggaccuggaaggccauugcugccauggcacuugggacacuugaggaagaaacagaaaccuuauuucuuccuguguguccccuagugguuuucuuuccauuuguguuaugccacagagagaaauuuccugucugaacucuucugcugccugccuaggaaggaaaccugaagauuugggcagccugagucucuugguuucugagcuggcuccugaauauauguucaagugggugugcccauagggccugggcacgugucucuagcaaaaccagggccugagcauaagaacugggacccuucuaggcagggugcaguggcucacgccuguaaucccagcacuuugggaggcccaggcaggcggaucaccugaggucaggaguucaagaccagccugaccaaccuggagaaaccccgucucuacuaaaaauacaaaaaauuagcugggcguggugguaggcaccuguaaucccagcuacuugggaggcugaggcaggagaaucucuugaacccgggaaguggagguugcggaccugagaucaugccauugcacuccagccugggcaagaagagcgaaacuccaucuuaaacaaacaaacaaaaaaaaaagaacugggacccuucugccaucugacauagcccaaagcacaucucuauccuuucucccaguugccccucuccuuuuuuguuguuuuuuuugagguugaguuuugcucuuguugcccaggcuggagugcaauagugcaaucuuggcuaacugcaaccuccgccucccagguucaagcaauucuccugccucagucucccgaguagcugggauuacagucaugcaucaccaugccuggcuaauuuuguauuuguaguagagaugggguuucuccauguuggucaggcuggucucaaacaccugaccucaggugaucugccugccuuggccuuccaaagugcugggauuacaggcaugagccaccgcgcccgcccugccccuuuccaagagauaugcucagcauaaugagagaucaaccgugguggggaguggguccaaguaaggguucucauuguugccuuuuaagaggccuaaguccugcauuaacucaguccaaccauuaagugaugcaggcugcucuucccucaugugagaaaaaccuguuucccucugguucuuccuggcuuugcaccugguggcuauuacaaagcaguacugcaguaugucuuggaccuggaaaguuggacauguguguggcucaacaguuuucucgggggaguucagugaccuuuugguggccacccucuguucucaccugugaguucuugcagguggcgacuucaucugcaaggucacuuacauagccccacucagcugcuucggaaagcgugacgaagcaguaguccucaguguguguguaagugaagaggaccuugugguagcagggaccaugcuucauucguggcuguguccccaucugagggccugguaugcaguaagaucaauaaauacuuguggaaugcau

SEQ ID NO: 16130 - RNA, 5058 nt, Homo sapiens
gcgugccuggcagugugguggccucugugcgccgucugcacucguugcaggcgacgaugcagagggcuguaagugugguggcccgucugggcuuucgccugcaggcauuccccccggccuugugucguccacuuaguugcgcacaggugggauagagggugcugaucuuggagggugggggagggaagcggcugggggcuagggcccugguggcacuaagcccagccgcccacaggaggugcuccgcaggacaccgcucuaugacuuccaccuggcccacggcgggaaaaugguggcguuugcggguuggagucugccagugcaguaccgggacagucacacugacucgcaccugcacacacgccagcacugcucgcucuuugacgugucucauaugcugcaggugagccaggggagcacacuggccaucugaucaggccuuccucccuguuuacagugguccacuccuuggcuuuguuugcugugaacuggauuccaaggacagccuucucagaagagcuagaggucaugggggugucauggauaggucaauggccccaaggaaaugagcucagagggucucaucaucucauccuucuagcuugcccccauuaaauggugugccuuaaugucccggguuuuccagggcugacacccacucucauguauugggcuggauguugguuugaaaagggguuauuucaggaaggugcuagguccuguccaguucccuggcaguccccccacacagagugacugggggaggucaggaaaucagaaggugguccuuugccacguguagaaccaaaagacugguuagucacuuugggugggcuggacugcacuguggauggcagggaggaugcauccuugcuuaguagccuuuuggauuguagcuguugcaauggccugaggcuuucaaucucuuccccagaccaagauacuugguagugaccgggugaagcugauggagagucuagugguuggagacauugcagagcuaagaccaaaccaggugggcccuuuuauuucugcucuaugaguuuucuuagucaugagccagcaaaugggcugagucccuaccucaggcuuaggggcacagagaugagucaaacacagcuucucagggcuugcagucuuggacagaaucccugagucauuuccagagacacagacauuuguagggaggggaauaucccagucuuacuacaucaggcuaggaggccagaaaccaagguuaauaugcugcucucuggccaucccuucugcuuaaccccucucuauucaacauguggucccuggccaggcgacgugacucaaacaccuguaauccuggcacuuggggaggccaaggcggguggaucaccugaggucaggaguucgagaccagccuggccaacauggcaaaaccucguuucuacuaaaaacacaaaaauuagccgggcgugguggcgcgugcuuguagucccagcuacucgggaggcugagguugcagcaagcugagguugcaccacugcacucuggccugggcaacagagugagacucagucuaaaaagaaaaauaacaacaacaaaguguggucucuaaaccagcaucuuuggagcuuguuaggaauauagucucaggcacugcugcagaccugcugaaucagaaccuucauuuuaacaagauccccaggugauucaugugacccccucaaccucaggcuuuuuguccauccaguggggaggcuaaggaaguuuuuugggggcauugcuauggaguacuuaggagagccugcgaucaucaagaugaccuuugaagcuuuuguccuguggguugccacaugggcuaagucgucccagguuuggguaggugaagcagcagguccuaggugucauagauuaagugucagaugggacucucaguacagaguggggaggggugcagagguugcaccagaucagggaagcaccccaagguagggaggggaugaaaacuuacuugaugcaugaggaucaaagaccuuggacuugggcccagacuuguaccuugcacacccugaguccuucacauuaggguucauaaccuuuugguaacuaaguggguccaggguugugucuggcucacccuuggccuugcccuccuggaccuggaagccaaaacgcuccacuuugguccuaggggacacugucgcuguuuaccaacgaggcuggaggcaucuuagaugacuugauuguaaccaauacuucugagggccaccuguaugugguguccaacgcuggcugcugggagaaagauuuggcccucaugcagguauacccccucuguguucuagacaccuugucuuccuuguucauagagcaguauccuuguuguccaagacaggguuggcacagacaagggaccuggaaaauggcucuuucagugaaugaacagcuaugagacucaagagcaggcccucucuggagcacgccaggguuugguggugggggauuaccaggcauggggagggggucuuggccccucuggugugagguggcagaacugggcuugggucaucucuaucacuuaguagcuaugugaccuuguaagaugggaaccagccuacuaccuuuuuuuuuccucccuccuccuccuccucuccacuguccuacuacuguccagcucugcagcguccagcccaugguagcugcucaguaaguggccccagaugcucuuguguuucugucuuuuaggacaaggucagggagcuucagaaccagggcagagaugugggccuggagguguuggauaaugcccugcuagcucugcaaggugagagggcugggcugggguuggagccaaccuuugccuuccuggcuucauugacugcuuagcacagaggccauaccaagaagaauguguggaaggugugauauuugugugccauaauuuuaaguuuuguaucuugcccuccuccuaccuaccacaaggcuccaugggcuagggacaagggcaucuucucccacuugcagaguaagacaugcucagggcuuguucuggucccugaauaaggcuuuaguccagcuuugagggaugcugggaccuggauacuuggucacuggcucccugggcccaggccccacugcagcccagguacuacaggccggcguggcagaugaccugaggaaacugcccuucaugaccagugcugugauggagguguuuggcgugucuggcugccgcgugacccgcuguggcuacacaggagaggaugguguggaggugugucaagaaguggugugggggcaguacagggcacaggaugcaugugagggguuggggguaugugguacagggagcuucccaucugcccucugguguuucauacagaucucggugccgguagcgggggcaguucaccuggcaacagcuauucugaaaaacccagaggugaagcuggcagggcuggcagccagggacagccugcgccuggaggcaggccucugccuguaugggaaugacauugaugaacacacuacaccuguggagggcagccucaguuggacacugggugagcugggccagcacuaaaggauaggguccuggaggucagggugacccuugauaagacuagccagcccaugacucauccaaagguuauguagccugaagccuuccugagccucccuucccugaaggugccacugugccuuugcccauuagaaacugcagauguuggccggaugcgguggcucacaucuguaaucccagcacuuugggaggccgaggcggguggaucacgaggucaggagaucaagaccauccuggcuaacauggugaaaccccgucucuacuaaaaauacaaaaaaaaaauuagcugggcauuguggcgggcgccuguagucccagcuacucgggaggcugaggcaggagaauggcaugaaccugggcggcggaguuugcagugagccgagauugcgccacugcaccuccagccagggcgauagagcgagaccccgucucaaaaaaaaaaaaaaaaaaaaaaaagaaacugaagaugcugccgggcaugguggcucacaccuguaaucccagcacuuugggaggccaagguggguggaucaugaggucaggaauucgagaauagccuggccaacauggugagaccccgucucuacugaaaauauaaaaauuagccaggcgugguggcgggugccuguuaucccagcuacucgggagacugaggcagguaaauugcuugaaccugggaggcagaguuugcagugagcugagaucgugccacugcauucuaggccugggcgacagagugacuccaucucaaaaaaaaaaaaaagaaacugaagacgcucggcaggugggcagcauggccuccaggggauaggaggugguugguuggcugacggcagugaagggaggaauagagccuggaguagcccaagcaaaggggccuugaugcuagauaguguguuacuugaggaccucauaaggaccuccuguggccagggcuucuaugggcuguggcuuaugucucaugugucauucuccagggaagcgccgccgagcugcuauggacuucccuggagccaaggucauuguuccccagcugaagggcagggugcagcggaggcgugugggguugaugugugagggggcccccaugcgggcacacagucccauccugaacauggaggguaccaagauugguagguggaccagggaagcugggaaacccuugucucuucccaggagggugggggcacuggcaggguggugcugaugcguggcuuaugcuugcuugacagguacugugacuaguggcugccccucccccucucugaagaagaauguggcgauggguuaugugcccugcgaguacagucguccagggacaaugcugcugguagaggugcggcggaagcagcagauggcuguagucagcaagaugcccuuugugcccacaaacuacuauacccucaagugaagcuggcucaggguggggcugucccuuccaggaguuuugccccuacaagggguuagucaagaagcugaggcagaacucacugggggugggc

SEQ ID NO: 16131 - RNA, 1553 nt, Homo sapiens
caguucugcugacacccggcacuuuauuaguggggaaacucgccuuggucuggcagagacugggaucaacaggaccagcacccaucucgaggugguauuuucuguaagaucagguguuccucccucguagguuuagaggaaacacccucauagaugaaaacccccccgagacagcagcacugcaacugccaagcagccgggguaggaggggcgcccuaggcacagcugggcccuugagacagcagggcuucgaugucaggcucgaugucaauggucuggaagcggcggcuguaccugcguaggggcacaccgucagggcccaccaggaacuucucaaaguuccaggcaacaucguugcgacacaccggagaccaggugaugagcuuggggucggucauaagcgcgguggcgucgucgcugggagcuggcagggccucccgcaggaaggcgaagagagggugcgcccccgcaccguucaccucgcacuucucgaagagcaugaaguugggcucgaacccaccaccaggccggacguacuugagggaauucagaaucucuucguucuuggcguucuccuacaggagagaagggcagcuagaacccggggucaagaggaggagagaaacguucuaaccacaaacaagggagauuuucuaugagucaccgggauuuugcccuccaugcgcaaucccaagggcggagaggaauuucagcagcuacgagcaacagaaaggaaacgagagaguagccagacucuccgcgcauggagccgacggcacccaccagcacaccgccggcgcccccagccacuacugcacguccgcccccgccccgccccgcuccgcccggcgcaccugaugcccaaacugguugcacgggaagccgagcaccaccaggccccgggguccgaggcgccgcugcagcucguucaucuggguguagucccggaccguggugccucagagggacgccacauucucgauaaguaguaccuugccccgcagggagcccaggcucacaggcuccccgccggccagcgggcgcgccgagaaggcauacaccgacugggccgccgccgccgccgccgcuagccgagcagcacacauggcgcaauuguccaagaagccagcggagcgccccgaacaagcacuguaaggggaggccagcaggcgccuccuuuuaacuggccggcggcgggucacguggcacaggcaguuuuccgggccugagggucccgccucauccggcccccgcccuacccggagggcucggccccuccucagccaggaaaaggcuggagagugcgcccgagcgggacgcgugcuccuccuaagccggaaggagcagcaggcaugucuggucuggcccaggcaaccaggcggcagcgguccagguuacccuuccaagggcuggggcccucgagggcuccguuuuuucucagagguuccugaguuaggaugugggguuuggcauaggaggcuggugggcgacggcagcagcugcaggagcugcccgugcacaaacagcccuccucuccugugccauguuaccgg

SEQ ID NO: 16132 - RNA, 969 nt, Homo sapiens
uggcuucuuuuccgacaaaacaccaaauggcggaugacgccggugcagcgggggggcccggaggcccugguggcccugagauggggaaccgcgguggcuuccgcggagguuucggcaguggcauccggggccagggucgcggccguggacggggccggggccaaggccgcggagcucgcggaggcaaggccgaggauaaggaguggaugcccgucaccaaguugggccgcuuggucaaggacaugaagaucaagucccuggaggagaucuaucucuucucccugcccaauuaaggaaucagagaucauugauuucuuccugggggccucucucaaggaugagguuuugaagauuaugccagugcagaagcagacccgugccggccagcgcaccagguucaaggcauuuguugcuaucggggacuacaacggccacgucggucuggguguuaagugcuccaaggagguggccaccgccauccguggggccaucauccuggccaagcucuccaucguccccgugcgcagaggcuacugggggaacaagaucggcaagccccacacugucccuugcaaggugacaggcugcugcggcucugugcugguacgccucaucccugcacccaggggcacuggcaucgucuccgcaccugugccuaagaagcugcucaugauggcugguaucgaugacugcuacaccucagcccggggcugcacugccacccugggcaacuucaccaaggccaccuuugaugccauuucuaagaccuacagcuaccuaacccccgaccucuggaaggagacuguauuuaccaagucucccuaucaggaauucacugaccaccucgucaagacccacaccagagucuccgugcagcggacucaggcuccagcuguggcuacaacauaggguuuuuauacaagaaaaauaaagugaauuaagcgugaaaacaaaacaaaaaaaagaaac

SEQ ID NO: 16133 - RNA, 12075 nt, Homo sapiens
cugucucugguuccuggggcgaaggcaguuuccggagggaagggguaggguuggggugggggcgcucuccgcccgguguugcgcuccuucccagaauccgcuccggccuuuccuuccugccgcgauucccaacuuugcucaaagucgcuggacucuaagcugucggagggaccgcuggacagaccugggaacugacagagggccuggagggaaacaggccaaagacccacaggcagaguugacacggaaccccaaagcaaggaggagggcucgggcccgagaccguucaccuccccuuaucccuguuccccucuucaggauggagcugaccucaagggaaagagggaggggacagccucugcccugggaacuucgacugggccuacugcuaagcggugagagggccuggugggggcuggggguuguggaaugugaugguagguccugguaguugcccuuggggcacaugagguggagccacuggauaggaacucagcggaacugacugagcuacuguccccagugcuggcugccacacuggcacaggccccugccccggaugugccuggcuguuccaggggaagcugcuaccccgccacgggcgaccugcuggugggccgagcugacagacugacugccucauccacuuguggccugaauggcccccagcccuacugcaucgucagucaccugcagguguggcuggggacagggugugacgccgagucaggguggggcuggcacugccugaggcacugauucuaauccccauccaacccaggacgaaaagaagugcuuccuuugugacucccggcgccccuucucugcuagagacaacccacacagccaucgcauccagaauguagucaccagcuuugcaccacagcggcgggcagccugguggcagucagagaauggugaggccauggguggggcaaaagugagcagggcugcccaccaguagcuuugaguccuugacuuccgauuccugucccagguaucccugcggucaccauccagcuggaccuggaggcugaguuucauuucacacaccucauuaugaccuucaaggugccugcauaucugggagccugcccgaaucacccugcuuggcucuccauugccccuggacagagccucagcuccuuaacacagccuccuugagcauggaugcaggaggcuccuucaucccuucacaccuuccauuugccuccaggccuuugcacaugcucuucugccuuuccaaucccaggcugggucaggcgcugucucccugagccccaugaacccugagucuccccauuagagguggcuaccuuugcuggucauuaucuggcuuccaccagucacccccacucucugugagcuauuugagggcagucuugggcugagcagggcucuugauggcucuggguugggcuuggguccuggugccugcugaucagcuaugccccccuacccagacauuucgcccugcugccaugcugguggaacgcucagcagacuuuggccgcaccuggcauguguaccgauauuucuccuaugacuguggggcugacuucccaggagucccacuagcacccccacggcacugggaugauguagucugugagucccgcuacucagagauugagccauccacugaaggcgaggugagggcuggcaucugggcugggggcuggaagcuggggaugaugggccugaggcaagguccagugugacuaugaacucccugcuucuccaggucaucuaucgugugcuggacccugccaucccuaucccagaccccuacagcucacggauucagagugagugcuccacccuuugagucuggcacaguccguguccggcuagggacuauuuggggccucaguaacuauuuugggugcuuccuagggcaggugccaagcccaguuuagcucggguggcaguguauaggaggucuuucaaggugaccuuggcagcugagccccuggguggacauggggcagcaagggccugccuggucaguuggccccccuucccccgccucagaccuguugaagaucaccaaccuacgggugaaccugacucgucuacacacguugggagacaaccuacucgacccacggagggagauccgagagaaguacuacuaugcccucuaugagcugguuguacguggcaacugcuucugcuacggacacgccucagagugugcacccgccccaggggcaccagcccaugcugagggcaugguaaggggcuucagacgguugggauagggcuaggggcaggggcggacauggcugagcagugcugacaaccuaccugccaaccucuauaggugcacggagcuugcaucugcaaacacaacacacguggccucaacugcgagcagugucaggauuucuaucgugaccugcccuggcguccggcugaggacggccauagucaugccuguaggagugagugagaucuuggccuccauagcuccagcacucugcagccuggcugugcccuggguagaaccuagagcuaguuggucaagccccuaaaacccaggcuguauccaaagaguaugcagaccuugaugccccuugggacccccucaauccuccucugcagucugcucuggguagggaaccaguaugaugcugaggccuugaagucccugagccccuacccacaaauucuggccugugauagggaucuaagguggccuacuucuuacccuugugaccugguuccucauguggccuuugcccugcccuuccuccccugccagagugugagugccaugggcacacccacagcugccacuucgacauggccguauaccuggcaucuggcaaugugaguggaggugugugugauggaugucagcauaacacagcugggcgccacugugagcucugucggcccuucuucuaccgugacccaaccaaggaccugcgggauccggcugugugccgcugugaggcugggauugggcacggggagagaaagcugagccuggggcaggaacuagagagcuggacugcugucuaaauugcaggaaauugggguuaggggcuugggauagaacuugaccagggauccagggugggaucccuuaggcuuaggagaggacuggcagugagcuaguugagauagggugagugacccuguaucucuuuuugccgucagccugugauugugaccccauggguucucaagacgguggucgcugugauucccaugaugacccugcacugggacuggucuccggccagugucgcugcaaagaacauguggugggcacucgcugccagcaaugccgugauggcuucuuugggcucagcaucagugaccgucugggcugccggcguaugugucuccugcccuaacuucuaugcugaccuuuaaccccuguccucuuacuccugacucagcugaacaugagcacugccacaguuucccaaagugcugaugguucuccuucccugcaggaugucaauguaaugcacggggcacagugccugggagcacuccuugugaccccaacaguggauccuguuacugcaaacgucuagugacuggacguggaugugaccgcugccuggugcgacuggaaggggcuggaguucuaggggcaugauuuguccuuagagcacagggcuggggugucacaucuaugccagugggugggugcugagagcuuaggauccaguccuggcugagaagccucaggucugggaggccaaggaugugggccaguggucuggggggcauguuuucacugaggggugauugaggcuaagacgugugguugggauuuccugcuggguggugauggggucuggaggucuguuucuggcccccagcaacuccuuucgugcagccuggccacuggggccugagccacgaccugcucggcugccgccccugugacugcgacguggguggugcuuuggauccccaguaaguguuguaaagggggccugggaagggauggggaaagauccugagcagaagagaagguucuucuugaguaaccacagaguucccuccaggugugaugagggcacaggucaaugccacugccgccagcacaugguugggcgacgcugugagcaggugcaaccuggcuacuuccggcccuuccuggaccaccuaauuugggaggcugaggacacccgagggcagguguggggccucccccuaagcagagggcuggauguggguggacacgucuaugacuggagaggugggguuaugggcaguaccuuguugaggggauaggggugauaucuagcuuuggcaggagaaaugggguuuggggcuggcuguggcagaagaggcaaagccucaccugagccuccaucccuggcugcauuaucucccaggugcucgaugugguggagcgccuggugacccccggggaaacuccauccuggacuggcucaggcuucgugcggcuacaggaaggucagacccuggaguuccugguggccucugugccgaaggcuauggacuaugaccugcugcugcgcuuagagccccagguuagacccuguuaucuaaucuggggcugaaccucugggugugggagcaucuccuccaucaucccguuuucccaggucccugagcaaugggcagaguuggaacugauugugcagcguccagggccugugccugcccacagccugugugggcauuuggugcccaaggaugaucgcauccaagggacucugcaaccacaugccaggugagggcacuggugguagcacucacaauggcaggggguuguggggccagcccuaagcucccugcagggcaccuggaagaccccacagcucauucaucuguuccuucuuucaaauaccuccagaaugcugguugccaggcccuguugggcauggcucuguucacagaaaggaaguagacagaucaaggccugcucucucaggggucuaaggcccagaggccaaggcaggaauuaaugggaaaucaccuggugucacuaucaggaggguccacagugguggugguagagggugguaguggugggguuguggcaucagagcacucugagcagggaugugccuggucugauuaauguuuuauuacauuuuggguaguauuuguuucauguuucauguuucuuuuuuuuuucuuuucuuuucuuuuuuuuuuuuuuuuuuuuugagacggagucucgcucugucaccaggcuggagugcaguggugcgaucucggcucacuguaaucuccaccucccggguucaagcaauucucaugugucagcaucccgaguagcugggacuacaggugcacgccaccacgcccagcuaguuuuuuguauuuuuaguagagaugggguuucaccauguuggccaggauggccucgaucuucugaccuugugaucugcccgccuuggccucccaaaguguugggauuacaggugugagccaccgugcccagcccuguuucauuguuucauguuuuguuuguuuguuuguuuguuuuugagauggagucuugcucugucgcccaggcuggagugcacuggcgcgaucucggcucacugcaagcuccaccucccagguucacgccauucuccugccucagccucccaaguagcugggaccacaggcacccgccaccaugccuugcuaauuuuuuguauuuuuaguagagacgggguuucaccauguuagccaggauggucucgaucuccugaccuugugauccaccuuucucggccucccaaagugcugggauuacaggcgugaaccacugcacuugaccuauugcuuuuaguuuuugaccauguaaauauucaaacagaaggaaagagaauaacauauugaaccuggcugugcccauuauagacauuuugccaacugugacuuguguuuagaaaaaaaauuccucuagaccaggcaugguggcucaugccuguaaucccagcacuuugggacacugaggcaggaggaucacuugagcccaggaauucaagaccagccuaggcaacauggcgagacccugucucuacaaaaaauaaaauaauuagcuaagcaugguggugugugcuugugguuccagcugcuugggaggcugaggugggaggauaucuugaacccaggaggucaaggcugcagugagccaaggucacgcacuguacuccauccauccugggcaacagagaccgcaucucaaauaaacaaauaaauaaauaaaucagaaaauaaaaagaaaaaagaugagggauugaagaacaauuuuugggaugggauaaaagaacccaaguaugaguuugcagcacaaugggaaaggaaagccuuggagacaaagagagagggggcgacauaguguugaugaagaggagcagccauuguagguuguaggucggggucagaggaagcgugaggugguuguugaggagaauuggcaaguucuugggauuuccaggcuuuaugaguauuuccagugagucugcacagguggauguaugauucuagagggccaccuuuaugagacuauucugugcagauucuuuguugggcugcccagcuguuuguuggccuagcgcagcccaacgcaacccagccauagucucugcuuuggccaauggccugguugcugggagaaggaugggggaggcccagaugauuuguacagggccccuagaugacccacugcaccuguccccacucgcccccagguacuugauauuuccuaauccugucugccuugagccugguaucuccuacaagcugcaucugaagcugguacggacagggggaagugcccagccugagacucccuacucuggaccuggccugcucauugacucggugaauaaucuccucuugcccacaccaaccaagauggcagggcccguggugugggacuugagggauagcaggggucuguggcagaagaggcaggcccaugguggugccagggugggcaggcuuguggcagugcuaaggcaagugcucuggcaaugccuacguggucccaggucugaacugcgaucuuccuugcucacuccuucagcuggugcugcugccccguguccuggugcuagagauguuuagugggggugaugcugcugcccuggagcgccaggccaccuuugaacgcuaccaaugccaugaggagggucuggugcccagcaagacuucucccucugaggccugcgcaccccuccucaucagccuguccacccucaucuacaauggugcccugcgugagugucugugauguggguugauggggcagagguggggacccagccugacuuggcccaacccuccuccccacagcaugucagugcaacccucaagguucacugaguucugagugcaacccucaugguggucagugccugugcaagccuggagugguugggcgccgcugugaccucugugccccuggcuacuauggcuuuggccccacaggcugucaagguacucuucugccccuuguucccuccuaugcuucucucuccuucccauuacuguucucucuccuccuucuggaccugcugcugguuuccucaaacuaagucuuggacccucuacucucaaccugggucaguuguaguucucuuccauuuccugaccuucccaccuagacucccacuacucacacuccccugagacccucccccacccacacuccccucagacccccuccccuggcucuggcucagcucugccuugcuccuagccugccagugcagccacgagggggcacucagcagucucugugaaaagaccagugggcaaugucucugucgaacuggugccuuugggcuucgcugugaccgcugccagcguggccaguggggauucccuagcugccggccaugugucugcaaugggcaugcagaugagugcaacacccacacaggcgcuugccugggcugccgugaucacacagggggugagcacugugaaaggugagacuggagcagcuaugaguggguugguuggugggcaggcuucccagggaugacacauuucuucuuccuccucccugcaggugcauugcugguuuccacggggacccacggcugccauaugggggccagugccggcccugucccuguccugaaggcccugggagccaacggcacuuugcuacuucuugccaccaggaugaauauucccagcagauugugugccacugccgggcaggcuauacgggugaguggaugggggcaggcgugggaucagggugaguuggcugggcugagcacucacagcuuccucuuaaccgugggcagggcugcgaugugaagcuugugccccugggcacuuuggggacccaucaaggccagguggccggugccaacugugugagugcagugggaacauugacccaauggauccugaugccugugacccccacacggggcaaugccugcgcuguuuacaccacacagaggguccacacugugcccacugcaagccuggcuuccaugggcaggcugcccgacagagcugucaccgugaguaugagugugggagggcauggcugaauugggguucugcuucuuggccuccucuugacuacugugcucaucuugguuggcacaggcugcacaugcaaccugcugggcacaaauccgcagcagugcccaucuccugaccagugccacugugauccaagcagugggcagugcccaugccuccccaauguccagggcccuagcugugaccgcugugcccccaacuucuggaaccucaccaguggccaugguugccagccuugugccugccacccaagccgggccagaggccccaccugcaacgagguaugggacccuccugcagaucccugguuagauggggccaggugucugucuuaucuccagggcuuagccucuuauagaggcucugacccugccuuguucccaccccaguucacagggcagugccacugccgugccggcuuuggagggcggacuuguucugagugccaagagcuccacuggggagacccuggguugcagugccauggugagggagccagcggggccaggguagauggaggacuucccagaaugccccacagugacccuaacucugugcucugcucuuucuugcagccugugauugugacucucguggaauagauacaccucagugucaccgcuucacaggucacugcagcugccgcccaggggugucuggugugcgcugugaccagugugcccguggcuucucaggaaucuuuccugccugccaucccugccaugcaugcuucggggauugggaccgaguggugcaggacuuggcagcccguacacagcgccuagagcagcgggcgcaggaguugcaacagacgggugugcugggugccuuugagagcagcuucuggcacaugcaggagaagcugggcauugugcagggcaucguaggugcccgcaacaccucagccgccuccacugcacagcuuguggaggccacagaggagcugcggugcggaagggccuaagaauacauggugggauggggcagaggcccaguggaccagggcugaagccucucuaaacaccccccucuccaucauugcaggcgugaaauuggggaggccacugagcaccugacucagcucgaggcagaccugacagaugugcaagaugagaacuucaaugccaaccaugcacuaaguggucuggagcgagauaggcuugcacuuaaucucacacugcggcagcucgaccagcaucuugacuugcucaaacauucaaacuuccugggugaguuguuagccaacuaggcagguggaccagggucagucuucagcugacugucugccucugcccaauuuaggugccuaugacagcauccggcaugcccauagccagucugcagaggcagaacgucgugccaauaccucagcccuggcaguaccuagcccugugagcaacucggcaagugcucggcaucggacagaggcacugauggaugcucagaaggaggacuucaacagcaaacacauggccaaccagcgggcacuuggcaagcucucugcccauacccacacccugagccugacagacauaaaugagcuggugagguugaaguguuggguggggcagguggguguagauguuccucucacagggcccugacuuguucugugccuggcagguguguggggcaccaggggaugcacccugugcuacaagcccuugugggggugccggcugucgagaugaggaugggcagccgcgcugugggggccucagcugcaauggggcagcggcuacagcagaccuagcacugggccgggcccggcacacacaggcagagcugcagcgggcacuggcagaaggugguagcauccucagcagaguggcugagacucgucggcaggcaagcgaggcacagcagcgggcccaggcagcccuggacaaggcuaaugcuuccaggggacagguggaacaggccaaccaggaacuucaagaacuuauccagagugugaaggacuuccucaaccgugagccucccacgugucccaggccaugugguuguccccuuuggcaacucccggugucuguaucucccuugguucauacuugagccucagggacuacacuggauuaguguuuaugaucccuugacuggcuccugaguuauugcccauauguggucccagguccauguucuugagucugagccccuuguauagucccuguccuugugauuauauccuuaugccugguaacaaaccccuaucccauguacauguccugaguccauaccccaaaacuguauccucaugcccaugcuggagaaucuauguucuuaaguucuugcugugucccuauagaggagggggcugauccugauagcauugaaaugguggccacacgggugcuagagcucuccaucccagcuucagcugagcagauccagcaccuggcgggugcgauugcagagcgaguccggagccuggcagauguggaugcgauccuggcacguacuguaggagaugugcgucgugccgagcagcuacugcaggaugcacggcgggcaaggucugaccccaucccuggccccuaucccugacaccugguuuugauaccuccagguucugauucccccuucuccccaggagcugggcugaggaugagaaacagaaggcagagacaguacaggcagcacuggaggaggcccagcgggcacaggguauugcccagggugccauccggggggcaguggcugacacacgggacacagagcagacccuguaccaggugaggucuuccuaggacaucagugggacaagguuaugggcaugaaccguagaucuguguaaccuuuggcucacccauggcagguacaggagaggauggcaggugcagagcgggcacugagcucugcaggugaaagggcucggcaguuggaugcucuccuggaggcucugaaauugaaacgggcaggaaauagucuggcagccucuacagcagaagaaacggcaggcagugcccagggucgugcccaggaggcugagcagguggguugaggcagagccagcuggagaagguagggguggaagaugggccuccacugagcuaccacgcuaaccuaacccucuacaucugcagcugcuacgcgguccucugggugaucaguaccagacggugaaggcccuagcugagcgcaaggcccaaggugugcuggcugcacaggcaagggcagaacaacugcgggaugaggcucgggaccuguugcaagccgcucaggacaagcugcagcggcuacaggguaagaaauggggcaccagagacacaagacugcgggaaacccccccuaaacugacaccugcccuuccuagaauuggaaggcaccuaugaggaaaaugagcgggcacuggagaguaaggcagcccaguuggacggguuggaggccaggaugcgcagcgugcuucaagccaucaacuugcaggugcagaucuacaacaccugccagugaccccugcccaaggccuaccccaguuccuagcacugccccacaugcaugucugccuaugcacugaagagcucuuggcccggcagggcccccaauaaaccagugugaacccccacu

SEQ ID NO: 16134 - RNA, 13017 nt, Homo sapiens
cagaacccaugcaccgcuaagccacccgagcaccgccuccuuccgcucgggcccgccccggagcugcgggucgcuccgagcccauucccgccggaagugcgucaccagcuuggcgcuccgccucccucggccuuagcuagaagucgaaacaaaacaagccgcuaaggcgguggcggcggcgccgggacgggggaggggcgcgccggaaccggaaccgaccugcgccggaaccggaacggagagcggguugccagggcccgaagagggcuggcugcggcggucucgcucggugaguggagcaggcugcaacucgcuggcuuggccgcagcggggaggccgcaacgcgcggccgcggcggccuguucaaggucacgggccgugccagucccuaccccuagugccccgcagcgugccagcccacugaugccggcagggccguuacgcuaugccuguggccagccucccaccugggagaggacuggcggccagcgagggcaacuucgugggagaggugguggcgggcucgggguucagaggcugaagcugggucgcagcucgaccggggcgcugaucuguggucaguaaccccgcgcugccauuucaggccggcucgggucucuaaacagccccuuacccgccucgacgucccuggggcaugggggagggacgcgaccuucggcuggggccugggugcaagaaggaggcgccgguggcaggugucauuaaagauccagcccaccaguaccacaucugaccuguagaaggguauccugccaucccuccuuccuccuuuacacacuuaggggaacacagacuagucauuaucuguccugcuacugguucaggccaggcuugaggcugccaggaguccuggaucugugguccuccccagccucaucucaguaucuaguuucaagaccuucauuuuggaggaggaaacaguccagaauccacuggugggucugugggaaacuguagugguccuuguggcucagagcucaugagugaaggcaucugggaaggaaggugauaauuucuguuccagucucaaacuggaugcccauccugccuuaguacuggagcaggguugcugcugaagagguagcgugacaucuagauacacuuuucagucccuuucugcuugggacagcagcuggggagaggacuuucucuugaaaugaagaaggaccaagcaguacauaggagcagguucuugccaagggugggagcuggcaggaggcagguggagugccuuagccccaggacuuuuucugggcaaugguagaaccuggguugagccuguuuacagccacagagccugguucuccugcggcuugucuccuguccugccuuccuccuccaccuucuauuucuccaguggugacuaagcagccagugagagugaaggaaaagugagcacccugcucggagugccagcccugugggcuggagccguggcuccucuccagauugguggaguagccuggucccaggccaugacuuccuugaccuggugcccccucagugaggcuuucaccugugugggacuguuaugguggguaucuaugaggcuuggccagaagugguugcugcuacuugcauuauuuauuaccucuucagaauauccugagaguguccagggguacuuaagagaugagaagauacagcucuguagcauuaguguccuguguugcugagcccuggguguagcuaaagagcaaguuguugggucuuggcagugaucacuggcuucuuuccauuaggcuguccguuccuugcuggagaauuuggccacaaagaguugccaagauagcugggccaggaagaaagcgccgcagcccugacccagacgcuguugccgaccccggggcacucuggcugucgaccaagcggcucaagaugucuggcggggccagugccacaggcccaaggagagggcccccaggacuggaggacaccacuaguaagaagaagcagaaggaucgagcaaaccaggagagcaaggauggagauccuaggaaaggugggaguggcauucccagaguaauuguggccuucucugccucccaucuuauugguauacagauugggguuugggagaugacuuucuuguucuucucucuguccugguuugaugaugagagaagaaggacccaugauaaccucaguagagccucagcuuugaagccugaguacuuggcuaagauccagaagauggugcuguuggggggcuugccuucuuuccuuuuuaaacuuuuuucuuuuuuuugaaccuguucuuuuuuuccuuuuuuuuuugagauggagucucauucuguagcccaggcuggagugcaguggugcaauauuggcucacugcaacguccaccuccugguucaggugauuguccugccucagccucccaaguagcugggauuacaggugcaugccaccacgcaaggcuaauuuuuuuuuuuuuuuugagacaaugucucacucugucauccaggcuagaguguaguggcgucuuggcucacugcgggcucugccucccggguucaagugauucugcugccucagccucccaaguagccucagccucccaaguagcugggauuacagguaugcaccaccacacucagcuaauuuuuguauuuuuaguagagacgggguuucaccauguuggccagacuggucacaaacuccugaccucaggugauccacccaccucggccucucaaagugcugggauugcaggcgugaaccaccgugccugucccuuuuuuuuuuuuuuuuuuaaaggcagggucucacucuugcacagauuggagugcagugcaggugugaucguagcuuacugcauccucaaaguccugggcucaagcaguccuccuaccucagccuccucaccaugcuugacuaauuuuucuuauuuuuuuuuuagagacagggucucgauauguugcccaggcuggucuugaaccucuggccucaggugauccuucugccucagccucccaugcagcugggaucacaggcucacgccaccguacccggcuguucuuuccuucaucgucagggucagcauccacuccucaagaggagcagaccaaagagggucaguaacgaaugggcuuuuuguugcuagggaaggggagggggcacuugcaauuuggcucccaucugaagcaguuucauuaggcugggucucuguuaccugcuuaucaccaucaggagcuugugaagacccucaugaucucuuggcuacucccacuccagaguuguugcucgauuggaggcagagugcagaagaggugauugucaagcuucgugugggaguagguccccugcagcuggaggauguagaugcugcuuucacagauacagacuguguggugcgguuugcagguguguccaucugcccugagcacaguaguauguuugaaucuucugauaucuccuauccuaccucauggacccugcucuguccccagguggucagcagugggguggugucuucuaugcugagauaaaaagcucuugugcuaaagugcaaacccgcaagggcagucuccugcaccugacacugcccaaaaaggugccuaugcucacguggcccucccuccuggugaguucuaguaguacaggguuggguagggauaccaguguagucgacagggccugacugcuguaucuuuggcagaagaaaccucuagggacccaggagcuggugccggggcugcggugccaggagaaugggcaggaacugucucccauugcccuggagccaggcccugagccccaccgggcuaagcaggaggcccggaaccagaagcgggcccagggccguggugagguaggcgcaggggcuggccccggggcccaggcagggcccagcgccaagagggcugugcaucucugcagagggccagagggggacggguccagggaugacccuggaccccggggugaugccccacccuucguggcugacccagccacccaggugagagcugggcaccuguuuggguguuaggagauggggggaaagggugugcacuggagugggagccaccuggcagacccagggcugauucuuuccacaaucuugccauuaauagguugaggcugaugaacagcuuugcauaccaccgcugaacucccaaaccugccuccugggcucagaggagaauuuagccccuuuggcaggagagaaagcagugccucccgggaaugacccagucucuccagccaugguccggagcagaaacccugggaaagaugacugugccaaggaggagauggcaguggcagcagaugcugcaaccuugguggaugguaaaggugggggugggcaggcagagcccuagguuggguugcaaaguuuguagguggauagagaguagcaauaggcuggaaccuguccugguuggggcugagccauggucucaauauagagcccgagucgauggugaaccuggcguuugucaagaaugacucguaugagaagggcccggauucagugguggugcacguguacgugaaggagaucugcagggacaccucaagaguacuuuuccgugagcaggacuucacgcucaucuuccagaccagguggguggguagaugauggggcaaacaaugccucaggugggacaguaugucucaugcucuuccucuuguccuuccuccuauccugcugugccucugcagggauggaaacuuccugaggcugcacccgggcugugggccccacaccaccuuccguuggcaggugaagcucagguggguggugcccggccccaccacugugccuguccuaccccgugggcuccaucucccuggcucaucuauccugaugcucauuccuccuaagucccugaguucagccuuuucccacaggaaucugauugagccagagcagugcaccuucuguuucacggcuucucgcaucgacaucugccuucguaagaggcagagucagcgcugggggggccuggaggccccggcugcacgaggucugcacacgagcucccuucauugcccaguuccacgugaccaggacccaaaccccugucacaugcugcuaaccaccagcccucucauucccccuuuuuaaggugcaguggguggugcaaagguugccgugccgacagguccaaccccucuggauucaaccccaccaggaggugcuccccacccccugacaggccaggaggaggcccgggcuguggagaaggauaaauccaaggcacgaucugaggacacagggcuagacaguguggcaacccgcacacccauggagcauguaaccccaaagccagagacacaccuggccucggugagaauucuggggugggaaggacgaagaauggaggcuggagagucuuggggcuguucucucaugucgucuuugcuccugcagcccaagccuacaugcauggugccucccaugccccacagcccaguuaguggagacagcguggaggaggaggaagaggaagagaagaaggugugucugccaggcuucacuggccuugucaauuuaggcaacaccugcuucaugaacagcgucauucagucucuguccaacacucgggaacuccgggacuucuuccauggugagggcagggccuggagccuggguuaugggcagagagagugccuuuguuccucacaccuuugcucggcuacuauuccuagaccgcuccuuugaggcugagaucaacuacaacaacccacuagggacuggugggcgucuggccauuggcuuugccgugcugcuucgggcgcuguggaagggcacccaccaugccuuccagccuuccaaguugaaggugaucugugaccacugucacccuuggcuggagggggcggggagggccagccagcugggugugcagugggugcuagggcuucauguucacaccuuggcuccuguauccaggccauuguggcgaguaaggccagccaguucacaggcuaugcacagcaugaugcccaggaguucauggcuuuccugcuggaugggcugcacgaggaccugaaucgcauucagaacaagcccuacacagagaccguggauucagaugggcggcccgaugaggucaggguuagggacagagggugggcaugucucaugagcaucccagccccugguacucuuugguucucaccacucugccucucaggugguagcugaggaagcauggcagcggcacaagaugaggaaugacucuuucaucguggaccuauuucaggggcaguacaagucgaagcuggugugcccugugugugccaaggugugaugggcuccccuggaaagagacccccuaguucagcucagcuauucuggucacauuagguucagaggcaugugcaucuuaaggugcuacagggcaagguuugggcaaagaagcuggcagggaggccuuaggauucuauuugggcugaagagcccacucaggguaggcuuccugacugagggaaaagugauguuagagcucaaagguguuguagcaggguugugggcacauggggugcaagugugaggccaauucguaaaguggcuaagcugaguagggcuuugagugccagaaagaaggauuguuauuuccuggugguccuccugcccugucuaguguccugaagccugagaguuugcugguuggcugugggggcccugagagccaucagaagccccggaaugggcucucugagcaugagcaucuuaucucccacucugugugcagcuacccagugccaccucuacauccacaggucuccaucacuuuugacccguuucuuuaucugccggugcccuugccacaaaagcaaaagguucucccugucuuuuauuuugcccgagagccccacagcaagcccaucaaggugaggaguaagccccuacccucugggcuguucuagagaacguggcccaccucccucacugacugcccuuuuugccacaguuccuggugagcgucagcaaggagaacuccacugcgagcgaaguauuggacucccucucucagaguguucaugugaagccugagaaccugcguuuggcggagguaucuuuguccuuccuugggcuaucacauguguggauguguguguguacucaccacagacguguguacagucauuggcaucuacagacauacacaugggcugggcacaguggcucaugccuguagucccagcacuuugugaggccgaggugggcagaucacuugagcccaggaguuugggaccagccugggcaacuuggugaaacacugucucuacaagaaauaaaauuagcugggcauggugguacguguuauagucccagcuacuugggaggcugaggcaagaggcucacuugagcccgggauguggagguugcagugagcagagauugcaccacagcacuccagccugggugacagagugagacucugucucaaaaauaaauaaauaaauagauaaaaaaauaaaaauagggccaggcgugguggcucaugccuguaaucccagcucuuugggaggccaaggcugauggaucacaaggucaggagauccagaccacccuggcuuacauggugaaaccccaccucuacuaaaaauacaggaaaaguuagccgggcgugguggcacaugucuguagucccagcugcucaggaggcugaggcaggagaaucgcuugaaccugggaggcagagguugcagugagccgagaucgcgccacugcacuccagccugggugacagagugagacucugucucaaaaauaaaauaaaauaaaauaaaaauagacauacacaugaguaugccugugacuguacaaaaacaggcgaugugcuguuauuuuuucugugcaacagaagugcccucaguuccuagccauuaucaggguuuauuccccuuuguggugguggaucccaacugcauuucccuuuuuagacaaggagcuugagcugcaggacuaucccuauguucgcucugccucucccucuauccugcugcucucuccuuuuaucccaguugugugugcuagcucuccccagggguuccuagccuuuagccugacaguguugguuuucuuagggguaagaguggggaggaggcucuuugaauguggacccuccaugauaauauguuacagucuuauaaggcuaugcuaguuauagcagggcagagucccucaguguggagagcuggugugguugauaucugccucacaccuggucuuucaggcccucugaugcaccaggcuccuuauggcauugggcacugagacaggugccagcagaggcauaagccuauuugggccuacagaccucaccacugcccacauagacccaaggcagggccaagccuucuuaaacucuggggcagggcuagggaaagggcuuauccucacgugggaucuguguguucucuguccccagguaauuaagaaucguuuucaucguguguuccuacccucccacucacuggacacuguguccccaucugauacgcuccucugcuuugagcugcuauccucagaguuggcuaaggagcggguaguggugcuagaggugcaacaggugagugggggccaaccugauggcacagcgcccugguggguggggcacuucuuccuggucuugcugagccagacgacccacccuagcgcccccaggugcccagcguccccaucuccaagugugcagccugccagcggaagcaacagucggaggaugaaaagcugaagcgcuguacccggugcuaccgugugggcuacugcaaccagugaggacccccauggucuccccuacccuuucuuuccaccuuccaugugccacccugcuccuucccuucacaccaaggcacauaugcuuaagcuuucuacuugccacccuacuuuaccaggcucugggggaggcagggcuggcguacccaguucccagggacuaugacuagcccccaguauggagucauaggagauggggcuaagggccuauccuugucuuccucuucccgucaggcucugccagaaaacccacuggccugaccacaagggccucugccgaccugagaacauuggcuaccccuuccuggucaguguaccugccucacgccucacuuaugcccgccucgcucaguugcuagagggcuaugcccgguaagugcccagugguuggacuagagugguguaggugggggcagaggugcuagaugggcuggucaggagucuuacuugcguuguucucuguugccagguacucugugaguguauuccagccacccuuucagccaggccgcauggccuuggagucucagagcccuggcugcaccacacugcucuccacagguucccuggaggcuggggacagcgagagagaccccauucagccaccugagcuccagcuggugaccccuauggcugagggggacacagggcuuccccgggugugggcagccccugaccgggguccugugcccagcaccaguggaauuucuucugagaugcuggccagugggcccauugagguuggcuccuugccagcuggcgagagggugucccgacccgaagguaagauccagugaaaggcucuagaagcuggggaggaggauaagggaggauggagggggcuguuguuuagggccuggugggccuggugaggcccugaugggcagggaagcuuugauuaucauguucucacacagcugcugugccuggguaccagcauccaagugaagcuaugaaugcccacacaccccaguucuucaucuauaaaauugauucauccaaccgagagcagcggcuagaggacaaaggugucugaggcugugggugggagccaugggguggguugagcuggcuguucuccacagcugcaugaccucucucccugcgaaucuccaggagacaccccacuggagcugggugacgacuguagccuggcucucgucuggcggaacaaugagcgcuugcaggaguuuguguugguagccuccaaggagcuggaaugugcugaggauccaggcucugccggugaggcugcccgggccggccacuucacccuggaccagugccucaaccucuucacacggccugaggugcuggcacccgaggaggccuggugagaacagagcagcaaguagauaagggggcaggauggagaagagagagacuugcugguccugacccaaucucuguccccaccagguacugcccacagugcaaacagcaccgugaggccuccaagcagcuguugcuauggcgccugccaaauguucucaucgugcagcucaagcgcuucuccuuucguaguuuuaucuggcgugacaagaucaaugacuugguggaguucccuguuagguaagcaguggaccuugguaacuguggguggggugugaggaccaggaugggcauccugagcgccuguugccugucucaccccucccugacuggaccugaccugcaggaaccuggaccugagcaaguucugcauuggucagaaagaggagcagcugcccagcuacgaucuauaugcugucaucaaccacuauggaggcaugauugguggccacuacacugccugugcacgccugcccaaugaucguagcagucagcgcagugacgugggugagggcacacacagccagcaggauaggugguaggggugguggugcagacuuuguucacacucuucccacccugcuguaggcuggcgcuuguuugaugacagcacagugacaacgguagacgagagccagguugugacgcguuaugccuauguacucuucuaccgccggcggaacucuccuguggagaggccccccagggcaggucacucugagcaccacccagaccuaggcccugcagcugaggcugcugccagccaggugaggcaugugggaggcuuuacagaauacugggggacaguucacagacuggggccggguugggggauauagcuuccucuccuccagccacaggcccauugagccuugggauucaugagaauugcagaguucucuuaacaucaaagcuuuagccagaggcauccccaugccuuggggacacuaacaaacauacaaguacacuaacaugcugccacuggcaagcacauuggcaccuacuuggcacaggucaggcaacugcucugaaccucacugggcacuaugcugugaaugaacuauaccugacacucuccuagauuuccucugcacauuccccacaugcuggcccacacacccucacuugugaugucccugaguucuagugugcacucaagacaaggccuauuugggcuggccauggccucugguggcuguuauacucuuugagguaagcaucugucuuugcugagccuucaggaucuucucuuuagugacauggugugccauaggcccaguuagugggcguaggcacaucucuuuucuggacuggccgucuccuuucuggcuccauccucucuugagccuucucugucaagcuuagagaaauccuugcagaagacuggucaggaucuggguaugggugggaaggagcaaggagauugcucugggauuggcaguccuguucucuaugaaucgguguccuuuggggaggccuggacugaaauacuaaccagauaacuccccucccaccuccaugcggagcugcauguggauugagagcuguuuaggguaggccaaaaugcugucaagauucucuuacccuugugcucuuacucuggacagcccugagguuggcugccugccuuccuccuugcuguuugaucuagaaugcaggguguuagccccagucaccccaggugggacugucauggcuaagggucucagggacacuggguccuccccacccccggggugcugauggccguuuccacauacccuaggcuucccggauuuggcaggagcuggaggcugaggaggagccggugccugaggggucugggccccugggucccugggggccccaagacugggugggcccccuaccacguggcccuaccacaccagaugagggcugccuccgguacuuuguccugggcaccguggcggcuuugguggcccucgugcucaacguguucuauccucugguaucccagagucgcuggagaugagcucgccugcaggcagcugcugugagcuggccuaccugccugccccaggccaugccugccuuuguuguggggaacaccucugggcuuugggccucagcuuaugcaucuggugggagaggguggggagguuguggccccugcaggggcagaguauccuaggguguguauccaucuggcugucuguccauucauccugcugcucugacccuuggccucaggcuuggcccugcccaagcuacuuccuguacuuaaaaguguuaauaaaaccagacuauucaggcccaaucucgucucucugucucaacgccgcugcugucugcgccugccuugggacccucccuugggugccagggcuccaagccagcacccccgggaugccaggcggcaugcugggcagcccccaaccccuguccucguauucuguugcagggacuaggcccuggccaggcccccgagguggcccccacgcggacagccccugaacgcuucgcccccccuguggaucggccagcccccaccuacagcaacauggaggagguggauuagcaggucccuggcugaugggggggacuggguuugggacacccacacagagggccagcuccuugccgcuucuccuucucuaacccagaggacacuggcucugucaaugggaagcugagggguaugauuuggguguggagaccucucagguugggacuucuugucagcuuggaccccugaccagugggcuuuggcuucuccagccgccuccagugcugcgugauuugauucuguuguaccuucaauucuucugacccgcauuauaaacauuauaauuuuauucuaaaaauuguaauuuuuuuugcauuuuggaagugacugcugcuguuuaaauauauuuuaaaaauaaauaauaaguaaguagacuuagugacugugauccaccac

SEQ ID NO: 16135 - RNA, 9219 nt, Homo sapiens
cucgcauuugcccccgaggacaauuacuauauugagauggaguuaccagggcugaaguagaaaagucagagcaaaaccacgccugugucuuccuccugccucagggacgaacaccuuccuuccagguccguggcaaauaucuccaaaagcccugccgccugccaacaccccuucaaguucccaguuccacggaggcggaagcaaagcccccggaaaggccgguuuguccgcccuguguuguuuaaaggggauagacgaccuuggagcgccccgcccccucccgccaaggaaggaccccauuggcucuccccggaggcuucacucucauuggucagcgagugaaugccgaccugcagacuggggccuaaguuucuuuuaguuuccggugucucugcaauggcggcucuagacucccugucgcucuucacuagccucggccugagcgagcagaaggcccgcgagacgcucaagaacucggcucugagcgcgcagcugcgcgaggccgcuacucaggugcgagccccucugcccccggccugguuugcagaccaugcugcaacgcagcgcggggcgggguccagaucccgaccugccccguuugucccgcccuuuccucucacugagcgcggggcuucucucuugaccccucugaccucaggcucagcagacccuggguuccaccauugacaaagcuaccgggauccuguuauauggcuuggccucccgacucagggauacccggcgucucuccuuccuuguaagcuacauagccaguaagaagauccacacugagccccagcuaagcggugagaccccuaccuguccugccaguucgcaccaaugccucccuucagccaagaccccugucuucccuuuuugccaaguccuccaguuucuuucuagacaccuaguucugcacaggcacugaggcauggaagggguggccuauggugagacugacacgggaacugucagggucugaggggggauccacucucgacacgugcuucuuucuucccuguguucucuagggugguggugccagggcuuaacuuuucaggaggccagacuauccuuggaguuucaugagauuaggacccugucuguccacuucuuggagcagagaugccacaaacucacgggcucuuucuucucagcugcccuugaguaugugcggagucaccccuuggaccccaucgacacuguggacuucgagcgggaauguggcgugggugucauugugaccccagagcagauugaggaggcugugagucuuuccccaggcaucgucugccuccccaguccuggccauggaaaggaguggcucaguuucccuccucaggaagacccagagugaggguguggguucccagaauaucucuaaagguggcuuuccugaaccacaugguuuggcuuucugcagguggaggcugcuauuaacaggcaccggccccagcuccugguggaacguuaccauuucaacauggggcugcugaugggugagcagggccuggaacggggcuauauuguucucucuggucaugccuuuucuucugggcacgagugagaaggaggugggggaaggaacaggagugacuuaaaguggucuggcugggcucaggcucugguucugguggucagccaggaccuuuccuugggaaagagguggggggaguacucuuuuuugccuuucugcagcuccuugugccuaugcuucuaggagaggcucgggcugugcugaagugggcagauggcaaaaugaucaagaaugaaguggacaugcaggugagcgugcuucacuaagcugaagcuggcaaagacucuggcaugaacagagccuggaauccacuaagggauaaaaggcaggaagagggcugggcaugguggcucacgcuucugaucccagcacuuugggaggcugaggcaggaggauuacuugagcccaggaguucaagaccagccugagcaacauauugagaacuccucucuacagaaaauuuaaaaauuagccagacauggugguguauaccuguagucccagcaauuuguggggcuguggugggaagauugcuugaaucuaagagaucaaggcugcaguaagcucugauugcaccacugcacuccauccuggaguacagaaugagacccugucucaaaaucaacaacaauaaaaaaaggugggagggggcugggcaugguggcucacaccuguaaucccaacacuauugggaggcugaggugggcagaucaccugaggucaggaguuugagaacagccuggccaacauggugaaaccccaucucuacaaaaaguacaaaaauuagcugggugugguggcgggcacaugcagucccagguacucagaagggcugagguaggaaaaucgcuugaauccaggaggcggagguugcagugagcggagacugugccauugcauuccagccugggcaacaugagcaagacuccagucugggcaacaagagcaagagcauuuuaagcuagcagacccacaugagaagagaugggaugggcuagguagguuuuuucagucagugcugguagauaggccaggaagccuuggguugguggguaggaucagucaggggcuccuugaaagaggauacuccugccucugccugauucuggucucugcucagguccuccaccuucugggccccaaguuggaggcugaucuggagaagaaguucaagguagggaugggcauggcccugagucccugagggugaggugagguauggugagacuucaggcuggggaaggaagugucugaccacagggaucccaagacccuauccaagagaaaauuugaugccauuuucugaagcaccuggggcuucuuucagguggcaaaagcucggcuagaagaaacagaccggaggacggcaaaggaugugguggagaauggugagaagcuugagacuccugucacagcauucagcucccugacuucugaaccuccucagaagaguccuuacaggcuccucaggcccuuggcuuacucaguacccugacuucugucucaagacugggauuccugguguuucuuuuguucccuuugcccagagacuggcaugagaggccucagaugucuggcucuagauaucuugucucuggaauugagggaauaggggucuacucaguucuguucuggcuguaggauaugguaaauguaucuagaggacaaguuuuccuuguuuuguuccccacaggcgagacugcugaccagacccugucucugauggagcagcuccggggggaggcccuuaaguuccacaagccugguuagugggcaugucaaaacccuggggagggcuggaucuuggcagcagcuccuauagucaggccccuggggucagaggcuuuggcugcagccugguccuuaggcuuauucugguccuggcaggugagaacuacaagaccccaggcuauguggucacuccacacaccaugaaucuacuaaagcagcaccuggagauuacuggugggcagguguguggggauguggccaugugagcuugugccaucaaacaccugccugagugccugggcugcguccauacugccccaucucacccaucaccauggccuuccugggagggaacaucuguuucuuuaaggucaucugagcucagacuuuauuucucuuuucccaucccccuuauuuuagguacguacccgguucccgccagaacccaauggaauccugcauauuggacaugccaaagccaucaauuucaacuuuggcuaugccaagguaagcaugugucuagggaccuggcaagcaagaugaccacuugcuguucccaugaguggauaccauaucccugccuugcugucugcucccaauaauguacccaggugggcagaggccauggaaaggaaccacaugugugacagauaccuaggaaucuauugagcuuauuggaauaaauagcucccucccucugaggagucagugaguucaaauuugggggaguugccagugcagucccuaggcuuagaaagaugcuagguuagauacaggaaggugagagaagcucuugaagacauuuuuaauucugacaugaguccggguuggguggcucacgccuguaaucucaacacuucgggaggcuaaaguggguggaucacuugaggucaggaguucgaaaccaaucuggccaacauggugaaaccccaucucuacuaaaaauacaaaaguuagcuggccaugguggcacacgcuuguaguuucagcuacugggaagcugaggcaggagaaacccaggagguggaggcugcagugagccaagauggugcaagauaaucaagacuccaucucaaaaaaaaagaaaauucugacaugagagugcucugugaauauccuaguuugauaaacaggauuguggggcugauggaugaugugggaguucacagauggugcaacuuuccuaggccaacaauggcaucuguuuucugcguuuugaugacaccaacccugagaaggaggaagcaaaguucuucacggccaucugugacaugguagccuggcuagguauggacuaggcaaagccuagaagggcuggugguuagugggccucuccuugggccauggccugcccacuggguguuuguggcuggcugcucauacuuuguuucauuuugccccaggcuacacaccuuacaaagucacauaugcgucugacuauuuugaccagcuauaugcgugggcuguggagcucauccgcagguaaggccagggccaugacguagagccaggcagacugacuaggucacagccaugcugggcacucacaccgcuuccccacaggggucuggcuuaugugugccaccagcgaggagaggagcucaaaggccauaauacucugccuucacccuggagagaccgucccauggaggagucacugcugcucuuugaggugggguccuagaggagcaucuggguuugggugggccaaggugcugagaaugagaugcuccugugcuuagagacagccugaguccuuguuccccucaggcaaugcgcaagggcaaguuuucagagggcgaggccacacuacggaugaagcuggugauggaggauggcaagauggacccuguagccuaucgagucaaguauacaccacaccaccgcacaggggacaaaugguggguguagaaugggguggggugguggggcugccgagcagggcgaugggccaugggguagggcagaguagggcuggaugguagggcccacugccuaugccccacaggugcaucuaucccaccuacgacuacacacacugccucugugacuccaucgagcacaucacucacucacucugcaccaaggaauuccaggcccggugagggagcuggguccauggggugguagggccaguggaauuccagcagcccuuccuguggucucugccugguuccagagcuggccagugcuaacccuacucucccaccccagacgcucuuccuacuucuggcuuugcaaugcacuggacgucuauugcccugugcagugggaguauggccgccucaaccugcacuaugcuguugucucuaagaggaagauccuccagcuuguagcaacuggugcugugcgguaggugcggcuguuuggcuuaugaaagguuaauggcauaugcucccaaaggccuucucaccaccuucuuauccacagggacugggaugacccacggcucuuuacacucacggcccugcgacggcggggcuucccaccugaggccaucaacaacuucugugcccggguauagcccagcagguuggguagauacauuggggguugaguguggcaguuugugauuguagcugugacugaugcugaacuuuccugccaggugggagugacuguggcacaaaccacaauggagccacaucuucuagaagccugugugcgugaugugcugaaugacacagccccacgagccauggcugugcuggagucacuacgggucaucaucaccaacuuuccugcugccaaggugggccugccucaacaugugugucacauguguguguguagcuggggguacacuuggcucugggcauggggguccuaaugcugaguaugacucauaccugucuccugucuccugcuauaguccuuggacauccaggugcccaacuucccagcugaugagaccaaaggcuuccaucagguucccuuugcacccauugucuucauugagaggacugacuucaaggagguaaauuguggggguggagggucccguuugcugcugagucugguacugggaaccuuucaucuccucaucucugucaguccaucuacuuccugcuucagaugaaccaaucuuugccagacacggggguagggaagcuuccccacuuguuugacccuugcagccucaugugucuaccccacuuccuaucucuaggagccagagccaggauuuaagcgccuggcuuggggccagccugugggccugaggcauacaggcuacgucauugagcugcagcauguugucaaggugagagccagcugcagccuuccuacugcagugccugcuggggccaagaugugaguauagccugcaguccugguugugguucccgggucuaauugcugcuccccuccccccacuuccagggccccagugguuguguagagagucuggaggugaccugcagacgggcagaugcuggagagaagccaaaggccuuuauucacugggugucacagccuuugaugugugagguucgccucuaugagcgacugugagugaacagagcuggggugggggcagguacaagaugcacauugccugcuauggcugcccagcuggggguaugaccuucacuuuggcugcagauuccagcacaagaacccugaagauccuacugaggugccugguggauuuuuaagugaccugaaccugguagguucaugagguuuggggugagggagguaggccucccugguuggaugguugccugaguucccugccugcaggcaucacuacacgugguggaugcagcauuaguggacugcucuguggcccuggcaaaacccuucgacaaguuccaguuugagcgucuuggauauuucuccguggauccagacagccaucagggaaaggugcuugacuuuacucaccugcccucaucugcagcagugacaguggcugccguucauugugccaagugcucugcauacauucccuuaguuaauccucaccaccugagggaguugguauucauauucuacuagugaggaaacuggcacugaggauaacuccaggcacaaaauuuuguaugaaggcugccuuuuuuuuugagacagucuugcacugucgcccggggcuggagugcaauggcaccaucucggcucacugcaaccucugccucccagguucaagugauucuccugccucagccucccgaguagcugggauuacaggcgccugccaccacacccggcuaauuuuuuguauuuuuaguagagaugggguuucaccauguuggccaggauggucucgaauuccugacuucaugaucugcccgccucggccucccaaagugcugggaucacagucaugagccacugcacccgaccucuuuuuuuuuuuuaauuauuauuuuuugaggcagggcaugguggcucacacuuguaaucccagcacuuugggaggccaaggcaggcugaucaccagaggucagggcuuaccaccagaggucaggaguucgagaccacccuggccaacauggugaaacacccgaaagauauuauuuuuaauaucuuucguuaaggcagcuaauaaccuuucuuuuuauuuauuuuagagacggggucuuacucuugcccaggguggugugaaguggugcaaucauagcucacuguggccucaaacuacugggcucaagcuauucuccugccuuagcugagacuacaugugcacacuaccaugccuggcuaauuuuaaaacuuuuuguagaggcaaguucucacuauguugcccagguuggucuugaauuacuggcuucaagcaguccuccugucucagccuccuagagugcugggauuauaggcaugagccacugugcccagccacccugccauccuuuuuuuuuuuuuuuucuuuuuuugaaacaguaucucgcccuguugcccaggcuggaguacaguggcacgaucucggcccacugcaaccuccgccucccaggcucaagccauucuccugccucagccuuccaaguagcugggauuacaggcacaugcuaccacgcccggcaaauuuuuuuuuuuuuuuuuuuuuuuuuuuuuuuuuuuuugagacggagucucacaugucgcccaggcuggagugcaguggcacaaucucggcucacugcaagcucugccucccggguucacgccauucucccgccucagccucccaaauagcugggacuacaggcgcccgccaccacucccagcuaauuuuuucuauuuuuuaguagagacgggguuucaccguguuagccaggauggucucgaucuccugaucucaugauccgccugccucggccucccagagugcugggauuacaggcgugagccacugcgccuggccuaauuuuuguauuuuuaguagagacgggguuuugccauguuggccaggcuggucuugaacuccugaccucagauuaucugccugucucagccucccaaagugcugagauuacaggcgugagccacugcaccagcccacccugucuuucuuacuccuuaaaguagggggcaaacauggugguuguuauaauccauauaaaacuauacccuggacccccacggugguuguuaugguccauauaauacuauagccuagagccccauucagucccuuacccaaagucacaaaguuauugaggacccgggccuccugacccuuagucccucggcuucuuuggcuuaagaaggauguuagggggaggugucuguggugaaaccugcccaggccucccuggccuuguucuggguugguggucauccuuuucccucugcccuccagcuugucuuuaaccgaacugucacacugaaggaagacccaggaaaggugugagcuggaagcacugaaccuaccucauccuccuggaggguguggcuacccucgccaccccaaauuccaugucaauaaagaacagcuaaauucuccuagagucuguguguuaucucugcac

SEQ ID NO: 16136 - RNA, 9219 nt, Homo sapiens
gugcagagauaacacacagacucuaggagaauuuagcuguucuuuauugacauggaauuugggguggcgaggguagccacacccuccaggaggaugagguagguucagugcuuccagcucacaccuuuccugggucuuccuucagugugacaguucgguuaaagacaagcuggagggcagagggaaaaggaugaccaccaacccagaacaaggccagggaggccugggcagguuucaccacagacaccucccccuaacauccuucuuaagccaaagaagccgagggacuaagggucaggaggcccggguccucaauaacuuugugacuuuggguaagggacugaauggggcucuaggcuauaguauuauauggaccauaacaaccaccguggggguccaggguauaguuuuauauggauuauaacaaccaccauguuugcccccuacuuuaaggaguaagaaagacagggugggcuggugcaguggcucacgccuguaaucucagcacuuugggaggcugagacaggcagauaaucugaggucaggaguucaagaccagccuggccaacauggcaaaaccccgucucuacuaaaaauacaaaaauuaggccaggcgcaguggcucacgccuguaaucccagcacucugggaggccgaggcaggcggaucaugagaucaggagaucgagaccauccuggcuaacacggugaaaccccgucucuacuaaaaaauagaaaaaauuagcugggagugguggcgggcgccuguagucccagcuauuugggaggcugaggcgggagaauggcgugaacccgggaggcagagcuugcagugagccgagauugugccacugcacuccagccugggcgacaugugagacuccgucucaaaaaaaaaaaaaaaaaaaaaaaaaaaaaaaaaaaaauuugccgggcgugguagcaugugccuguaaucccagcuacuuggaaggcugaggcaggagaauggcuugagccugggaggcggagguugcagugggccgagaucgugccacuguacuccagccugggcaacagggcgagauacuguuucaaaaaaagaaaaaaaaaaaaaaaaggauggcaggguggcugggcacaguggcucaugccuauaaucccagcacucuaggaggcugagacaggaggacugcuugaagccaguaauucaagaccaaccugggcaacauagugagaacuugccucuacaaaaaguuuuaaaauuagccaggcaugguagugugcacauguagucucagcuaaggcaggagaauagcuugagcccaguaguuugaggccacagugagcuaugauugcaccacuucacaccacccugggcaagaguaagaccccgucucuaaaauaaauaaaaagaaagguuauuagcugccuuaacgaaagauauuaaaaauaauaucuuucggguguuucaccauguuggccaggguggucucgaacuccugaccucuggugguaagcccugaccucuggugaucagccugccuuggccucccaaagugcugggauuacaagugugagccaccaugcccugccucaaaaaauaauaauuaaaaaaaaaaaagaggucgggugcaguggcucaugacugugaucccagcacuuugggaggccgaggcgggcagaucaugaagucaggaauucgagaccauccuggccaacauggugaaaccccaucucuacuaaaaauacaaaaaauuagccgggugugguggcaggcgccuguaaucccagcuacucgggaggcugaggcaggagaaucacuugaaccugggaggcagagguugcagugagccgagauggugccauugcacuccagccccgggcgacagugcaagacugucucaaaaaaaaaggcagccuucauacaaaauuuugugccuggaguuauccucagugccaguuuccucacuaguagaauaugaauaccaacucccucagguggugaggauuaacuaagggaauguaugcagagcacuuggcacaaugaacggcagccacugucacugcugcagaugagggcaggugaguaaagucaagcaccuuucccugauggcugucuggauccacggagaaauauccaagacgcucaaacuggaacuugucgaaggguuuugccagggccacagagcaguccacuaaugcugcauccaccacguguagugaugccugcaggcagggaacucaggcaaccauccaaccagggaggccuaccucccucaccccaaaccucaugaaccuaccagguucaggucacuuaaaaauccaccaggcaccucaguaggaucuucaggguucuugugcuggaaucugcagccaaagugaaggucauacccccagcugggcagccauagcaggcaaugugcaucuuguaccugcccccaccccagcucuguucacucacagucgcucauagaggcgaaccucacacaucaaaggcugugacacccagugaauaaaggccuuuggcuucucuccagcaucugcccgucugcaggucaccuccagacucucuacacaaccacuggggcccuggaaguggggggaggggagcagcaauuagacccgggaaccacaaccaggacugcaggcuauacucacaucuuggccccagcaggcacugcaguaggaaggcugcagcuggcucucaccuugacaacaugcugcagcucaaugacguagccuguaugccucaggcccacaggcuggccccaagccaggcgcuuaaauccuggcucuggcuccuagagauaggaagugggguagacacaugaggcugcaagggucaaacaaguggggaagcuucccuacccccgugucuggcaaagauugguucaucugaagcaggaaguagauggacugacagagaugaggagaugaaagguucccaguaccagacucagcagcaaacgggacccuccacccccacaauuuaccuccuugaagucaguccucucaaugaagacaaugggugcaaagggaaccugauggaagccuuuggucucaucagcugggaaguugggcaccuggauguccaaggacuauagcaggagacaggagacagguaugagucauacucagcauuaggacccccaugcccagagccaaguguacccccagcuacacacacacaugugacacacauguugaggcaggcccaccuuggcagcaggaaaguuggugaugaugacccguagugacuccagcacagccauggcucguggggcugugucauucagcacaucacgcacacaggcuucuagaagauguggcuccauugugguuugugccacagucacucccaccuggcaggaaaguucagcaucagucacagcuacaaucacaaacugccacacucaacccccaauguaucuacccaaccugcugggcuauacccgggcacagaaguuguugauggccucaggugggaagccccgccgucgcagggccgugaguguaaagagccgugggucaucccagucccuguggauaagaagguggugagaaggccuuugggagcauaugccauuaaccuuucauaagccaaacagccgcaccuaccgcacagcaccaguugcuacaagcuggaggaucuuccucuuagagacaacagcauagugcagguugaggcggccauacucccacugcacagggcaauagacguccagugcauugcaaagccagaaguaggaagagcgucuggggugggagaguaggguuagcacuggccagcucuggaaccaggcagagaccacaggaagggcugcuggaauuccacuggcccuaccaccccauggacccagcucccucaccgggccuggaauuccuuggugcagagugagugagugaugugcucgauggagucacagaggcaguguguguagucguaggugggauagaugcaccuguggggcauaggcagugggcccuaccauccagcccuacucugcccuaccccauggcccaucgcccugcucggcagccccaccaccccaccccauucuacacccaccauuuguccccugugcgguggugugguguauacuugacucgauaggcuacaggguccaucuugccauccuccaucaccagcuucauccguaguguggccucgcccucugaaaacuugcccuugcgcauugccugaggggaacaaggacucaggcugucucuaagcacaggagcaucucauucucagcaccuuggcccacccaaacccagaugcuccucuaggaccccaccucaaagagcagcagugacuccuccaugggacggucucuccagggugaaggcagaguauuauggccuuugagcuccucuccucgcugguggcacacauaagccagaccccuguggggaagcggugugagugcccagcauggcugugaccuagucagucugccuggcucuacgucauggcccuggccuuaccugcggaugagcuccacagcccacgcauauagcuggucaaaauagucagacgcauaugugacuuuguaagguguguagccuggggcaaaaugaaacaaaguaugagcagccagccacaaacacccagugggcaggccauggcccaaggagaggcccacuaaccaccagcccuucuaggcuuugccuaguccauaccuagccaggcuaccaugucacagauggccgugaagaacuuugcuuccuccuucucaggguuggugucaucaaaacgcagaaaacagaugccauuguuggccuaggaaaguugcaccaucugugaacucccacaucauccaucagccccacaauccuguuuaucaaacuaggauauucacagagcacucucaugucagaauuuucuuuuuuuuugagauggagucuugauuaucuugcaccaucuuggcucacugcagccuccaccuccuggguuucuccugccucagcuucccaguagcugaaacuacaagcgugugccaccauggccagcuaacuuuuguauuuuuaguagagaugggguuucaccauguuggccagauugguuucgaacuccugaccucaagugauccacccacuuuagccucccgaaguguugagauuacaggcgugagccacccaacccggacucaugucagaauuaaaaaugucuucaagagcuucucucaccuuccuguaucuaaccuagcaucuuucuaagccuagggacugcacuggcaacucccccaaauuugaacucacugacuccucagagggagggagcuauuuauuccaauaagcucaauagauuccuagguaucugucacacaugugguuccuuuccauggccucugcccaccuggguacauuauugggagcagacagcaaggcagggauaugguauccacucaugggaacagcaaguggucaucuugcuugccaggucccuagacacaugcuuaccuuggcauagccaaaguugaaauugauggcuuuggcauguccaauaugcaggauuccauuggguucuggcgggaaccggguacguaccuaaaauaagggggaugggaaaagagaaauaaagucugagcucagaugaccuuaaagaaacagauguucccucccaggaaggccauggugaugggugagauggggcaguauggacgcagcccaggcacucaggcagguguuugauggcacaagcucacauggccacauccccacacaccugcccaccaguaaucuccaggugcugcuuuaguagauucaugguguguggagugaccacauagccuggggucuuguaguucucaccugccaggaccagaauaagccuaaggaccaggcugcagccaaagccucugaccccaggggccugacuauaggagcugcugccaagauccagcccuccccaggguuuugacaugcccacuaaccaggcuuguggaacuuaagggccuccccccggagcugcuccaucagagacagggucuggucagcagucucgccuguggggaacaaaacaaggaaaacuuguccucuagauacauuuaccauauccuacagccagaacagaacugaguagaccccuauucccucaauuccagagacaagauaucuagagccagacaucugaggccucucaugccagucucugggcaaagggaacaaaagaaacaccaggaaucccagucuugagacagaagucaggguacugaguaagccaagggccugaggagccuguaaggacucuucugaggagguucagaagucagggagcugaaugcugugacaggagucucaagcuucucaccauucuccaccacauccuuugccguccuccggucuguuucuucuagccgagcuuuugccaccugaaagaagccccaggugcuucagaaaauggcaucaaauuuucucuuggauagggucuugggaucccuguggucagacacuuccuuccccagccugaagucucaccauaccucaccucacccucagggacucagggccaugcccaucccuaccuugaacuucuucuccagaucagccuccaacuuggggcccagaagguggaggaccugagcagagaccagaaucaggcagaggcaggaguauccucuuucaaggagccccugacugauccuacccaccaacccaaggcuuccuggccuaucuaccagcacugacugaaaaaaccuaccuagcccaucccaucucuucucaugugggucugcuagcuuaaaaugcucuugcucuuguugcccagacuggagucuugcucauguugcccaggcuggaaugcaauggcacagucuccgcucacugcaaccuccgccuccuggauucaagcgauuuuccuaccucagcccuucugaguaccugggacugcaugugcccgccaccacacccagcuaauuuuuguacuuuuuguagagaugggguuucaccauguuggccaggcuguucucaaacuccugaccucaggugaucugcccaccucagccucccaauaguguugggauuacaggugugagccaccaugcccagcccccucccaccuuuuuuuauuguuguugauuuugagacagggucucauucuguacuccaggauggagugcaguggugcaaucagagcuuacugcagccuugaucucuuagauucaagcaaucuucccaccacagccccacaaauugcugggacuacagguauacaccaccaugucuggcuaauuuuuaaauuuucuguagagaggaguucucaauauguugcucaggcuggucuugaacuccugggcucaaguaauccuccugccucagccucccaaagugcugggaucagaagcgugagccaccaugcccagcccucuuccugccuuuuaucccuuaguggauuccaggcucuguucaugccagagucuuugccagcuucagcuuagugaagcacgcucaccugcauguccacuucauucuugaucauuuugccaucugcccacuucagcacagcccgagccucuccuagaagcauaggcacaaggagcugcagaaaggcaaaaaagaguacuccccccaccucuuucccaaggaaagguccuggcugaccaccagaaccagagccugagcccagccagaccacuuuaagucacuccuguuccuucccccaccuccuucucacucgugcccagaagaaaaggcaugaccagagagaacaauauagccccguuccaggcccugcucacccaucagcagccccauguugaaaugguaacguuccaccaggagcuggggccggugccuguuaauagcagccuccaccugcagaaagccaaaccaugugguucaggaaagccaccuuuagagauauucugggaacccacacccucacucugggucuuccugaggagggaaacugagccacuccuuuccauggccaggacuggggaggcagacgaugccuggggaaagacucacagccuccucaaucugcucuggggucacaaugacacccacgccacauucccgcucgaaguccacagugucgaugggguccaaggggugacuccgcacauacucaagggcagcugagaagaaagagcccgugaguuuguggcaucucugcuccaagaaguggacagacaggguccuaaucucaugaaacuccaaggauagucuggccuccugaaaaguuaagcccuggcaccaccacccuagagaacacagggaagaaagaagcacgugucgagaguggauccccccucagacccugacaguucccgugucagucucaccauaggccaccccuuccaugccucagugccugugcagaacuaggugucuagaaagaaacuggaggacuuggcaaaaagggaagacaggggucuuggcugaagggaggcauuggugcgaacuggcaggacagguaggggucucaccgcuuagcuggggcucaguguggaucuucuuacuggcuauguagcuuacaaggaaggagagacgccggguaucccugagucgggaggccaagccauauaacaggaucccgguagcuuugucaaugguggaacccagggucugcugagccugaggucagaggggucaagagagaagccccgcgcucagugagaggaaagggcgggacaaacggggcaggucgggaucuggaccccgccccgcgcugcguugcagcauggucugcaaaccaggccgggggcagaggggcucgcaccugaguagcggccucgcgcagcugcgcgcucagagccgaguucuugagcgucucgcgggccuucugcucgcucaggccgaggcuagugaagagcgacagggagucuagagccgccauugcagagacaccggaaacuaaaagaaacuuaggccccagucugcaggucggcauucacucgcugaccaaugagagugaagccuccggggagagccaaugggguccuuccuuggcgggagggggcggggcgcuccaaggucgucuauccccuuuaaacaacacagggcggacaaaccggccuuuccgggggcuuugcuuccgccuccguggaacugggaacuugaagggguguuggcaggcggcagggcuuuuggagauauuugccacggaccuggaaggaagguguucgucccugaggcaggaggaagacacaggcgugguuuugcucugacuuuucuacuucagcccugguaacuccaucucaauauaguaauuguccucgggggcaaaugcgag

SEQ ID NO: 16137 - RNA, 2956 nt, Homo sapiens
caggugguuucuccuuaaaauggcuccaagucugcaggcagccagagcaagcggaagggcaagcugugauaguguuuggguggcuguucggcuggcccagaccaggccgaaccggaccagacuugaaguagaagcgcguggagcaucaccuuguccucguucacucugcucgcguccugggagucccccgucccccgucuugauccaagucaagggccuacuggcgcgagagucgcuggcccccgcgcgggguuugggcaucucggcacgccggcucugucguggccucaggggaacauugucgcuuucgcuacccgcggggccgggcgagcgggaagcucggcacagugggagccugguggugggucuccuggggccggucgcaauggguuuccgggggucccgcggcugcucuguggaccccuucggccccuggugcuccgggcgcuggcagcgucaccggacaaaggccaccgagcgcggggguguccccgagguggacgcgcggguuuacuuccucuccggccccacgggcgcgcuucccuccugacggauuccgaagcccgccccaccaccgucaccgcaccaguggcccaggcuucgugggaccaacagggcuaauccugccccacggaucuaauccggaucgggacccggucccaggggaggcccccaccuccccuucuauuguucuguggcccaggugagcgucuuguucccucuagacuccguuucacaaccuacucccgggucuuccuccugggacuggggaugggcggguucugauguggccccagggcgagugaccugggggcaggagcucccccgccccccgccaacggcuggacagcgggcaacggaaucccaaaagcagcuguugucuccagagcauuccagcugcgcuuggauuucguccccugcucuccugccugagcagcgcccuggcccagauggggugccccugacccccagacauacuuuacugagcugcuugggucucaguuccucucaguugcgcccucaggcuggaggugauggguguagacgugggagagccgaggcugguggccaucucuggaacccuggggaggauuggcgagggaggguggacccaggaccucuggguagggcugcaaugguagugacucccccagggcugccucagcccgcaucucgcuaaagauagcccucuuacuuccuggggaaaaaccaccccaaccgucuucguggaugagaguaucugaaguccucaguuugacugaggguucccaacccugcuaagcaguugucuccaggucaugcaccuucagaauggaaagcgcuuuggaaugacacgaucacucccguugagugggcacccgagaagccaucgggaaugucguguccgcccagugcucuuucggcgccucccagcagggccucagcccuggcccagaaaggggccuugccaagcuuuuccugccccuggguuucccugcucuccggauuucccaacucucucuacugaguuagcuucucuauuaaaaggaaugggggugggguggggggugaguaaguuacagugaaaugaagacauuugggaaccuuugugggagaaagaaaaagaccuuuccuauugguagaggagcaagauacuccaacugaggccuauuuucuauuauggucgcauuauuugguuggcccguaaauggcuguugccuaaaacaggaagcuuuaaggaucguuguuaaagcacaccagguuaaaggagucacauuaaaagcuggucauucugagccgggcgcgguggcucacgccuguaaucccagcacuuugggaggccgaggcaggcggaucaccugaggucgggaguucgaggcuugacaaacauggagaaaccccgucucuauuaaaaauacaaaaguagccgggcgugguggcgcgugccuguaaucccagcuacuugggagacugaggcaggauaaucacuugaacccgggagggggagguugcggugagccaagaucacaccacuguacuccagccugggcaacaggagcgaaacuccgucucaaaaaaaaaaaaaaaaagucugguaauucuggaagccaucaugaugguugugauuucucagguaucaagagaagaaaaccgccaacuguaucagagugcuuauuuauugggcauaaagaccacccgggcugggugcaguggcugaugccuguaaucccagcacuuucggaggccgaggcgggcaggucacgaggucaggaguucgagaccagccuggccaacauggcgaaaccccgucucuacuaaaaauacaaaaauuagccgggcgugguggcgggcgcccguaaucccagcuacucgggaggcugaggaggagaauccugugaauccgggagguggaggcugcagugagccgagaucgugccacugcacuccagccugggagacaagagcaagacuccgucucaaacaaacaaaaaaacacccauaucucaaacgagaaaaugcuugcaaauaaccugaaaccgcggaacacuauucuuuuuaaaacgagauauuuuaaguaggucgugaaaguggccuuaauguuauacugccuuauuccagugacgaauauucaucauguguaaaaugggagaaaugaaauguuauuaaaacaaacaugugagacuucgaugagaagagacgguacccggucuaagcgcccaccgggucgcgaggauccuuuuccugguuaaggccugggucacagcgaaagaacccuaggcccagggagggccccgagauuucagauccggggcccggcugugcagguggaccacgcggaaggggcgcugggggcgguaggucgaaagcagccgacagggcuaccacuggcgcaccuguccacuuacggggaccaccgccgcauccccgccccagcuagucgguccuuuccggaaguuccaccucccuaaauuuuuuu

SEQ ID NO: 16138 - RNA, 2956 nt, Homo sapiens
aaaaaaauuuagggagguggaacuuccggaaaggaccgacuagcuggggcggggaugcggcggugguccccguaaguggacaggugcgccagugguagcccugucggcugcuuucgaccuaccgcccccagcgccccuuccgcgugguccaccugcacagccgggccccggaucugaaaucucggggcccucccugggccuaggguucuuucgcugugacccaggccuuaaccaggaaaaggauccucgcgacccggugggcgcuuagaccggguaccgucucuucucaucgaagucucacauguuuguuuuaauaacauuucauuucucccauuuuacacaugaugaauauucgucacuggaauaaggcaguauaacauuaaggccacuuucacgaccuacuuaaaauaucucguuuuaaaaagaauaguguuccgcgguuucagguuauuugcaagcauuuucucguuugagauauggguguuuuuuuguuuguuugagacggagucuugcucuugucucccaggcuggagugcaguggcacgaucucggcucacugcagccuccaccucccggauucacaggauucuccuccucagccucccgaguagcugggauuacgggcgcccgccaccacgcccggcuaauuuuuguauuuuuaguagagacgggguuucgccauguuggccaggcuggucucgaacuccugaccucgugaccugcccgccucggccuccgaaagugcugggauuacaggcaucagccacugcacccagcccggguggucuuuaugcccaauaaauaagcacucugauacaguuggcgguuuucuucucuugauaccugagaaaucacaaccaucaugauggcuuccagaauuaccagacuuuuuuuuuuuuuuuuugagacggaguuucgcuccuguugcccaggcuggaguacaguggugugaucuuggcucaccgcaaccucccccucccggguucaagugauuauccugccucagucucccaaguagcugggauuacaggcacgcgccaccacgcccggcuacuuuuguauuuuuaauagagacgggguuucuccauguuugucaagccucgaacucccgaccucaggugauccgccugccucggccucccaaagugcugggauuacaggcgugagccaccgcgcccggcucagaaugaccagcuuuuaaugugacuccuuuaaccuggugugcuuuaacaacgauccuuaaagcuuccuguuuuaggcaacagccauuuacgggccaaccaaauaaugcgaccauaauagaaaauaggccucaguuggaguaucuugcuccucuaccaauaggaaaggucuuuuucuuucucccacaaagguucccaaaugucuucauuucacuguaacuuacucaccccccaccccacccccauuccuuuuaauagagaagcuaacucaguagagagaguugggaaauccggagagcagggaaacccaggggcaggaaaagcuuggcaaggccccuuucugggccagggcugaggcccugcugggaggcgccgaaagagcacugggcggacacgacauucccgauggcuucucgggugcccacucaacgggagugaucgugucauuccaaagcgcuuuccauucugaaggugcaugaccuggagacaacugcuuagcaggguugggaacccucagucaaacugaggacuucagauacucucauccacgaagacgguuggggugguuuuuccccaggaaguaagagggcuaucuuuagcgagaugcgggcugaggcagcccugggggagucacuaccauugcagcccuacccagagguccuggguccacccucccucgccaauccuccccaggguuccagagauggccaccagccucggcucucccacgucuacacccaucaccuccagccugagggcgcaacugagaggaacugagacccaagcagcucaguaaaguaugucugggggucaggggcaccccaucugggccagggcgcugcucaggcaggagagcaggggacgaaauccaagcgcagcuggaaugcucuggagacaacagcugcuuuugggauuccguugcccgcuguccagccguuggcggggggcgggggagcuccugcccccaggucacucgcccuggggccacaucagaacccgcccauccccagucccaggaggaagacccgggaguagguugugaaacggagucuagagggaacaagacgcucaccugggccacagaacaauagaaggggaggugggggccuccccugggaccgggucccgauccggauuagauccguggggcaggauuagcccuguuggucccacgaagccugggccacuggugcggugacggugguggggcgggcuucggaauccgucaggagggaagcgcgcccguggggccggagaggaaguaaacccgcgcguccaccucggggacacccccgcgcucgguggccuuuguccggugacgcugccagcgcccggagcaccaggggccgaagggguccacagagcagccgcgggacccccggaaacccauugcgaccggccccaggagacccaccaccaggcucccacugugccgagcuucccgcucgcccggccccgcggguagcgaaagcgacaauguuccccugaggccacgacagagccggcgugccgagaugcccaaaccccgcgcgggggccagcgacucucgcgccaguaggcccuugacuuggaucaagacgggggacgggggacucccaggacgcgagcagagugaacgaggacaaggugaugcuccacgcgcuucuacuucaagucugguccgguucggccuggucugggccagccgaacagccacccaaacacuaucacagcuugcccuuccgcuugcucuggcugccugcagacuuggagccauuuuaaggagaaaccaccug

SEQ ID NO: 16139 - RNA, 3117 nt, Homo sapiens
cgguuccgcuuacuccuuccggucaccauggcgaccaggcgccuuggggucggggagacgcugggggcccucaacgcggcccuggggccaggcgguccgguguggaucaaggagacgcgcacccgccaccugcguucccgagacuuucuggcaccgcaccgcgcgcugcaggcgcgcuucgaugacggccaggugggcgugagccgggcggggccgugcggccgggagaugggccccgugccguggcucuuuuacacgcccguucucccgcagguuccggagcauuugcuccaugcccucgccugccugcagggccccgguguggccccggugcugcgcugcgcgccgacccccgcgggucugucucuccaacugcagcgguccgccgucuucgagcgcguccucagcgccguggccgccuaugccacgcccgccucgccugccucgcugggccagcgcgucuuacuacacugcccagcacugcgcagcucccccugcgcacuccgcuugagccagcugcguacggugcucguggccgaucaccuggcgcgagcccugcgcgcucacgggugagcggggccgcggggccggaauggagaaagugggacugccggguaccuagaaagcgagcggcgccgcccguggggacugcggcuggaggugggaagucguggcgagcuggaccaggugcucagacugaggcggccgcccucccuucgcagggugugcgugcgccuagugccagcugugcgggauccgcacaugcugaccuuccugcagcaacugcggguggacuggcccgcugccucggagagagcuuccucccacacccugaggagccacgcccuugaagaacuuaccucugcuaaugacgggaggacacuguccccuggcauccuaggcagacugugucugaaggagcugguggaagaacagggccgcacagcuggcuaugaccccaaccuggacaacugucuggguaggaccugaagccuagcagggccagaaaaggcaggaggggguuaggggcacaucucugcuucuugucagucucagcaccugucuguucucuuuucagugacugaggaucuccucucugugcuggcugagcugcaagaggcucuauggcauuggcccgaggacagccacccaggccugguuagugacucccagcccuguagguucucccaaaccaaguauacuguacuuccacaguuaugauuguccucccuuaggcuggggccucagauacugguacaggcggcugccugguuguacauguuguuagcugugaggaggaguuccagcaacagaaguuggaccugcuuuggcagaaguugguugacaaggcuccacucagacagguagguuaauaaugaugguggagcuccccaccaccuaacccccaaccucagagggcccuugaaaacccaccgaggggcuuguuagcugacagaaaccaacacuugaccuugggggaguugcuggacuugagagggcauguacagcaggugcagaggcucuggggaaggggggucuguagacacaucccaagaacacugaagaccagguugagaaggaugaaccaugcguagccugaguggcuggguagacggaggcacucaaccuggcaguuccaauuugagggagucugggcugaguagaggcaccagauuugggcuccucaagggacuuccuggagaguagcgccaacuaggcugagccccugacaucuuucugacagaagcaccucaucuguggcccugugaaaguagcuggugcaccuggcacucugaugacugccccugaguacuacgagugagugaggcugggaggaacaccaaccuaagccaggguaaugaggggggacucuuuacccaggacccugcccacuggccuuccucucuuccaaacacagguuccggcauacccaggugugcaaggccucagcacugaagcaugguggggaucuggcacaaggugugccugggaaacccuggcuauguucuggguuaggggcagguuuuuugcaucccugcccuugccugcagacugacugaccaacccuauacucccucagacccagccuggacagagaucuuugguguucucucuguggccaccaucaaguuugagaugcugagcacagccccacagagucaggugagccugggagccugacagggccaguguuggggcacagggugugguggcugccuucucucucugcagcugugcuucuauuccccagcucuuccuggcucuggcugacagcaguaucuccacgaagggcacaaagaguggcaccuuugucauguauaauugugcccgucuugccacacucuuugagaguuacaaguguaguauggaacaaggucuguaccccacuuuuccuccugugagcagucuggacuucucacugcuacaugaugaggugagugucccuccugguagcuggcacaaggaggccuggacuuccccucccagcaccuuucuccccaacagggugagugguuguugcucuucaacaguauccuccccuuuccggaucugcugagccggacagcagugcuggacugcacagccccggggcuccacauugcuguacgcacagagauggugaggcauagacaaccaggacacucuacacucuauucuuuauucuggccuggggcacaagagcaaagagaugggccagugacucagucucugucucuagauaugcaaguuccugguacagcucagcauggauuucagcuccuacuacaaccggguacacauccugggggugagcacacagcaaaauggggugggacgugcagagagguauaggguaaaggcaaaggaagcagaggaugagaccagcaggcccuuucucuuucaggagccucgaccacaccucuuuggucagauguucguccgccugcagcuucugagagcugugcgugaggugcuccauacuggccuggcuaugcugggucucccuccacugagccacauuuaaggccacagaggcuccaauaccugggaauguucacaaagucaucaacuggaaaaaaagcaaaaacccacggccaaaauaaauugguacuguuuguuacaaaguucugucuuguc

SEQ ID NO: 16140 - RNA, 3117 nt, Homo sapiens
gacaagacagaacuuuguaacaaacaguaccaauuuauuuuggccguggguuuuugcuuuuuuuccaguugaugacuuugugaacauucccagguauuggagccucuguggccuuaaauguggcucaguggagggagacccagcauagccaggccaguauggagcaccucacgcacagcucucagaagcugcaggcggacgaacaucugaccaaagagguguggucgaggcuccugaaagagaaagggccugcuggucucauccucugcuuccuuugccuuuacccuauaccucucugcacgucccaccccauuuugcugugugcucacccccaggauguguacccgguuguaguaggagcugaaauccaugcugagcuguaccaggaacuugcauaucuagagacagagacugagucacuggcccaucucuuugcucuugugccccaggccagaauaaagaauagaguguagaguguccugguugucuaugccucaccaucucugugcguacagcaauguggagccccggggcugugcaguccagcacugcuguccggcucagcagauccggaaaggggaggauacuguugaagagcaacaaccacucacccuguuggggagaaaggugcugggaggggaaguccaggccuccuugugccagcuaccaggagggacacucaccucaucauguagcagugagaaguccagacugcucacaggaggaaaagugggguacagaccuuguuccauacuacacuuguaacucucaaagaguguggcaagacgggcacaauuauacaugacaaaggugccacucuuugugcccuucguggagauacugcugucagccagagccaggaagagcuggggaauagaagcacagcugcagagagagaaggcagccaccacacccugugccccaacacuggcccugucaggcucccaggcucaccugacucuguggggcugugcucagcaucucaaacuugaugguggccacagagagaacaccaaagaucucuguccaggcugggucugagggaguauaggguuggucagucagucugcaggcaagggcagggaugcaaaaaaccugccccuaacccagaacauagccaggguuucccaggcacaccuugugccagauccccaccaugcuucagugcugaggccuugcacaccuggguaugccggaaccuguguuuggaagagaggaaggccagugggcaggguccuggguaaagaguccccccucauuacccuggcuuagguugguguuccucccagccucacucacucguaguacucaggggcagucaucagagugccaggugcaccagcuacuuucacagggccacagaugaggugcuucugucagaaagaugucaggggcucagccuaguuggcgcuacucuccaggaagucccuugaggagcccaaaucuggugccucuacucagcccagacucccucaaauuggaacugccagguugagugccuccgucuacccagccacucaggcuacgcaugguucauccuucucaaccuggucuucaguguucuugggaugugucuacagaccccccuuccccagagccucugcaccugcuguacaugcccucucaaguccagcaacucccccaaggucaaguguugguuucugucagcuaacaagccccucgguggguuuucaagggcccucugagguuggggguuaggugguggggagcuccaccaucauuauuaaccuaccugucugaguggagccuugucaaccaacuucugccaaagcagguccaacuucuguugcuggaacuccuccucacagcuaacaacauguacaaccaggcagccgccuguaccaguaucugaggccccagccuaagggaggacaaucauaacuguggaaguacaguauacuugguuugggagaaccuacagggcugggagucacuaaccaggccuggguggcuguccucgggccaaugccauagagccucuugcagcucagccagcacagagaggagauccucagucacugaaaagagaacagacaggugcugagacugacaagaagcagagaugugccccuaacccccuccugccuuuucuggcccugcuaggcuucagguccuacccagacaguuguccagguuggggucauagccagcugugcggcccuguucuuccaccagcuccuucagacacagucugccuaggaugccaggggacaguguccucccgucauuagcagagguaaguucuucaagggcguggcuccucagggugugggaggaagcucucuccgaggcagcgggccaguccacccgcaguugcugcaggaaggucagcaugugcggaucccgcacagcuggcacuaggcgcacgcacacccugcgaagggagggcggccgccucagucugagcaccugguccagcucgccacgacuucccaccuccagccgcaguccccacgggcggcgccgcucgcuuucuagguacccggcagucccacuuucuccauuccggccccgcggccccgcucacccgugagcgcgcagggcucgcgccaggugaucggccacgagcaccguacgcagcuggcucaagcggagugcgcagggggagcugcgcagugcugggcaguguaguaagacgcgcuggcccagcgaggcaggcgaggcgggcguggcauaggcggccacggcgcugaggacgcgcucgaagacggcggaccgcugcaguuggagagacagacccgcgggggucggcgcgcagcgcagcaccggggccacaccggggcccugcaggcaggcgagggcauggagcaaaugcuccggaaccugcgggagaacgggcguguaaaagagccacggcacggggcccaucucccggccgcacggccccgcccggcucacgcccaccuggccgucaucgaagcgcgccugcagcgcgcggugcggugccagaaagucucgggaacgcagguggcgggugcgcgucuccuugauccacaccggaccgccuggccccagggccgcguugagggcccccagcgucuccccgaccccaaggcgccuggucgccauggugaccggaaggaguaagcggaaccg

SEQ ID NO: 16141 - RNA, 8678 nt, Homo sapiens
acaaccaggacacucuacacucuauucuuuauucuggccuggggcacaagagcaaagagaugggccagugacucagucucugucucuagauaugcaaguuccugguacagcucagcauggauuucagcuccuacuacaaccggguacacauccugggggugagcacacagcaaaauggggugggacgugcagagagguauaggguaaaggcaaaggaagcagaggaugagaccagcaggcccuuucucuuucaggagccucgaccacaccucuuuggucagauguucguccgccugcagcuucugagagcugugcgugaggugcuccauacuggccuggcuaugcugggucucccuccacugagccacauuuaaggccacagaggcuccaauaccugggaauguucacaaagucaucaacuggaaaaaaagcaaaaacccacggccaaaauaaauugguacuguuuguuacaaaguucugucuugucauggggagucgggcauauucuuggcagcacuccacucaccuucagcuccugcaccgacaucaggaacccacggccaccaccuccuccccucaaggcaugcugagcaugggcacagacagcccaucccugcuccaugcugucugugagcaggccccaugcccagcacgccagccaccgcaggauaccucagucauaccaguuguaaaccucaagccccugacccccaagggcacaacgguggccaaacucagggcucacaggccagcaguccaugucagccacaucaggcacauggaacacagugcuauucaugaagguggguucaccaugccccagacgccagaaggucagccguugaucaauggaggcugagaccaugaugcuugggcuuaggaucuugaggccugucacaugggcagcaugugcacaggggacagaguauuccucuagcacacgcagcugggguaccagcccagccucucccacagccucuucuagcuguagcaucuccacagcaagcacgaagacauggagggauccaucuucacugccacuggccacgagaugguggcccucacgggugggcaaggugugcaggcuguugauaccacagcugugggccuggagagucagggagggggugccaagcccugaaggaagaggaagaggguaguugucagggccccgccugccacaugugugagggcuaugugacaggugaggagggguagccaugguugcacauuagcuacucacgguagggaagcccaggauccacuggaggcuccaggacaguggagucauggucuagcaugguggugagaucccagaaagccaggcugccaucaguagcugcgcugcacaggaggagccuccugagagccaggaaaagacagccuggucaauaacagagaugaagcucaacaggaaccccccaacccagcccaugcaggaccaucauccagccccucucaccgccucugguugggugccucguguguaaaggaguggaccuugaggacacaucgcuuaugguggaagguuucagcaaggagcugcagaauccgcccagaauccugcaaaagaaagagccuggggggcgggggguggcccagcucagaacgcauccuagacaaccuuacuuccuuugucuccugucccacugggcccuaugcucucaccuuacggccccaucacuacaggcugcagccacaagggggccaaggccgggcuggucaaguucacacacagcaagggacauguaccugcagagacaacaugcagcugucagguggagccugcaagccugggagcaucugcaugacccauaccacacccugcccaggagcauauauuaccuggucucugggucuaccuuaaccauccgaugccgauugcguugccggucccaauacucaucuagccggugggacgaaaggugcaugacauggcaggcgaggcggcuuggggugcugggguccggaguaaccaugaugcugaagcagugcaucucagcccgcccccccgcagacaccacaugggcagucaggccuggcugaggauccugagggccaccuggggugccaaugccccacacagccacagcacguaccgaggagauaugguuacaaacagcugugagugcgugggcugagccugugguuguagggagugcuaggacacagacaguaguguccucacuacaugugaucacaaugucagucaagucgggccccucacugccaggcuccaggucaucaggcugcaugaagcugggcacuccauauucaggccccaggguaauggugcccacacgcuuuacacaagugaucucacggccaugcagacccucccggagaaucacguguggccgggugcagccacccagagcccuguacagcaugacauccccauccuugagguaagcaaaggccauggccgccucaguaucagagaaugcccacgaacggugcccuccaccacaguugacgaugugcagcuucucgugugaccgaggguuccacaccacaaacucauuggcauggaaacccaggauaaccaugcucccaucgggcacuauacggagcccagcuagccaguucaugccucgacaggacuucugccuuaggacuggcuggagcuggccgucucguacaaacagcugguaguaggcuccaucacgcccugugguauacacauagccaccauggcaugugacugaggucacacccugcuucccgugcagagagggcaggguagacacugggcccaacccagugaaagcauucccacccccacuacuaccacuacccacuacaggugccccagcaccagcccgagccuugccucccaccccaggguccuugagcagaccuggucuggaggggaauagcagcacagagccccggcggucaccacacaccaggaagucaccuggggguaggaaggcacugcaugugugccaucucugcuugcuugggggcagcagguaccgacaacguuccuugacaaagauggccuugccagagggugcggcugagaucucuaggcaagcuacuaccccgccagggcccgaugccagcaacaggagcuccucauaaccacgcagggcccagcucaagcugugcaccuucccaggaaacagggucugguccacagcagcaguuggaguguugauggggacaaccuugacacgaccuuccccauuggccauagcacacaauccgaagcccucgggaccaggagcugccuccagcaggcaguaggacuggaaauguuuauccucuagcagcugcucccagcacuugaccucgacgucauagagauacagggccccuguaucagucacugccagcagucgccaagagccagccagagucacagccuugaguguaccuggccuacuacgggacuugaagcagagagccgagacccccaauccccgguacccacgcccuaccaagugccacagccgaaugccugagucaucacccccagugaucacccaggccugccucucaugggcagcuauggcccggaucccacgucccugguguccccgaaaggccuggaggaucucaccuucauggcuccacaccaagcagacacaauccucuccugcacugauaagguaauucucuagaagcuugaccugccacacacgggcgcugugcccaaagcagugcccaauauucugcacccgacccccaggcacucgcaggucgcccaccuuccagauacgaacgcuucggucuucugaagcuguagccagcaaucccuugcuuuccagguaugacaugcugaagaugaugcccacaugcccacugauucgucggucaggugcuacagguuuguugucugcuaaggcaguugcuggguaccagaccaagagcugguuggaaacagcaccugccacuauggucagcuccuuccaggcgucuccaaucaggcaggcugaagagagggugcaccugucugugcagggcaccucuugcaggaugcacccuacuacagggucauauagcaccacugaguuguggcccagggccaaggcuauauuucccucaagccagcgugcaucccaaauccagucagacauguuccacaggccagagcgccaaagcucccagaaguggcccuguccccagcuaauuuucacaacucggagucccuugcuuccaaacacagccaccauggccuccaagucaaggucuccauuaggcucuggccguacccggaagccauggauaagauaguggccaagcagguucugcacucgcuuuaucauccgcagaugcccaccaaaguccaagcuguacaccaggacaucgggacccucaccuagauagaggcaaagagccaugucagagcuagguaccuaacucugaugacccacagggaagagauggggaucagggaaacuucucggcauguagccuaugaaugcaucaggacacacaauccugcagcuugaaucuuagaaaauccuuggucucggccgggugcgguggcucacgccuguaaucugggcacuuuggaaagccaaagccagacucugucucaaaagaaaaaaaaaaaaaagaaaauccuuggucucggccaggcacgguggcucacgccuguaauccuagcacuuugggaagcccaggcggaugaaucaccugaggucagggguucaggacuagccuggccaacaaggugaaaaccccaucucuacuaaaaaauuagccaggugugguggcacgugccuguaaucccagcuacucaggaggcugaggcaggagaaucgcuugaacccagcggguggagguugcagugagccaagaucauaccacuucacuccagccugggcgaaagacucaaaaaaaaaaaaagaaaaaagaaaauccuuggucucagcuucagcuggacuuucagugcugacuuugugcuucccucaucagucauucuuuuuuuuuuugagacagagucucauucugucgcugaggcuggagugcaguggcaccgugcagcucacugcaaccuccaucuccuggguucaagcaacucuccugccucagccucccaaguagcuggaauuacaggcgcccaccaccacaccuggcuaguuuuuuuuuuuuuuuuuugagacggagucuugcucuguagcccaggcuggagugcaguggcacgaucucagcucacugcaaguuccaccucccggguucaggccauucuccugccucagccucccgaguagcugggacuacaggggccugcccccaugcccggcuaauuuuuuguauuuuuaauagagacaggguuucaccguguuagccaggaugaucucgaucuccugaccucgugaucugcccgccucagccucccaaagugcugggauuauaggcgugagccaccaagcccgaccaguuuuuauauuuuuaguagagacaggguuucaccauguuggccacgcuggucucgaacuccugaccugcggugauccacccaccuuggccucccaaagugccgggauuacaggcgugagccauugugcccggcccccucaucagucacucuuuuuuuuuuuugagacaaagucucacucugccgcccaagcuggagugcuguggcgcgaucuuggcucacuacaagcucugccucccagguuuacgccauccuccugccucagccucccaaguagcugggacuacaggcauccgccaccaugcccggcuaauuuuuuguauuuuuaguagagacgggguuucacuguguuagccaggauggucucgaucuccugaccucaugauccgcccaccucggccucccaaagugcugggaauacaggcgugagccaccgcgcccagccucaucagucacgcuugauguucacuucaaccacaaauuucucaaacucagagccuccuccucaccucacuuuuuuuuuuuaauuaaaaaaaaaauagagauggggccuggcacaguggcucacaccgauaaucccagcacuuuggaaggcaggaggcucgcuuaagcccaggaguuugagaccagccugggcaacagggcaaaacuccaccucuaaaaaaauuauacaaaugagcugggcauaauggcgcaugccuguagucccagcuacuugggaggcugaggugagaggaucucuugagcccaagagguggaaguugcagugaccugagauugcaccacugcacuccacccugagcaauagagcaagacucugucucaaaaaaaaaaaaaguaaaauaaaaugagaaggauuuugacaaugcaaaaagaaaauaaaagauguaaaaugagaaagucuaauccagugguucuccacagggggcaacuuuccccacaggagacaucuagcaauagcuggagacacguacggcugucuccagggguugugcuacuggcaaguaaggccagggaugaugcuaaacauccuacaaugcacaaacagcauuccaacaaagaauuaucuggucuaaaaggucaaucgaggcaagauugagaaaacccuggucuaaucuaacaagacugggugaguguaaggggaggccaacuugaggacacaauauuuagaguuaggauucaaggauaagcagcaguuagccagaggaaaggaggcggaagagggggacugggaaauguuggggcggggggggggggguggggagcaaugggaggguuugcagcuuucuugguggagaaaacagcauguaugauugcccugagaugggcaagagcauugaguaugguggauggaacaggaaaugaagagcucaggaagaggcuagagaggccggguaugguggcucaugccuauaauuccagcaauuuggggggcugaggcaggcgaaucacuugaggucaggaguuugagaccagccuggccaacauggugaggccccaucucuacuaaaaauacaacaauuagcugggcaugguggugggcaccuguaaucccagcuacuccggaggcugaggcaggagaaucacuugaaccugggaggcggagguugcagggagccgagaccgugccacugcacuccagccugggugacagaggaagacugucucaaaaacaaacaaacaaacaaacaaaaaacacacacacacagaauuguagcuauauaaaagucacuuuggaagccacagaaguaggugaauucacuugcagagcuucuuaaacugcauuucccaaguuauuccccaccuuaaaacccuucaauagguucuccccacugcccuuagggauaaagucagaucaaggccugaaacaauguggccucugcucgcuuguccagcuuccuuuccucccagacuccauuccugcucuaacuucacaagaauucccuccuucccccaaaaugacagauucuuccagccucaaggccuuuggcaugcuuacccucuugccaggaacucaccccuuuuccuaguucacucuugugguucuuugaguuucugcuucguuguucccccucaaggagccuuaggaguuuagcucgcgguaggaacuccgcgcuccaagaacccccacaccagaucaaaacuggaucauccccaccccauacacacacccucuuaggacugguggcaacucacucaaggccugaccgccaaggcccugccucaggacccuuauacaacucagcagcaccaacaugggucauuaguggcuucauguaaugacuguucgagaccagccuggacucugacaccucaggucccaggccucgccuguccuuugcgacccgguucuccuuggagggaccuccacaccugauuuccuggaccucaaccaucucaggagggggucucagccccugcuuccccgggcaccgcccccuacucggaaaggucuuauccgccguuuuccgcgacgccacccuccucagaggaucuucacccccaccuuagggggaagagacucaucccgcccucgagaggccacacccuugcccucucccggccccgccuuccccaagaggccacacccccugaggggccggggccgccuccgccuccuccuccuccuccucccuccgccccccccagcucggccccgucuccuucggagaggccaagcccccgcccaucuccuagaagggagcacacccccucaacccucagcucccgggccuccgccuccgccuccgcgcggccgcguuccccugcacccucccgcgguuccacccgcccuuuccacgcgggcugaaguuuaugaagcgccgcggcggccacaucagcuuugucucucgggccccgcccucuucagguuggcccucguccccgccaucuccggggcucccuucccaccuccgaucggccucaaccugcugcccguccuucuccucagggcaccccuuuugucccuguggcaccgccccugggaggcgcuguuucuuucccccuuuccaccaggcgugccucaagccaagccucacccgccaacagccggucccccacgcacuccagacccgucacugggaggaguauaagcuccgagguugcccgcggccaaacguaguccucgagagcguccaugucgauccucgaggugcugaggcagccacggcuaagaagggagcugaacucucgcgagaacgagccuucccagcgcgccgcgcugcccaucaacagcgcccucagcuacagguagcagagaccagggcgcccgcggcgguuguccaau

SEQ ID NO: 16142 - RNA, 1549 nt, Homo sapiens
uaacacagagacaguccacuacaaacugggaaguuggucacucuagcagauggacagaagacuggaugugaauagacggaaagagggacaaaagagugccuguagacgguggacaaagaaaugguuauagauacagacagacagauuauuagauauggaaggguggacagagaaguggccauagaguuuucuggggacugguggaugacccagugcccaacccagcucccaccaagcaccacaccacagggcuugucugaggcucauuugucuugggccuguguuggacagaagggcucucaccugagugaaugucagcauagcugugaaaggcaaaggagaggguuagugccacugagaaugggcagagccuccuaccugaucucugcucuuucuguaaaggagaacaauguugcagcccuguguacugggcauuugcaaagguguaaauucacucauacacuuuuuaauucaacaaguauuuauuaagcacuuacacucgguauuggaaauacagcagugaacaaaaaaggaaaauaaauaaauaucccugaccuuauaacaguggauaggagagacuucugugagcagcuccucucaccuuagcaugugguuuccagggcuccauguccuccugguuuccuccagucucaccaguuucucaucuguguguuuucucuuugucuacacucacucuuccaaaaucuuauccaggcucaugacuucaaaugccaccuacaugucaaucacuccuaaaaguguuuguccaguccagacccuuccugaguggcagauucacuagucccacugucaacuagacaucugcacucugacuuccaguugcuggcaucucaaacgcaacuugugcuacccuaacacuggcucauccgccaaaccuacuucaccccacuuuccccaaauugagugauagcaucucagcccuucuuauugcucaagucaaacaccucaaaguaccccuugacuacucucuuucccaucuauauucagugcaccaggaaggucugcugucuccaucagcaucaucuacccagaaugaaaucacuucuugccaccuccauaccuuucacugaguccaaacugccaccauuucucuugagugcaaugucacagcugccuccuggucuccucuugcugccccugaugccuucagucuguucugcacacaucagccugugaauacaugagucagauccucccauucccugcucagaacccuggaguacuuccuccccaagggaaaaccagagacaucaggaccuucauaauucccuaucacccccccgacuguaucuccccggccagcuuuuggccuugcugcucaaucucccaguguuccucacacaucacaccccaugcacucuccugcacaguguaugaguuaugguuguucccaugccuggauugcacagauuuccaaagagcugcaccccagcucucagagccccucauuucagacuguaaccugccccacucugcccccagcacucaguaccaccuuuauccccucauccuggcucuauauguuucc

SEQ ID NO: 16143 - RNA, 12315 nt, Homo sapiens
cggggcgggacaaccgcggcgcggcucggcgcucccggccuggcguuguggcgccgcagcccuugccaccuucccugcaccugcccugcccggccucauguaccgcgcgcuguacgcguuccgcucggcggagcccaacgcgcuggcguucgccgcgggcgagaccuuccuggugcuagagcgaagcagcgcgcacugguggcuggccgcgcgggcgcgcaguggugagacgggcuacgugccgccagccuaccugcgccgccugcaggugagugcgccccuucccgcccggccuccgcgccccuggggcaggaccccuucacagccccgcggaaccgacccagggaccccacccucuccgggacccgaggccaggaccucuaucagacagggaguuugagaaccugacccugagacccccggacccacggggacugagaccccaagugucagcaucacccacaaaagaccaggcccuugacagaccaacucccgaucgaccaaaagccuaacucugggacugagacuccucaggaccccagacccuucaguaucgaguccgccaucugaauggcgacccugagccccaccgaauccuggccaauuauucaaaucccugagaccccagauccuuaauaugccccuucucuggauuccuaggaccccacaaccaaccucccucccucccucccucccucccucccucccucccuuccuucuucccccaaccccgcgccuugccccccguuggagccaccacugagaccuggaccaccuuggacaccaccuguuucccuagccauucuccagguccucaaccccccaacuuggacccuagagccauagacaccuccauccccuauguaacacccaagcuuugguacuucagugucuuucacuagccuguguucagccacccucuaagcucuucuuaagucucuaccaaccuuauuugaaccaaggacccaugccccugcugacacugucugcuccacuccccaacccugacuucucaaacuuucuugcuuugaaaauggguuccaucccuacuuguucccagccuggaguggggacugcucacauugugaugaagugaguucuuauagcuucuccuggucugaucguggccccauuuccuuccaguggaagcugcagucccaguuccuguuucccuaagaguagcccugcugcggggguuggggugcguaucuccagcuggucuauucugaccacagggggaagaagggcccagagcugccgggccugugccagacacccccgccccguccuaguccuuauccuuuaggaaacauccugucccagcccaguucaggacagaaauaacgggauaaauuuggaagugucaucuggucuuaccaggaaggaugggcccugggggccuaggggcuuccucauagacccuuggcgugaucccaucuaggagugccaggggugggagugggggccguggacaccauggcugcugugugucagacccaaccuuuuugggaauggggucucauugaaggccucugaggaaaaguccugucucuuccccuacugggcauaggucaagggccugugaguccccugccgccagccaggaccaguggggcaagguguuuggggagggcagagaggcuaccaucuucucugucacugucuguuucuuucugcgugucucuuucugucuggauugcugcgacucugugccucucugccugugucguuccgacuccacauguguguguuuuuguuucuuccuccggcuccccccacacucuggcuuuggcucuguuucuuucugcguuguuucccucugucugccucuccguuccucucugagcuccucucuuuccccauuccuuucuuucucucucucucugugugugugugugugugugugugugugugugugugugugucuucaugucuuucuaucccccugucuccucucccugcacucuggcacaccucauaccaccuggagggcuuugcugaccucugugcccaccugucugugcccaucagggaagcuucucaaacccaugguggaaugaguucaucucagcuccgggacuccuauguagccugauggacuacgugugccagggccaggggagggcuggggguagcugguuugauagcugcuacccuacacuccccaugucagauaggcagaguagacuggaucccuggaauguuggggauggcaguacagagccuggaacaggggcuaggccccucucucauguuuauccuuugccacaaacacagaacugcuucccaggguggguuuggaagcuuacugagacaucuuguggggaugagggccagcagcaggguuggggagggcaagucccuuugacccauucucagcucccagggcuuacagagggcccuuacaaggacagggcuguucugggguaugaccuugguuuugugaaagaucagcaagaugcagagugauguauuaaggauuccagauacuggagacuuccuguuuggcaucucaaccugggcucugagccaagaccagggauagacgagguaugcgcuccuggcugcaagcugggagccccugggcuauguuuuugcuuuagaccucugauuuucagaaacaucuuagccaagagccuugcugugggguaaaauccugaucaggaccuaauauguaauguggcagcaugggggucacccugugccucagcucccugagugauacaguuugagaaccccauuccauauucugguucaacuuuuugugcuaugucuagcauuccaggcuuucgcuauauugguucucugcccuggguucuaucucgggcugggccugggcugagcaccuccguuuggccuucaggucuaacugcuguccccugccccccccagggccuggagcaggauguccuccaggccauugaccgggccaucgaggcuguacacaacacagccaugcgggaugguggcaaguacagccuggaacagcguggaguccuccagugaguguugaggggagugaagugggaccucccggugagcaugguggggugggguucuucaaugagugucauggggcaggugggccugggaaaugcgaggguuggcaaggguggugggggaauggcaccucccagugagcaagguggggucggguccuucagugagcaccaggggugugcagagcgcaggacugaggauaguaugggguacuguaggcugggguggagcauggaggagauggggaugucugaggggccugggcuauggggucccagcaucccacaggggcauaugaggacuuugagcugugagaugcaaccccccaauagucuuccuguccuuccaucaggaagcugauccaccaccggaaagagacccugucacgcagaggcccuucagccuccaguguugcaguuaugaccucaucaaccagugaccaccacuuggaugcugcugcagccaggcagcccaauggggugugucgagcuggguucgagcggcagcacagccuacccaguucugagcaucuuggggcagauggaggccucuaccagguguguggggaggacaucguggagaagggagguggguggaacuugaggcuucauccagaggcucaagggguccacucaggagugaugcggcccagagccauaguccugcccacagccagggcucagggcccgagccucgcugacgcucuagaugucagucuguccuccaagauccuacuuccaucuuccagaucccacuuccaucuucccagaucccaccacagccucgccgagcagcacccaccacaccgcccccaccagugaagcgccgagaccgcgaggcccugauggccucugggagugguaagaaggcaggguuaggggaauucagguggaggcacccuaugcuuggaaugguugugcugccugugucagggaaauggaggcucuaagcuggggaagaggacaggacucccauuuuggggcaauuaggggcucugggcuuugugaggaggcagugccuagcagagaaacuaggcccuguguuaggggacaggggaucugggcugugaaggguaugguuuuccagggggcugcccuggcccagcuucuacucacugcucgcagguggccacaacaccaugcccuccggggguaacucuguguccagcggcuccucagucagcagcaccucccuggacacgcucuauaccagcuccagcccaucugaaccaggcuccagcugcucacccacacccccaccugugccccgccgaggcacccacaccaccgugucccaaguccagcccccucccuccaaggcaucagcaccugaacccccugcagaagaagaaguggcaacugguacaaccucagccucugaugaccuggaagcccuggguacacugagccuggggaccacagaggagaaggcagcagcugaggcggcugugcccaggaccauuggggccgagcugauggagcuggugcggagaaacacuggccugagccacgaauuaugccggguggccaucggcaucauagugggucacauccaggccucggugccggccagcucaccagucauggagcagguccuccucucacucguagagggcaaggugagggugggcggcacagcagggccacccugcuacccacccuguucccaccgucacacacuuguccagccuguacauuacagguauuucucaagcucuggcucugagcucuuacugugcugggcacuggggacguugagcugauuucugaagcagaaaggaaggacaagcauuccaggcagaugcgcagccuggacaagggccacaaggcaggacugagccuggcuugugggaggaaguggaacaaggccugcaggacuggaacacagggagugagggagugggugcuguaggaggaggugagaccuggggcaggugacagauaagacgacaugcggguggccaagaguucugucuggcugcagggaaggaauggacacggcgugggugaggguagugccuugcugaccuuggcaguaagagacaugggugcugggagagcugggauggaguccuaggugcugacauggaugagagggagugaggugugugggcaucaugggaugggugggauccuuggcacucaugagcaggaugggggcagugagcccagcauacaugaugggggucagacagaccaaaggucccucuuuagugcuccaugguuccuguuacacuucugguuuggguguuggggagugggccaaugggcuuggcugugcugggcacaacagcuagugccuggucagcaggguucaaggaaaauguggcaaguugguagaugacaggccugugccauuuuguguggaaugggagagugaggucucagagucacauucuggcagugacagaguucauggcccuccuaguuggggguguuuauccaggucugggaugagaggcgagcuguugaaaacccccuacagaugagucucccguugacuccuguccugggaggucaucaagacuggaguugagccuccuguccagugugggccaggagggacuugaguucauggaguaaaaguccacagauggacucuccaggccuuggaggcucccuggagauggugagggcagggagugugcugagucaugccuugcccucucccucuaggaccucagcauggcccugcccucagggcaggucugccacgaccagcagaggcuggaggugaucuuugcagaccuggcucgccggaaggacgacgcccagcagcgcaguugggcacuauaugaggaugagggugucauccgcugcuaccuagaggagcugcugcauauucugguaaggguggggucccacacacauaccccacauggggaacaguggcccccacccuguagcaucccucacagugcuaggagucuccccuacacauaugugcucagcccucucuugugcggcugcacagcuccgcucaugguggcugaugcucucacuuccucauuucuguagacugaugcagacccugaaguuugcaagaaaaugugcaagagaaacgaguucgagucuguccuggccuugguggccuauuaccaaaugguaugugcaggauggaggggagggguaauggagagaccuagauagugggggaguuccaggcacugagcacgcaggguucccugccaggaacaccgagcaucacugcggcugcugcuccucaagugcuuuggcgccaugugcagccuggaugcagccaucaucuccacgcuugugucauccgugcugccuguagagcuggcgagggacaugcagacagacacgcagggugaggcuggagggcgggguaggagggaacuuccugcuaucuggaggguguuccugccaucugcugggguuuccugccaucuuuggggacucugacugccugccuugucccccccagaccaccagaaacucuguuacucugcccucauccuggccauggucuucuccaugggagaggcagugcccuaugcacacuaugguaagaaugcaguaaccgaccagcugaucacagguccuaagccagggcccauugcccgagggccugggaccugcugacuacacagccuagcagggagaggcuauccccaaggcucacagaaagccaggaaggguggguggugcgggggucggaggggaauggggcugcagacuucugugcgccccucucccagagcaccugggcacgccuuucgcccaguuccuacugaacaucgucgaggaugggcugcccuuggacaccacagagcagcugccggaccucugcgugaaccugcuucuggcucucaaccugcaccugccaggugggguggggccuggcugggcgguggcugagcacaugguggcucucaggcucagcacccugucuauacccauguccuuccuuagcugcugaccagaaugucaucauggcugcccugagcaaacacgccaaugucaagaucuucuccgagaagcuguuguugcuccugaacagagggggugagggcccgggaaucugcgcggguaccacuuccaugcccugugacuccaugaccccugcaaugacucccguaacccccuggggugacucugggauccccacaagguccacccugaccgcuaugaccccugccuccuagaugacccugugcgcaucuucaaacaugagccacagccaccacacucuguccucaaguuccugcaggacguguuuggcagcccggccacagcugccaucuucuaccacacagacaugauggcucucauugacaucacugugcggcacaucgcagaccugucaccaggagacaaggugccuggagguggcugcagcagcgggggucacuguguggaaacugaaacaaaaugguggggggcaugacauugaguggagaugagggggcaaggccacugcuggagccagguaaguguaggaggccaugauaggugcaccaagacccaaaggagccagccaugaggugaucuggaggugguggggcuggaggaggcuggagaggagggaguggagggagaugaggcauggaggauggaguuuacacaaagccucggaggcugcugcaagagguugugaucucaggaccggggaaugugaugugauuaacaucccacauggaaucaacugcaugccagcagaguggaagccagccagggaggaagcagccucagugguccagguggcauggaugggguggggaugggauaggucguggcaguggcaguggcgagaagaggccagcuguggaguguuuaguaaguggaucuggcagggcuugccacuugauuuaucuugagcagcuagauggaugaagugcugauuuuugaaguuggggaggcugggagaacuucuugggggaaaauagagagucguguuuugaaugugucaagaaugaggagauaucugcuagacacccagguaccgagggcaucagggaggcaguggggaaugaguugagacuagagagacauuucggaguggucuaugcagagauacgaugggaagccugugacaaugugauugccucagaaaugagauagauaggcaggucagcgggaaguucgggcugcagcccugggcacagcugaaacaacuagggagaaacccaggaagagaaccaagaaagcaggagcccaaagccacauguuuagaggaagacgaucagccaucucuauaccguuaggagccugagcgagacugggguuggccauuggauucaccacacagaggucaguggugccugacaagcagugucaguggggugcaaggaggagagucugaaugaaaguuugagagagcuugaaguuauuggggaguagaaaugaggggaggguuggaagcaguaaauggagacaacucuugugaauuuucuauuaaggggaagagaaaaauggaagggagguugcuggagagagaugacauggggauagggagaguguuuuuuuggggguuuuuuguuguuguuguuuguuuguuuguuugucucccacuguugccaaggcuggaguguaguggcacgaucguggcucacuguaaccuccgccuccugguuucaagugauucuccugccucagccucccaaguugcugggauuacagucacccacuaccacacccagcuaauuuuuauauuuuagcagagacaggguuucgccauguuggccaggcuggucuugaacuccugaccucaugcaauccaccugccucagccucccaaaguguugggauuacaggugugagccaccgugccuggccagggagaguguuuugaagaugggggauguuggccaggcgcgguggcucaugcuuguaaucccagcacuuugggaggcugagguggguggaucacuugaggucaggaauucgagaccagccuggucaaaguggucucuacuaaaaauacaaaauacgaaaaauacaaaaauuagcuggguaugguggugggagccuguaaucccaccuacuugggaggcugaggcaggagaauugcuugaacccgggagguggagguugcugugagccaagaucacaccacugcacuccagcuugggugacagaugggggauguuggccaggugcaguggcucacgccuauaaucccagcacuuugggaggccgaagugggaggaucacuugaguccaugaguucaagaucagccugggcaacauagugagaccucuguauaaccugauggaccacaguagaaaauaaaauuagcugggcauggugguaugcaccuguaauuccaacuacuuuggaggcugaagugggaagauuacuugagcccaggaggucaaggcugcauugagccaugauugugucauugcacuccagccugggcaacaaagccagaccuugucucuuuaaaaaacaaaaacaaaaaugguacggaugauggugcauguucugagccggagggaaugauccagcaagcacagagagauggaugauguguuggagauggugagccaccacaggagucaaguggauggggcaggaggggagaguucagguccaggcccacauggacaggagcuagggcugcucauucugguagggacaggugagauguggguacugaggggaaagacggguuucugcaagauuacuucuguauucucuaugaagcacaaggccagcugacaagguagguagguuucaaagacagagaagguggacauuauuacuacucuaagggagagugacacagcagagaaaagcagugggaggcucaggcagugcuguguguccguuugagguuugcgguggugaaugacauucaggccugcacauggcucugcauuugucuauagcuuagacgcugguguuugaugugcaggcaccucaguaugacucccagggcugggacuuagcagggugugcugccuaaaggagguuuugguauuauuucucuaauuaaagguaaaaagagaaaugagggauguugagggaagcagacaucaggucaguggacugggggucucugugagaacaagcugucaagucauaagggcuggccgggcguggugguucacgccuguaaucccagcacuuugggaggccgagguggguggaucacuugaagucuggaguuugaaaccagccuggccaacauggcgaaaccccgucucuucuuaaaaaaaauacaaaaauuagccaggcauuuuggcacaugccuguaaucccagcuauuugggaggcugaggcaggagaaucacuugaauccaggagucagagguugcagugagccaagaucaugccacugcacuccagccugggugacagcacgagacccugucucaaaaaaaaaaaugauauauauauauauauaucauauauauauauauauaugauauauauauauagaucauaagggcuguuggaacugguucagccagagguguugggaguauagguuggaggagaggcuguuggagaugaauuuggggcauauguaggagguaggauggccaggucuuagacauggcuuggauaugagguaugugggagacaagaagcaaagaggacaccauauuucaggccugugcuuuugaaucggcaacagugcucuuucuaaagguaagaacaugagaaaaccuucaacucugggaggaugggaaagaucaugaguuuggugguagauauguggauuugaggucugucacaugugcaggagaugucaagugggcaguugaauauucuugucuggagcucacaggggaguucuagguaagagguaugagagugguucacuauuugaagcugugaaugugcacgaggucuuccaggguaagagaggauagggugagaagcagagggccucugacugauagacagaggcaccuugagagacccagcuucaaaggaugggcaggacuucccugggcaggccacauacuuggggcugucuguggcugggaugauucguuuauucgcuuacucaaaaacuauugaagaccaauucugugccagguauauugugggugcuggggaugcagcccugauguucagguccacagcccuggggucugugggacagugggguccugucccuguccaguggugguugcaguaccucccuggggucccugagcuggccugcucuucccacagcugcgcauggaguaccucucccugaugcaugcuauaguccgcaccacacccuaccugcagcaccgccaccggcuacccgaccugcaggccauacugcgacgcauccugaaugaggaggagaccucaccccagugccagauggaccgcaugauuguccgagagaugugcaaggaauuccuggugcugggggaggcucccagcuagcaccuugcuguccucccuucccugcagcuccagucagugugcaggggacucaggggcuuggcccuaagaauguuuugcacugacagugggaggggauaagguggcagaaggaaccugagcaggacccccaccugaaguagaacuuaagagaggggccaaguguaggauuggggaccauggucugggagcuguucuggggcagggggaauaugcaagcuaaagccccucuauacccugguaggcuuccucuucagcaugccccccucuucaccccacacccauguguacacucagaguccugcugccgcuccaggcuggaccagacccccauccccaccccuccuggucuguauccugggccucagcaagccaugccccuggggugaggggaggcaucucccaccagcucuauucuuugccuuagcuuugcagugagugcugcucauguccuccccuccacccgcacaugggggucgcugcccuucacuccuacccccagaggccuuggccaagcugcugcuuugaaagcgggaucuuggagacaggccauccauccuggagccucauggaacaggaugauggcacugagaaagccaaugaccgaaucucuuuucucuguaaaaauguagacugaaaagccauguguauuuuccuaugugcuguagcucuccuuuggaaauaaaucacaggcaucuggaaacaggcuucccuguaugaucuugggagacagugggagaggaugggcagaaguacuggggccucaggaccccaucacugcagcuugcacugacuucuccagccugaggaggugauggacccugacaggccuggccuucaaggcccuuugagcccuguucuagccucucuucccugagcuccacuuuuccugagccccagccauagccaagugccccucagcagcccauucgcaggugucugcaucuccaggcuuca

SEQ ID NO: 16144 - RNA, 1484 nt, Homo sapiens
cacuauacggaccggccuccaaaggcggaaucgauaacgagcugcagcgccgggugcagaggacgcgggcaucccgaagcccaggaagaggucagggccgggaccccagaacgcuccacagggugcggcucccgcgaugggguggauccugguucuaacaggcgaggaacuccuggccaaggccucuggcccgccccgaacggucccuaugacaucaccaucaaccaaucagucggcgcauccuuucgccccuugacugcuccgcuuccgggaggcggggcuucugcggguuccaccucccgagcgccccuuguggcuaccaaggucaggcaacagguguccaguuguucccucuccugucuacgaaucugaggaccuccccaggaucagagcucugggccugauacacggccgggguuccuacggguuugugaguggggguggaagaucugcagaggcacuuagggcugaacuccuuugaaugggagccaaucggugcaggggcuggaggagcgagucccccaaaguaguuuuauuuaucuauuuagagacaaggucucacucuuucggagugcaguggugaucacagcucaccguagccucgaacuccccaggcgauucucucaccucagccucccgaguagcugggacuacggguacaugucaucacacuuggcuaauuuuugcauuuuuuauagagacagggucucaccauguaggccagauuagucuugaacuccugggcucaagcaauccgcccaucuuggccucccaaagugcugggauuauaggugugagccaccgcgcccggcaacccagaagugguuuugacagcaccagcgcuuucuguguccacaaucuagugaguagagggcacaaaaccugacaccacggaggcagacaggcaggggcucugccggggaaggguguuggagucccaaaggaggcgucugagucaccuucgcaaccugggacgccuucuugcauaagaugccugagcagugccuugaaugaccaaggggagauccgcaucugcaaaggaagggcagggagggauagggauugggggugggcauccuaggucuuggagacugugugggcaaaugugcagagacauaaagggacuauggcugagggaaaucaagcccugcccucucaccaauagggcuggcgcuggucccagcuaacacuccuuuuggagagcaaagcuccucacuucugaguagugagauugauugcggaucacucuccauguugcugccugcugugugucaucccacugucauccucccuuuguggcuguucuguggagccccucucccucaaucugcacucaccucuaugccccagccccauuggcagcuccuaaugcacucccgguaaaaaaaaaaaaacaaaaaccagauguuagugauaguggugguaguucuucucuccaccuccaaaucuugcccuugccuccuaauaagaccccuaugugguuu

SEQ ID NO: 16145 - RNA, 31246 nt, Homo sapiens
cucugcccgagagacugcagcggcggcggcgggagcgggcggacgcgcaggcaagaccaggacucgggcuggaggggcgcugggcucggaccugccaaggccacgggggagcaagggacagaggcggggguccuagcugacggcuuuuacugccuaggaugacgcugcggcuucugguggccgcgcucugcgccgggauccuggcagaggcgccccgagugcgagcccagcacagggagagaggugggcaccgcaagggaggacccggcccggggcacugcaccgugccacccuccgcuccacucggccuucauccccaacaccccccgcccacaacccagccaacuccacgacgccccgcggauuccuccuaauucugggacuccccgaacccuccgcgaucggugcuggguucccuaaaccgccuccuauccuguuccuacccaaauucuggcucccuggaugcgugcgggguccccugccuuaugccaauccacgccggccccuagaggcugaccucagucccaaguccacacccgugcuggcgacucucccucccccgcacacccccaacccuccgcgggagucugcucugggacccaccgagcucaacucccuccaaggcccucaggcucaggccgauucggcccugguuugcauaagaugaggccuacucuccccaccaucccaagucccagugaggccaccgugcggguaggcgggugguuggccucccagaagaggcccugaucucuccugcccgccccagugaccugcacgcgccuuuacgccgcugacauuguguucuuacuggauggcuccucauccauuggccgcagcaauuuccgcgagguccgcagcuuucucgaagggcuggugcugccuuucucuggagcagccagugcacagggugugcgcuuugccacagugcaguacagcgaugacccacggugaguaggggcccugggggcuggggaccacgagauccccaccaagacuccuuccccagagagggaggagacccuggaaaccccaggccaggucuuugcagaaacaaguuuuggggaaccuagagacccccuagccaggaccuccuuuggagacagagguaaggauucccuagguagaaccuucgugcccugaggcaccuccaggcuacugcaagacaggaaggugcaagacagugaggcuguguuuucugaucuggagauggggagcccaggagggggcccccacgccuguuggauucuccacguucuagcccucuaacccuugcagccguucaccagaggugcuccaucuggccagcauccacuuuccuacaucuggaccccuccuccugcaauuauuuaauuaagcagcaucuuguuccccacagacugugagccccuaagggcuccuucaggucugcccaggcccaccugcagauggugcacaaaggagccccuggggaguuuguuaaccuggggguuccagaggcaaguggguguggagaaugacagaacgaagggaccccucaagagagccugauacccguaacccucacccuagaggccuccucaaggccagggccagaagagauccugaguccuagccuguugccaccccuacccuccaacaggacagaguucggccuggaugcacuuggcucugggggugaugugauccgcgccauccgugagcuuagcuacaaggggggcaacacucgcacaggggcugcaauucuccauguggcugaccaugucuuccugccccagcuggcccgaccugguguccccaaggugaucccuaccccuaccaugccucccaagaugaccccaaaugaaguguccaggggaaccgugauuugaccccugcaccugucccaggucugcauccugaucacagacgggaagucccaggaccugguggacacagcugcccaaaggcugaaggggcagggggucaagcuauuugcuguggguaaggaccgagcaggagugacaggucagcuggggggugggggcagucagagagcaugugggugacugaguccugaugggucgucacuucagggaucaagaaugcugacccugaggagcugaagcgaguugccucacagcccaccagugacuucuucuucuucgucaaugacuucagcaucuugaggacacuacugccccucguuucccggagagugugcacgacugcugguggcgugccugugacccgaccucgugaguuccugcccacacgguguacccugaccuagaccccggaccccaauccccacuuggcagugcugauuccauccuaugugcuccugaccccgaccccaacucugcaucauacaugcccaccccaauccuccugccugauccccugaucccgcauucccagcggaugacucgaccucugcuccacgagaccuggugcugucugagccaagcagccaauccuugagaguacaguggacagcggccaguggcccugugacuggcuacaagguccaguacacuccucugacggggcugggacagccacugccgagugagcggcaggagguaggaugucaggagugauaggugguggcuggggacuuggcugggcaagauaaagugaccucuugcccugggcaggugaacgucccagcuggugagaccagugugcggcugcggggucuccggccacugaccgaguaccaagugacugugauugcccucuacgccaacagcaucggggaggcugugagcgggacagcucggaccagugagcaauucugccagccucugaccccauucaccuaacccccgaccccaguacccccucccacuucugacuccaugaaucccuggugggacucucccccagcugcccuagaagggccggaacugaccauccagaauaccacagcccacagccuccugguggccuggcggagugugccaggugccacuggcuaccgugugacauggcggguccucaguggugagugagagaugugggcugaggggaguccccgcgccucagacaaggcuguagaguccugagucugcaaggcccacuggccccuuggugucccccaugcaggugggcccacacagcagcaggagcugggcccugggcaggguucaguguugcugcgugacuuggagccuggcacggacuaugaggugaccgugagcacccuauuuggccgcaguguggggcccgccacuucccugauggcucgcacuggugagaaggcugggcacuuucuucaggcugggacgggcaggcagggcaaggcccggaggccacugacaucccaugugcccugggcagacgcuucuguugagcagacccugcgcccggucauccugggccccacauccauccuccuuuccuggaacuuggugccugaggcccguggcuaccgguuggaauggcggcgugagacuggucagugcgggggaagggauggacaggcaagggucagggcauggccucugcuggucugacccuguuaucuugcaggcuuggagccaccgcagaaggugguacugcccucugaugugacccgcuaccaguuggaugggcugcagccgggcacugaguaccgccucacacucuacacucugcuggagggccacgagguggccaccccugcaaccgugguucccacuggugagggcucugugggcugggccagugagugggggaggugucggagccccaggcugccucuaugcugugcucuccaacaggaccagagcugccugugagcccuguaacagaccugcaagccaccgagcugcccgggcagcgggugcgaguguccuggagcccagucccuggugccacccaguaccgcaucauugugcgcagcacccagggugagguggacgcagccagcacccccaccacacacacugaaguuccagccugaggggucugaguguaccuccagcccucuccuuccacaccugggucccuauagucuccucccugucucguuauccaucugcuucccaagauggcacugagcccugaacugucaacagggugugucugccccuacccuaccccaaccaaucuccucccugccccacaccccauccacggcuuucaccucugcacagccacaagcucaaucaccugucuuucuguuacccuaguggugaccacuguacaccaaccucucauugcauguccccauccagcacugaccucugccaucccacaucagugucugucaauggcucaucaguucucacugcaguccacugacuccugucauccuacaugcuaagaucccacagacuccuguccuccagugucccugaccaucacuggccccuuucauccuauguccuugucuugcacucacuuuuuucagccauaucccagcucucugguccccaccaccccacauccccacccccauggcccuucucacucugcgucccuguccaucacugccaucgucccacaucccugucucuuucugaccccugcccaccuacccugacuucucucuuagggguugagcggacccuggugcuuccugggagucagacagcauucgacuuggaugacguucaggcugggcuuagcuacacugugcgggugucugcucgaguggguccccgugagggcagugccaguguccucacuguccgccggggugaguacugcaggaggcuuguggaggacagcugccugccucacucugguccugguucugacuucugacuucugucuguaacuccuagagccggaaacuccacuugcuguuccagggcugcggguuguggugucagaugcaacgcgagugaggguggccuggggacccgucccuggagccaguggauuucggauuagcuggagcacaggcaguggucagugugggguguguggggggacugccaaagggaccaaugaggguaugggugccagaggggacaggcaggagccaugccagcauuucccucugaccucagguccggaguccagccagacacugcccccagacucuacugccacagacaucacagggcugcagccuggaaccaccuaccagguggcugugucgguacugcgaggcagagaggagggcccugcugcagucaucguggcucgaacgggucaggcccugcccccgucccuuggcucucugccuccauugcucuuucagacccccaugccuucccuugcagacccuugcuucuccccagaacuccugccucccccuucagaaucccacucccuccucccucagagacgcugcuuccucuucaguuucagcugucuccccuuaagcccuccccguauucagauuccuccgcuucucuccuaagacucccacagccuuugcccucaaauauccaccacuucaacccucagacccccaucccuuuuuugcuggacccaaaucuccucugagauuuacacuuucuccuccaucagaccugcucacugcuuccuaaaaccuccaccuccccacuccuccacuggaccuauucaccaucuccucuaucaaauucccgucuccuguuagacucccaucaucuuccccuaucagauagccccacuccuuccugccuguuccagcagacuccccauugccucuccccacuagacccacugggcccagugaggacgguccaugugacucaggccagcagcucaucugucaccauuaccuggaccaggguuccuggcgccacaggauacaggguuuccuggcacucagcccacgguggggacugggguuugggagggggcaggucaggguggaaugggggcuggggguuuauuggggguccagguggggcucuggggcacagaguuugcuagcccuggagcugccuccaucccuguucccaggcccagagaaaucccaguugguuucuggggaggccacgguggcugagcuggauggacuggagccagauacugaguauacggugcaugugagggcccauguggcuggcguggaugggcccccugccucugugguugugaggacuggugaguggacccuggccagcuacuagccacaccgcauuagcuacccugcccugcuguguguuccugauugcccagcugccuccaccccccugcucagugacuguccuguccacacugacccaccccacacugauuaaguguccacccacggugaccuccugguggccccacacugcccaccccaaggcacugaccuccuccuccucagggcugccuaaagugaccuguccacacuaaccucacacugacuuucagaucaccccugcgucaaccauuccugcacugccucucuguucucuaccaggaccccuuaccuugccucuguccccagccccugagccugugggucgugugucgaggcugcagauccucaaugcuuccagcgacguucuacggaucaccuggguaggggucacuggagccacagcuuacagacuggccuggggccggagugaagguauggcucccugacgccaccccuguccuuccuggcugggacugcucaccccuaaccauugcuguaugcccaccuggccaggcggccccaugaggcaccagauacucccaggaaacacagacucugcagagauccggggucucgaagguggagucagcuacucagugcgagugacugcacuugucggggaccgcgagggcacaccugucuccauuguugucacuacgcguaggcagagcaugcgcuggagagcuucggaugggugguguggaugguuuggggauccgggcuugugcucuggauuggagaaaggaccaggauugguagugagccuuugggggcagggucugagaggagggagaggggucugagaggcugggcggggugcgugugccagggugggccugggauuggugcaggggccaugggggcagagccucccugauuccugagcuuucucuccagcgccugaggcuccgccagcccuggggacgcuucacguggugcagcgcggggagcacucgcugaggcugcgcugggagccggugcccagagcgcagggcuuccuucugcacuggcaaccugagggugagagguguccccaggaggaaguuagggaccauugggggcagggcuguggcagacuccgcaagguaggcgaggacagugauggugggcggggucugucacugggggucugcgggauccgugacaguagguaagaucaaucaaugaagugggugggaucaaugaguucauggagggucagucuggcaggguccguaaagugggcagggucagugaggaugaggaagaucagucaggagggugaacccaguuaacagagccagugaagugggcaggcccuuuaaugcccccaggugucacuaucccacaugcucuuggcccccacccucacgccugccccagguggccaggaacagucccggguccuggggcccgagcucagcagcuaucaccuggacgggcuggagccagcgacacaguaccgcgugaggcugaguguccuagggccagcuggagaagggcccucugcagaggugacugcgcgcacugguaagccugccucaccuuggcgugcuccuccccugcugaugacccacccugacuuccugcaccccgacucugagugacuccuccuguaccccuaccccucacccucugacccugggugaccccagcaugaccucccaugaugcuucaauaagacaaaccggacccaggaucucagaucucucccuucuggguucucaggacucagccucugauccucgaucuuucauuccuccuucagagucaccucguguuccaagcauugaacuacgugugguggacaccucgaucgacucggugacuuuggccuggacuccaguguccagggcauccagcuacauccuauccuggcggccacucagaggcccuggccagggugagggggaggccaggauuugggugggcuggcaguuggggcucuguggagacagcuuuuuaaucaaguucugucuccugcagaagugccuggguccccgcagacacuuccagggaucucaagcucccagcgggugacagggcuagagccuggcgucucuuacaucuucucccugacgccuguccuggauggugugcgggguccugaggcaucugucacacagacgccagguauagugggcguagugggaagggcagaaaggugugucugggugggcugcccgcuucaguaacuuguuccccuuccuacagugugcccccguggccuggcggaugugguguuccuaccacaugccacucaagacaaugcucaccgugcggaggcuacgaggaggguccuggagcgucugguguuggcacuugggccucuugggccacaggcaguucagguuuggcccuggggcagccagauucuaccucucccugaggccccccacccaggcuccauaccaguuaccaucuccugaccacccaauagguucaggcauucucccagcucucucacaggcuccagaccucaccuacugccuggcucccuauccugccaucacugcugacucccuaauagauaggguuuggucacacacacccugauguguuucuccaggcucugugcacccccaucccugcucugucauccuccucaggcucuguguuuccuuccaccccagguuggccugcugucuuacagucaucggcccuccccacuguucccacugaauggcucccaugaccuuggcauuaucuugcaaaggauccgugacaugcccuacauggacccaagugggaacaaccugggugaggacugcagcaggcauggacuccuggggcuauccacugggagcuuggugccccaggguucugacauguccuuccuuccaggcacagccguggucacagcucacagauacauguuggcaccagaugcuccugggcgccgccagcacguaccaggggugaugguucugcuaguggaugaacccuugagaggugacauauucagccccauccgugaggcccaggcuucugguaaggaguaggcugauggggaaggggucugggaauagggguggcccugaaaaggcuaucaugcagccacuggaccccaccuuagggcuuaauguggugauguugggaauggcuggagcggacccagagcagcugcgucgcuuggcgccggguauggacucuguccagaccuucuucgccguggaugaugggccaagccuggaccaggcagucaguggucuggccacagcccugugucaggcauccuucacuacucagguuuggaagaggccucugggggacugggugguagaauauaaggggucuggggguucuugguagaaauguucaaccucaaagagacccuauguccgcagccccggccagagcccugcccaguguauuguccaaagguaagagucccucaucgagaggugaacagaggcugcaccuggggcuagccacucugacccacaucugacaugucuuuccccagggccagaagggggaaccuggagagauggugagugccccugcgggcggggaauagagaauggguugagugucaguggggcaggagagguuggcagcacaggucucacugauuacccuuccuagggccugagaggacaaguugggccuccuggcgacccuggccucccggugagugucccccacaucugucccugcacccugacuggcuuauccccaccuaacugcuaucuucuuucagggcaggaccggugcucccggcccccaggggcccccuggaagugccacugccaagggcgagagggugaguguggagaccaucgagguuucucugaggcacuccucaaagcugucucgggguuuuuacaagagagaaggaagaagcagaguuagaaucaucgggaauuccuagaagcccagcuggagguuauaaaccaccacagagacuuugggggacacucugaaauagaagggccaguggggccucuagccccgcugcagagccugagcagcagcuccaagucccagaggcagggaagcccucugccuugucgcugcccuugugccuggaauugggcucugugaagcucugaggggccauuucucugccucacuguuccacccccaauaacacuugggggucagugggguaggcgaccccuuguugauggggugaggccccuccagcaaaccaggggccuugggggagggucccuuccuguccugaccucuucaccuccucagggcuucccuggagcagaugggcguccaggcagcccuggccgcgccgggaauccugggaccccuggagccccuggccuaaaggugagcaagccuuguccugcaggucagggugggcgcugccugagugggugggguggcuccgacuguucugccucuggccuccauuugcagggcucuccaggguugccuggcccucguggggacccgguaaggugccuucccuucuuugcucucuaagugucuucccaggguucuuccacagggugggagccuggggugguggugcagugcccacguugacauucgccugagcccaagcaccacccucugcucuguuucguccucagggagagcgaggaccucgaggcccaaagggggagccgguaggugaagggggaagggaggcggccgggaugucccagggaggagcaggacugccccacaccagacccugugcagggccuaaggcgcgaauaggaauagcuggacaugucuaggggcuucuuccagcucaaggcccccauagccugaauccugcccacugcucucuguccuuacagggggcucccggacaagucaucggaggugaaggaccugggcuuccugggcggaaaggggacccuggaccaucgguaagugcaggguauguggaggcaagugauguguaguggggggaccaacacgaggggggcgagagugaggucugugggguugcaccuuauacuuugucuccuccaucagggccccccuggaccucguggaccacugggggacccaggaccccguggccccccagggcuuccuggaacagccaugaaggugacagccucaugagugccaugugaugcagagaccuggugaccccauuugaacccacauaaccccugccaguuacucuggcccuugugacccuuugauuacccccauccucaccaugacgccucaguucucccaaaauccuugaaauccaauuggaccccaugacccucaucacuccugguaucuuugggagugagguguggcccagggucauggggucgucaucuguuuucuagggugacaaaggcgaucguggggagcggguaagugagggacagguugugcuagggguggcuuggagucugauuccccuguucauucccugaccugcuguucucucccagggucccccuggaccaggugaagguggcauugcuccuggggagccugggcugccggugaggggccuugaggcucugcugggggcccugcucaggggugugggucucuccuggggcagugguugggugcugggcuucauaguucuuggcucauauuuuuacucacuucuuccuagggucuucccggaagcccuggaccccaaggccccguuggccccccuggaaagaaaggagaaaaaguaggaaggcugacuugaugaugucccaguucuggggugggaggcugcgugcugggggcagggccucccuucggucuucccacccguguguuucuccuucagggugacucugaggauggagcuccaggccucccaggacaaccugggucuccgggugagcaggugaguggaggggccagggauucugaauauggugggcacagcuccagccccuaccucaaucaucaaccacugcuccauccucaugcccaaacccaaaucucugaacccccaaauucaucccuuccagggcccacggggaccuccuggagcuauuggccccaaagugaguaccaguugggggauucaggugugaggggugcuacucugggcuccccaugguguuaggggaggcuggaagauaaggagauaagaguucccuccaggucagaggucgugguuuuggagggggugguuggaguuugggaccccuugucugggguuugacguucaagccccgccaccaacccucucucucucugucuuucucucacccucucucuucagggugaccggggcuuuccagggccccugggugaggcuggagagaagguaagugcaaccuggggggugccaagggcccuggaggaucugggcccaacucagcucugaccucuucuuuuccaucagggcgaacguggacccccaggcccagcgggaucccggguaaacccacuggcugcaaugcucauaccagcugaccuggcugugcccuuucugguucugacuucuugcccuugaccccugcuaccccugcuccucaccccuccucaaugaccacuuaucccugcugauacaggcucuaacccucagccccagggaccuggcuuugaaccucugacccugcugaacugaccuugauuuucacugaccuggucucuguucuccugccaagucuuaccccugccaaccuaaaucccaaucuucccugaccccucuccagcccccaccccagccucuagcccugucuguccauaucccccguccccacccaccugcacagcucuucccuuccucuccuccaggggcugccagggguugcuggacguccuggagccaaggguccugaagugagucugugacuguggugggaccaggagugggacuuuugugugucccuccccuuucccuuccccuccugggcucacacuuucucuacauucaggggccaccaggacccacuggccgccaaggagagaagguggguccucggcuggggguggcacugucugguacuagggauguggcagaugggacacugggauuuugggcuccuaggugacucccugaccugucccugcuccuauccucucuccacagggggagccuggucgcccuggggacccugcagugguggugagugacgggaggauggcgcucugagcacagcacagcccuugagcagugacccuccuauagaacacuaucugggcugugauuccacagugcugggcccgugagcaggcugggagcucugcggcucuccuucugcuagaaccugcccccagacucuuggcuaugauccugugaccccaagaccgccaugcaggucaugagcucuuugugucaguccauuuuguauaaccccuucccugcugucagcggugacucugugacuucugggcggggacugagcuguaugacuuccaauuccaugugaccuccauuccaaugaagacuuugaucauacaaccccaaggcagggccaagcuguaucuguccuguuuguuuucagggaccugcuguugcuggacccaaaggagaaaagguaagccugguauggggcaaggggagguuucuacaggguugaggucuaggucauagggccuaucuaugggacuuggggggucacaggacuugcugggucaggggguuaacuggagccugggacuagcacugauggucuuugucaccuccagggagauguggggcccgcugggcccagaggagcuaccggaguccaaggggaacggguaagugaagcgaaguguuuagggggcaguuggugaagguugucuuccugacuucuuauccuuccauccacagggcccacccggcuugguucuuccuggagacccuggccccaagggagacccuggagaccgggugaaucaaugugggaauggggagugugacagagggagaugagguggugggacccugacuaaguccugccccccuucuguccccuucagggucccauuggccuuacuggcagagcaggacccccagugaguacccguuacccugggcaaccucaaggcuucugggguccccuccccuugagaacugcuugcuucgagcguccugcaucaccucccucuugccuccuccacagggugacucagggccuccuggagagaagggagacccugggcggccuggccccccaggaccuguuggcccccgaggacgagauguaagaggcuggagucgggggagucauggcggguaagggaguagggcuguugccagcaucauggggguucuuggaaccagggcugacucucauguuucacagggugaaguuggagagaaaggugacgaggguccuccggugagacuccuucccacugugguuucugauccuuuacccuugaacuaggaucccaguaggcuggugcuccaccaguucauccauccacucccugccuccuguccagcugcugcucagacccuucucuguccccucucccugagugaguuagauccugacugcccugugcaguaugacuuuucucucuaucaccagggugacccggguuugccuggaaaagcaggcgagcguggccuucgggugagucuuggcagagagaaguaacaggggugaugggaggugggcaugaaggugauaggaaaggcugagggggguaaggggugaugggagucccugcagggaggcauggggugaugggaaccucugauguggauuuuggaguaauggggaaccuggggcaguguagcgggucauaggggcaccugcaaaauauugggagggucugucucaggccagcugcucuucuuagggggcaccuggaguucgggggccugugggugaaaagggagaccagggagauccuggagaggauggacgaaaugugagucccagccuaugacuccucaccccaaccuuaacccuccaaccagccaauucccaauaccugauccuaccccccaacccuguaaugcuaaacccucccaaucuucacuuccuuugaccccugcacacacgcaucugaaggcuaccaacauucccaugaguccucauggugcuuccaaagcucucccaaacugcugccuaccuugaguggcccugaccccugccuuucugcagggcagcccuggaucaucuggacccaagggugaccguggggagccggugaguagggcugguguccugggcucagaagggauggaggguccccuggcgcugcugccagugugccuucacacaaggggucuggagguccaggugggaagcauggauggccacccaugccugcugggggcuggcauuggggugcuucggggaacuugggggcagaguugagccuggggcaaaccagagccauggccugggaccugagggcuccuauugacuauaaucauuuccuuucccagggucccccaggacccccgggacggcugguaagggcugcgcugggucugguccucugucauuguucucacuugccccuuuggcuccacaucauguccccucauuccuuccacuaacucccacuucccccacugucccucugaaaccuccgcggaucccuggagccccucacagacccuguauccccucgccaacuccucuuccccuuguugagccauucuucucacuggucauuccccccacagguagacacaggaccuggagccagagagaagguauuagggucuguggguggaggguaagaaagaccccagugccccucccagcagguucuaccuugggcauggcuuggcuucaaggcuguuccucagcaagcuuaucucugccacagggagagccuggggaccgcggacaagaggguccucgagggcccaagggugauccuggccucccuggagccccuggggaaagggugagugugauugguccucgggggugcaggcaugggagggccugcucugauuucuuccuccccuauccucagggcauugaaggguuucggggacccccaggcccacaggugagugaugcacuuugccccgucugccaaguccccaucuuacccucaccucuuaucugacccuguucccuccagggggacccagguguccgaggcccagcaggagaaaaggugagaggguguggggguuucucaggacaugagccuggguuaucagauccaccucagccuugguggccucuuaccacucuauuuuccacagggugaccggggucccccugggcuggauggccggagcggacuggaugggaaaccaggagccgcugggcccucugggccgaaugugagucuugguaguccugccugguuguccccuuccccuaccccuucacaugaggacccuagaccccagccucauugguuggucuuggccuugacgagcucuggggcgagaccuguugucugugucuucucccagagcccugccuggguggggcauguucuugccaugcaggccuuaggcucacagggacuagagccccugaccccaugaccaugaugaacugacuuugagucucuccucagggugcugcaggcaaagcuggggacccagggagagacguaagugaggggagaugcugggacagagggggcucggggcugcguaagcuccaaccagaucaucauagucacagcauccgagagaguugguggggggucgguucagccuugccuuugggagggucucagucccuggcacacagguuuuaguagaaucccccuuucugaccuucuuugccuugggggucuucauaggcccuccaaguccuggggguucuucccuugggagucucagcaggggcccccauccauggggucugugccugagggaucucaaugggaccucucaguccugggggucucuacccuggagggagaucuuuuugggguccucuuaguccauggggugugccccaagggauaucucagaggcccuauaaaucuuaacaaagacuuuuuccaggggcuuccaggccuccguggagaacagggccucccuggccccucuggucccccuggauuaccggugagaccagacuuucauguuacccccuuuucccccuuacuacccucacccgauccccgacauccaaccagugaucuguucccacagggaaagccaggcgaggauggcaaaccuggccugaauggaaaaaacgugaguguguccagggcagcugcggcgaaaccugccaagaaacgccagcacaccuacacagccaagaucuguagcaacacaugaggcacacguguagacacaugcauccuggcccagacauacagaugcauccagaaacauaguuuuuuuuuuuuugagauggaguuucgcucuuguugcccagguuggagugcaguggcacaaucucagcucacugcaaccuucgacucucggguucaagugauucuccugccucaaccucccgaguaacugggauuacaggcaugcgccaccaugccuggcuaauuuuguauuuuuaguagagaugggguuucuccauguuagucaggcugaucacaaacugaccucaggugauccgcccgccucggccuccuaaagugcugggauuacaggcgugagccauugcgccaggccuggaaacauaguucuauaugcacacacaggcagccucacagacacauagggaguuaggugaaugggccaauuuaugccaggaugggcugacacaugcccagauaacccacagccauaggcacaggugaagagccacagacaggucgacaggcacaaacacacugguguguagccacauuuggggcacuuagagacauguugauacccagacacuuccacccagacucaugugcuaagacauggacccaagaccgcauguggaccuguguugagacauggugagacacacauggauggcucugaccugugacaugugcuaggacaugcuggcccaugacuuuauauggucacccacacgcuuauggucauacacauugagcuacacacaagaguugcagacagaugccaagacacauggcucucaaggcauguauaagcccaugcucuuuggagacauguauaagcccaugcccauaugcagacaugggccaagaugugcaaacagaccaggacacacagacccauggguacauguacuaagacacacauggauaugcacacacccaggacauguggacgaucaccaacccagagaugcauaaauguggagcuaccucuagagagccagagucaaaggacaugugugcaguugccuguuggggugagcaggccuaugcaggcacacccuuagacauguagcagcucacucagacggccacaggccaugcuccaagacacacacaaccauggagcuacaggcacagaaauacagucacagucaucugaaaucuagcaagguagugucuugcagccagacaccagugaauguuugggcugaugugaguccucugcccacagggagaaccuggggacccuggagaagacgggaggaagguaaagucccccaccuggggucucucuggucucugcuuggagccaugccugaagcauccuugucuuccuuagggagagaaaggagauucaggcgccucugggagagaagugaguauuggaguuuucugcaaccucugaccccugacccugacccugggggaauaugacuccacucuuuucugaggucucagggugcugaugcuggcugcauccuucacagggucgugauggccccaagggugagcguggagcuccugguauccuuggaccccaggggccuccaggccucccagggccagugggcccuccuggccaggugaguguccugggucauucugggacuucagagcauuagaagccaugauguuucaaugggcaacccuccugggaagccaugggccuuugugaccccuuuguguucugccguaucucaggguuuuccuggugucccaggaggcacgggccccaaggugagugcggauguuggguagggggcguggugagggggcugaccaggcugggggccauuuccccaccuggucauucuuguuuucagggugaccguggggagacuggauccaaaggggagcaggugaggcccccaccuuuuccacaugcccagguagccacagcacccacaugugcacaugcacacccauaggcugguuccuagcaguuugucuucaucucuccagggccucccuggagagcguggccugcgaggagagccuggaagugugccggugagccaggcuugggauguccccuugacucuguuuugcaugcccauuggggccaccuugccauccccuuccccuugccaugaggcuccauagguucugugcuguguguucagugcccugccccauugggguucuuguagcccacacucaagggaacuugggcaguggggacacaccagaaaggggcucccaggagucuccagccaugccucaaccaagugcuaaagggugcucugggcaagaggccuagggaaaagggugugaaggugcuuuccugaggccgugcggggcagaaggcaggagcuucucugucaugggcagcccuucacccagacuuuguccccagaauguggaucgguugcuggaaacugcuggcaucaagguggguuguuuaggggcuggggguagggacaagugggggcccuuggggcuaguggugcccacaggcauaggggcugcggcgacgcaccccgcuccucugaccucuugcugucccucaggcaucugcccugcgggagaucguggagaccugggaugagagcucugguagcuuccugccugugcccgaacggcgucgaggccccaagggggacucaggcgaacagggccccccaggcaaggaggugagcagaaguggcucaguggguugugccccguggagugggguguagcuguacagccaccagcauucucucuuccacuccugcagggccccaucggcuuuccuggagaacgcgggcugaagggcgaccguggagacccuggcccucaggggccaccuggucuggcccuuggggagaggggcccccccgggccuuccggccuugccggggagccuggaaagccugguauucccgggcucccaggcagggcugggggugugggagaggcaggaaggccaggagagagggugaggcugggggcuggccaggagagugagggaagagggguugggaggggugggaccccccaugggcuuggcccucacccgcuauuugcauuucagggagaacggggagagaaaggagaacguggagaacaggugggcugcgaugggcuucguggggcaggcugucuggaggcugugcuggggcugccaccccauuuucuuguuuccugcagggcagagauggcccuccuggacucccuggaaccccugggccccccggacccccuggccccaaggugaucaccccaucccugccuuaguccugugacuagugaccaggaagccacccuuagcuugguccccagaaauaugguagugugugccauaacccuggaauuucugacccuauaacccucugugauccugagaucugugaugacucccccaugccucuaugacagagacaucucuccccugugaccuuguguuuguaggugucuguggaugagccagguccuggacucucuggagaacagggacccccuggacucaagggugcuaaggucaguguguggaaucagcucggggccacccucugccauggcacuagggacugacuugacaucucauccccacagggggagccgggcagcaauggugaccaaggucccaaaggagacagggugaggccucucuccacccuuccauagagucccccuccuuucugggggcacacuagagguggugugcauaugcaccugggcacguggcagggacugggggcucagggcacgacacucugccuucagggugugccaggcaucaaaggagaccggggagagccuggaccgaggggucaggacggcaacccgguaaguccuugcccaacagccacacaugugcaagaagguggcucucacauguauuguccugugugcagggcuggggucuguacugccugggacugucuggguccugacucugucuagggggaugguggguggaggggaaguuggaacugggaaacuaaggccuuaaaccuauucucugcagggucuaccaggagagcgugguauggcugggccugaagggaagccggugagugguggcugaagcaccuggccccaggcuccggacccuccgcuaggugcugcugcugcugugugugugcaugucuguguguguguguuuguguguaccugugucugugugccucucugugugugccugcuugugugugccugugucugugugugccugugugugccugugucugugugugguuguauguggaugugugugugcaggcccgugugugcuaucuaugagaggcaguccauggguagguauuaucugugacuggaaagggugagguauggaaauugacccccaaggaaaaagcccccagagguugggaacaggcccaagugaggcccagauugaggcucaucagugcccucucuauguagggucugcaggguccaagaggccccccuggcccaguggugaguacccaagaaccuucaccugucuugcccccauccugugcccugccccagugaccaguacugccucaguuuccuugguggggugcggcuaacucccccucaucagacucuuuuucgccacaacaggguggucauggagacccuggaccaccuggugccccggugagugaccagggaacacugccuggugagggucuggaagggcugggauaggcauuggccacagcugaugagccaggccuucucuguguuaaucccugagcccuguucccugcccuugacccuuuucucuagggucuugcuggcccugcaggaccccaaggaccuucuggccugaaggugagucuagguguguggauaggaggaggaggcuccuucaagcuguguccaugccugggguagugugcgccaaccuccugggcugucaucuccugcaaugaggaugagcuccaggagcccuggccacgugggcucugcucaugcagucucuggguuguuugcagggggagccuggagagacaggaccuccaggacgggugaguggccuagcucacagguuagggucauagggagaugggugggguuggcacugcccugaacuuucucuuccuccagggccugacuggaccuacuggagcugugggacuuccuggaccccccggcccuucaggccuuguggugagugagucccuguggccccuguagggacaccguguuuucacuccuuggggcccauguucucucaugucguccuguguccauugucacccugacauccgacuuguucuccgucaggguccacaggggucuccagguuugccuggacaaguggugaguucugggggucaaggguugggcuccaggggucaagggucgacaggcagcccugacagagcucuucccucucagggggagacagggaagccgggagccccaggucgagauggugccaguggaaaagauggagacagagggagcccuggugugccaguauguguucugggggcagcucgcuaggguguggugcccagcugugggccugaaauaugaggaguggggcagcagggguggugguggagaggcacugaguuccucacgcugcucugccauaggggucaccaggucugccuggcccugucggaccuaaaggagaaccuggccccacgggggccccuggacaggugaucuuugacccugacuuccacccccugcagcaacuccucugccucacccacaagccuguuuccaaaugccauggggguggcagggugggggcgggggaggaggaggaaacucacuagcauuccccacaggcuguggucgggcucccuggagcaaagggagagaaggugaguguguguggggcugccagugagggggggucaacuggugggggccaaggaaucccacugaccucucccccuuaccagggagccccuggaggccuugcuggagaccuggugggugagccgguaaguagggaacuucugacagcagauguucuggggguccugucucuccaguggccuaacuucugaccuucgacccauaguuuacccacccucaugacccucagcuuucauaguagaccgcauauuuaagcucuggccccaugccucccuccggagucucaucuuucugugacugaugccuguguugccuccugaccucugucaacagggagccaaaggugaccgaggacugccagggccgcgaggcgagaaggugagguggguuggcccuggggccugacuacugagcagagaaggcucaguccagacaccccucaccugccauucugugcagggugaagcuggccgugcaggggagcccggagacccuggggaagaugugaguccggggccuaggcaagggcgagccuggccugaggagugugauggcgggcauaaggggccacucuugggccggggcacaugucugagccccugagucgggcugcaugucccaacauccaggagccugcucucuggaucacagggagccacacacugucggcuuccacacucugagcucugggggcccugucuuggcuucugugugcccauccuuggucuguuucucaccacaucugggcacacgugugcucuggucugaucucccagaucccaggacacaccugaguucuugugaaccucuccuugguccuguguuuacaauccuccuuuccccugccccuggcugccagcguucagccuguggccaugccugcucuacccgggaguggacguguugggguuccccucugagcgcccguguguccgcacucacgucuguggagccagaugucugcacucgcgugugggcucccugugccugugccaugccugaacucccaccugucuaugguaguaucugagcgucccucugucugugcuguccugagauaggccauggucaugucugagcuccugugagccaauucuuggucgcaugucugaguucccauguguucauggucacaucagaacuccccugggaauauuuucagcccgugucugaacucugugcucauguuccuacccucucaaaugcuguuugcuggguuuucuuagggucagaaaggggcuccaggacccaaagguuucaagguauguguacccagaagggucccugcugggguccuggucgugagacucccugagcuugauccgaugccucuuuuccucaaagggugacccaggagucggggucccgggcuccccugggccuccuggcccuccaggugugaagguaagucaaugccccaucaccaguuguaggggcagcaggccgggcccccacaggaggaagagggaguucugaugagaguccugggagggguccugcauugaccauucccucccuuugcuguuuuuauuucagggagaucugggccucccuggccugcccggugcuccugguguuguuggguucccgggucagacaggcccucgaggagagaugggucagccaggcccuaguggagagcgggugaggggcugggaacagcauguaggggcauggugaauccauggugggugaggagggggcccugccuuggggguucccagucuugagggggcagaggguaggaggguucccaagucacucucugccucucuugccccauuuuucugguagggucuggcaggccccccagggagagaaggaaucccaggaccccuggggccaccuggaccaccggggucaguggugaguagaggugcccuaaagccccacguauuugauuuccuguccucgugaggacuuaggauggggcgggccacacugugggguguugggggaggcgcuuugagagccacaggacccucaccucacucugaccuacagggaccaccuggggccucuggacucaaaggagacaagguaggugggacaagugcugcugacucucucuugugcccuggucacccccuucagccuccacugaccucccaugacccugcgucccccacugauuccccucacugauccccgguguccuguuggucuccagggagacccuggaguagggcugccugggccccgaggcgagcguggggagccaggcauccggguacguaugucuuacuccacagccgaacucccuucaucccagcucuugccucugauuuccaaccucugagucaaugaaccuaaugucaccauccagggugaagauggccgccccggccaggagggaccccgaggacucacggugggucccgcuggggaaagugacagugcugugacuucaguccccugccugugcccuuuguaccccaggacucucugccauccucccuagcccucuggcccuccucgucuaccccuguccccuuugucugguccccacuguuucccuccucccccugauccuccuccguccuccacugcccugguuccuguagcucacggucaccuucucucacacaggggcccccuggcagcaggggagagcguggggagaagguaggaacguggggaagguccuggcaugagugggggggugaguggaucuuguaugauauuagaauucaggugcggggccuccccaguuugggcgggacucacacucuuuugcccaauagggugauguugggagugcaggacuaaagggugacaaggugagugugggcauggggagggcagggcaggggccagggugcucccgacuccucugauuccugccugcccccucagggagacucagcugugauccuggggccuccaggcccacggggugccaagggggacauggugagugggcccacguguggacugggucuccccugggugcgagagggaccccguggggcuggcccagggcaucugagagcucaaacucccagagggugagggaccuucagccccuuaccgugacuucuuacccaaaccaacccagggugaacgagggccucggggcuuggauggugacaaaggaccucggggagacaauggggacccuggugacaagguacagggaagagggugguguacucucugugggguccuguggcuguggugguuccacagcaucugugagggcaggaggggaggacaggaggaggcuuucugggguuuagggggaagggguucuguggcugacuauggaguggccgagaggaggggcucuagggagggcucaaggccuuggugugagguuaggagagcucuguggacuggcccuaugaaggggcccuauagggacaggaaaggggcuccuuggguguccccaucugaaggugcuucagaugggaugaggaacccagugauaagagggcggggcaagggucuggaguccuuggggugagaaaugagccagucuguggacuacagcccccaguuccacccgcuauggcacaggcugggaggacgugcugcuagggccguucgggagugacuugagcucugccccagcuggcgggcucguuguauucuaagcccccagccugaucugguccugacugaaucccucuccuggucacucccacagggcagcaagggagagccuggugacaagggcucagccggguugccaggacugcguggacuccugggaccccaggcaaguucugccccaggcccaggcccaggcccagguccagagccagcaucacacacacacauauccuggggguccucuuaagugcuggggguucuggcucccuugcugccggccccauguguguucacccgggaucuguguguggccugggcccuggccgcugagcaucugaguggccacacaugcagcggaugggccaguguuggggacagucccacugaagggcucccccaucuguguuucucacagggucaaccuggugcagcagggaucccuggugacccgguaagaugccccugcucccacaggggcccccuguccccagagggcccccgucaccaugguggucccaccagugugguagcuuuugaccuuauagugacccagugcucucaugguguccucaugucacccagggucccccaccuccacaguagccgccuaugaugguguccccugccuauggugacccuuguccccauggcaagccccaguggcucuggccuccagaggugacucccaccccaugguguucccuacccacuauccagggcgauucucuuuggucccucacugaccuccucugaccucacauggacccucucccugcuagggauccccaggaaaggauggagugccugguauccgaggagaaaaaggagauguuggcuucauggguccccggggccucaagguaggaaagaaacaagauugguuuuuuucuggucaggaaggccuaauguugaagggcgagggaccuggggucagauauuagggcacugggucagagguuggaguagcugaggccuguuuggagaguuaguuucagggugaagggggucacagagugaggugucugggaaucacuucuucaucugcuuuucucccucagggugaacggggagugaagggagccuguggccuugauggagagaagggagacaagguacagaggggaugggggcuggggggcuacguggccuggggccuaaggcucaccccacugccugaugccugcagggagaagcuggucccccaggccgccccgggcuggcaggacacaaaggagagauggugagugugggcacgcucagaaugagggggccacggguggacgggggccaaguucaugucuuuuuuucuccagggggagccuggugugccgggccagucgggggccccuggcaaggagggccugaucggucccaagguacagggucuguggacaguggacaugacagggagucaggauggggcagggaagcucauggucgggucauggggguguagggacaaggaaggcuguagaggguugggacuuugggggcugaaguggggcuggucucgaggugucaagguggguuggggucacaguggaguuaggaugaaagcaugggagguggagggggcaugugcaucagggcagggggcuauaguggaguuggagucauggggaucacaucugguuggcucacaggugcuuggguuacagaagguuugggcauuaggccagggagcucaugggaguucagggagguuccagagcugagggaggucagggcagaaggucucucaugcuucuucuguucccagggugaccgaggcuuugacgggcagccaggccccaagggugaccagggcgagaaaggggagcgggugaguugaagccauggucauggugaauugaggggagcgugcacuuugggagaggguccaucucuggggccucugauuacugacucuguccuauaucuccccagggaaccccaggaauugggggcuucccaggccccaguggaaaugauggcucugcuggucccccagggccaccuggcaguguuggucccagaggccccgaaggacuucagggccagaagguaaggggccccagcucugacuccugaucccugaaccuucccuacccuuccaaccucauaaccaucuuccagccugccugccccaaccucugaagcuguggcccccaaccugccugacucugauccccacugccucugacccugcucacuuggucccugugucugacagggugagcgagguccccccggagagagaguggugggggcuccuggggucccuggagcuccuggcgagagaggggagcaggugaguagggauuccaaggcuugggucagagaucggggugacuucuguugucccugaggucagaggucacagccuggucccaucuguugcacauaggggcggccagggccugccgguccucgaggcgagaagggagaagcugcacugacggugagugugggccuggaugggccugggagggccugggugggccugggugggcuggggcccuaccucccucacccagcacccugaccccugggcccuggcuccaugcagucucaccauagucccuguauuaugugcccuauguccuuccugugggccauggguucuuuauggucccuguggucuucugcucccaggaggaugacauccggggcuuugugcgccaagagaugagucagcacuguggugaguggugcccagcccgcagucucccacuccaccccagcacccuaggcaagggcaggcaggccccuagaacuuacagggcaagcagucaagaagauggggggauggauggauacacagaaggacacaugugcugcaggacugacacaugacauguguccccaguggagggagacacacaggcagaugaggauugccaugcagugcucucagauguccagcuuggcuguguggggagugggaugauggugggagcagagcugguccccuugggccugaccuggacccggugggaggggcaucagagugaagcugucucuucccgucucugucugcaccaccugccuguuucugugucuggccugcuucugucucuugccuuuuguuggccuguucccaacuucccucuccucugccuucuucucuuuuuccaucucucuaucuaccucccacccucucucuuccucucucuccuguuacccucuccugcuaucucuuuguguaucucuaccccucugccugugugucucugucugucucuccaucuucccauccuucucucugucauugucucucuaucccucucugcccccucuagccugccagggccaguucaucgcaucuggaucacgugaguaguuuucuacucccagaacuuucuucaccccaggcccugcccugccuaucaacugggguccucucagggggguuggcugggauggcugcccauggugacuucagggcccugaggccccugcucuuggcuccaggaccccucccuaguuaugcugcagacacugccggcucccagcuccaugcugugccugugcuccgcgucucucaugcagaggaggaaggugaggacagcugaacccguggggcagcuauggguggggccgagacacgcacauggguguccaugaaugcagggcacacgccaagcacguagggucugcaugcagggcacacgcaugggcacugugugcacacaguggaaaucagugcugcccaccuugccccggggccagcagccacugcucccagcacacccugcccuaccugcagagcggguacccccugaggaugaugaguacucugaauacuccgaguauucuguggaggaguaccaggacccugaagcuccuugggauagugauggugagaauggggggcugccagcggggucuggggaggggcaggcagggcugagcccugcugaccucccccugaccuuucaacccucucugauucccacaaacccugcugacuugaccccauuggcccagaccccuguucccugccacuggaugagggcuccugcacugccuacacccugcgcugguaccaucgggcugugacaggcagcacagaggccugucacccuuuugucuaugguggcuguggagggaaugccaaccguuuugggacccgugaggccugcgagcgccgcugcccaccccgggugguccagagccaggggacagguaugggcugagcccccaccguggggaacugggcacugagccugccuggaucggguucugggggaggaguccuugggccaggguuccaggucaggguccuggaggagacgcucccucgcaguaggggaccuggggcagacgcccagaccaaagagcugaauauagagccccagccguggagcccccaguaggguccccuuccauguucccuccuuuaaagaccuaaguauggaccccucugaggucagagcccccacuuccuguuguagccuccgcucccuccccuuggcggugccucugccugagcgucuccggggaaggucagauggcugacgaccguuuccaaccuguccucaccagguacugcccaggacugaggcccagauaaugagcugagauucagcauccccuggaggagucggggucucagcagaaccccacugucccuccccuuggugcuagaggcuugugugcacgugagcgugcgugugcacguccguuauuucagugacuuggucccgugggucuagccuuccccccuguggacaaacccccauuguggcuccugccacccuggcagaugacucacuguggggggguggcugugggcagugagcggaugugacuggcgucugacccgccccuugacccaagccugugaugacauggugcugauucuggggggcauuaaagcugcuguuuuaaaaggcu

SEQ ID NO: 16146 - RNA, 20930 nt, Homo sapiens
ugggccaggggcggggcacucgcggcggaggcaagcggcggcgcgcggacgguugguccaguucuccggccuggcggcaggcaagucuagcucggcgcugucggauacuuggggugagcggaaagcauggcggggaccuccgcgccaggcagcaagaggcggagcgagcccccggcgccucgccccggcccgccgccgggcaccgggcaccccccgagcaagcgggcccggggcuucuccgcagccgcugccccggacccugacgacccguucggcgcgcauggggacuucacugccgacgaccuggaggagcuugacacccucgcgucacaggcccugagccaauguccggccgcggcucgggacguguccagugagugcuccucgcggccuuuugcucggagggaguugucaaccgcgccagauccccuugauggcuguggcuucggaaccucgcggccagcacugccuuuucgccuuuuuaaaauaugggaacacccugauuuaagcagcgguugucuuccagaagguccuuugauuuuagggggaaaugcauuagccaggucaaacagccgauuugaaacacagaaggcuaaguugacauuuuacguuauuuucuaaaguuuaggccacuugguucuugguucuaagcagagauccuuggaacacaccuaccaccaccaucagaaccaucacuacccaugcauggggacccauucuugugacaaguuugagcggcuuuagaucuuaugaagcccacugucucccuugggcagugugagcaugggaggagccagacacaggcaagagaugaaauaaauuuauucuuuuauacaaccaguaaacugugcuaggugcccaaacgugaggaacugcagcugaccuuacaaugaacaaaauacaaaaacuguccuucauggagcuuacauucuaguugaggagugagugaagucuugaggacucccagaaagagaaauguuuugagugcaccuugcaucuguacuugggugucucaaggcaccuuaaacucaacacgaucauuuccuggaaacccaguccuccuccagcacuucuagcauggugccggcaaagcagacauucagagaaugaugaccagauguuccacaaggaaguaacuagcacgacucuccauccaguggcacaaagcgacucuuccccuuuccuugacucuacaucuaauuuauuuggaaagcaugucaagcuuaccuucuuaauccuucucuggagucuauccuauucacauugcuucuaccagcugccugaucuguguuaccaugaguccucucuugaacaauggucugcuaaauugguuucccauuuccagucuugacucccuacaagugaggcuucacaucacauucugagugaucuuuucaaaacucaaaucuggcugugucuuacacagauauacgugaacacccuuuuuuuuuuuuuuuuuuuuugacggagucucacucugucacccaggcugaagugcagugaugccaucuuggcucaccacagccucuaccucccagguucaagagauucucuugccucaaccucccgaguagccucagccucccaaguagcugggauuacuugugcccgccaccaugccuggcuaauuuuuguauuuuuaguagagacgggguuucgccauguuggccaggcuggucucaaacugcugaccucaggugauccacccgccuuggucucccaaagugcugagauuacagguaugagccauccgcacccagccaugaacaccccuaaugaaagcccuuuaauaauuucuuauuucuucuagugugaagaccagaauccuuaacauggccugaaaggcccagccugguuuggcccuuucucacucucuggguccuggcugcacuaacauucuuugaauucucucugcuucuuuacaauacaggaacuuuauacauuguucuuucuuuguacauugaguauacuuuucauucauucauuuccacucaucugguuaauuccuacuuguccuucagcucucagcuccuucaagucuucccuagggaaauguuccaaucaucccaguuaagucagauugcugucauauuauaggcuuuccuauauuuguucucuucugcaguucuuaaucacaguuguaauuuuacauuuaucugugugauuauuuguugaaugucuuuuaagcucugugaguguaaggaaguaucaauuuugcucacuauuguaccuguagagccuaacaugccuggcauauugcauguggucaguaacuauuacugaauaauaaguagaucauugaguucuggccaaugagaucuccucaggcuuuagaugagacucuuggaauuggaugaaggauagggaaagaauaauaggaucuguuguuuuagaaggaucauuuaugaguuucagccgggugugguggcucaugccuguaaucccagcacuuugggaggccaaggugggcugaucacuugaggccaggaguuugagaccaggcuggccaauauggugaaaccccgucucuacuaaaaauauaaaaauuagccgggcgugguagcacacgccuguaauuccagcuaccuaggagggugaggcacaagaaucgcuugaaccugggagguggagguugcagugagccgagaucacgccacugcucuccagccugggcaacagagcgagacucugucucaaaaaaaaaaaaaaaaaaaaaaaaaggaucauuuaugaguuugaaccauguucuuagguugaaaaacaucuauauugcuuacuagaucuuucccugcuuugcucucaagaguaauucuucccagcacuuugggaggcaaaggcaggaggauugcuuaagcccaggaguucaagaccaaccugggcaacauaaggagacccaaucucuacaaagaauuuuaaaauuagccaggcauccaggcacaguggcugacgccuguaaucccaacacuuugggaggcugaggcggguggaucgcgaggacaggaaaucaagaccagccuggcuaacauggugaaacgccaucucuacuaaaauccaaaaaaaaaaaaaaaaaaaaagccaggcaugguggcacacaccuguagucccagcuacacaggaggcuaaggcaggaggaucacuugaacccaggaggucaagguggcaguaagcagugaucacaccacugcacuccaaccuggguaacagagcaagacccuaucucaaaaaagaaaaaaaaaaaaaaaguggguauuuucagcauuuucuggcaaaagugggaaaauauuggguccugaaauguauauggaacuauuuuuuacaggugaucauaagguccacagauuauuagauggcaugucaaaaaauccuucagggaaaaacagagaaacuguuccaauuaaagauaauuucgaauuagagguacuucaggcacaauacaaagaacuuaaagaaaagguaagugacuuaacuugugguuuuuguagcuaauucauucacuuacguguuuaaaagcauuguacaguaaaauauacaaaaguuguaaaacaagugucuagauucaucccuaugacaugggaaaagacuagggaaagaaaaccagaaaguuuaggcugaaagaaacuaaauugugagauuccuaaugccaaaggcaagaagaaaaacacuguauaccagauccaaaaagagauacaaacuguuaggguacuaagaugaauuuauagcauguaucuucaugugaauaauacaacuucauaaugguugcuauuuucauuagcagcuuugcaagaaagcagacacuucauaucaccaucuguaggucccuaagaaaaccaggaauauguggaauuuuaguugugcaagguaugugacccagauuuuuuuuuuuuuuuuuuuuggagauggagucugucauccaggcuggaguacagugacacaaucuuggcucacuucaaccucugccuccugguuuuaagcgauucacaugccuuagcuuccagaguagcugggacuacaggugugcaccacgacgcccagcuaauucuuguauuuuuaguagagacggaguuucaccauguuggccaggcuggucucaaacuccuggccucagccucccaaaguguugggauuacaggcaugagcuaccacacccagcgacccagaucguuaaugccucuuagagccuaaagaauccggccaggcgcgguggcucacaccuguaaucccagcacuuugguaggccgaggccaguggaucaccugaggucaggaguucaagaccagccuggccaacauggugaaaacccgucucuacuaaaaauacaaaaauuagcuaggcaugguggcgggcaccuguaaucucagcuacucgggaggcugaggcaggagaauugcuggaaccugggaggugaagguugcagugaaccgagaucgugccauugcacuccagccuaggcgacaauagcaagacuccgucucaaaaaaaaaaaggaaucuggucaggcaagguggcucaugccuguaaucccagcacuuugggaggccaaggugagagaaucgcuugaacccaagaguucaagaccagccugggcaauacaaugagacccugucucuacagauaaaagugaaaauuggccaggcuaguggcacaugcuuuguaguccuagcuacucaagagguugaggcgagaggaucacuugagcccaggaguucaagguuacauugagcuaugauugugccacagcauuccagccuaagcaaccccaucccccucccuggcaaaaagaaucugcaugcaugaguggcaaguguaugcuuaagcuaucuugaugaauaucagcugucccaugaacaggccuagcagaccauggugacaucugguugcuguggauauauuuugaguacucauuugucuguuuuuccugugcuuucuccaucuccccaacuacauguuaaaacaaaguaccuaaguaguuuucucuuacaaaguuuucacgagauuaauuugggauuuacagaugaaaguaauggaagaagaaguucucauuaagaauggagaaauuaaaauuuugcgagacucacuacaucagacggaauccguucuagaggaacagagaagaucacauuuucuucuugagcaagagaaaacccaagcacucagugacaaggaaaaggaauucuccaaaaaggugacccagagcauuuguuuugcaccagcuuugccugcccacugaguuccuuugaccaggguugccuguaaaucuuccagggagauuucaacacuuguuugucuuaaauacuuucugcuaucaucucauugccauccacucuucuuccagggucuggauauauuuuggaaagggauuuagaugaaacucuauuuugcugugguaguuggucuuggcaggaguaaauaacuagcuuagcauuucuagaaacagguuuacauuaaggcucuuuugcuagaucagaaacucaacugaccuggcuuaggcuaaaaggaaacguauuggcuuccauauccaagucugggaagaaccgggguaugcugggaccuuaaaugacuuaaaucuugccaggacauuuuuauucucuaugcuauaaacaggcucuauacuuaugguagaggguguguucuccagaagcuccugggcucauauuuuauaaauacagagcagaauuaagacuuagggccacaugcaguggcucacaccuauaauccagcacuuugggaggcugaggugagaggauuacuugagccaggaguucgagaccagccugggcaacuagugagaccucaucuccacaaaaaagaaaaagaaaaaaugaacaaaauuauccaggcaugguggugugcaccuguagucccagcuacucaggaggcugaggugggagaauugcuugagcccaggagguugaggcugcaguaagccaugaucaugccauuguacuccagccugggcaauagagcgagacccugucucaaaaaaagacuuaggcucccucaucucaaguuuuaaaauucugagaaaggcucugauugguuuaacuugagucaguugucugucccuggccaauugcuauaaccaaaagcaaccaaaagcaaaaaaaugacagcucccauucuaauaaaauagucagagguagggaaauuauugaauuuuuuuuuuuuuuuuuuugagacaggguccaggguuucacucucuugcccaggcuggagugcaguggugcaaucacagcucacugcagccuugaccucccaggcucaagcaauccucccaucucagccucccagguagcuggaacuauaggcacacaccaccaggcaaagcuaauuuuuaaauuuugguacagacaggguuuugcuguauucuccaagccguucucaagcuccugggcucaugcaguccucccaccuuggccuuccaaagugcugagauuacaggcgugagccacaaugcccagccuguuucucagggaaaggaaaaugcuauucuggaaggaaaaacaguagguauccaguaccuacuacaacuuucccucagcaccuccucaugcuucaaucucaaggacaugggaucuuauucucauuguuucauucagcaaacuuagcaaacuuuaagcacuuaccugugcccaucauuaaccgcaauaguuaacuuucuguauaagugaugaagagcaaggaauuugcggucagacaaaccugaauuugaauccaggcuucaucacacauaagcagugaccucaagguaauaacuuaagcucccuggcucauuucccuuaucuguuccaagacauaaccagaaagguuguugggagacucacacauucuugcacuuacugugucuggugcugggccuggcgcagagugugcuuggggaaugauggcaguuacuguuggcuguagcaacugcaggccagagcagcaggucucucuauacugcacagugucuugguaaacuauuccaacuacucugcccaaacuuugaggaagaccuggaauugugcaccagugcguucguuaauaaaggucaauauguuacugcugacauagggcaccuuaccaagcucuaugcuggguauuuuacacucaucauucuacuuaauccucccaacuaucaugaagacagguguuuuauguuacaaauaaguuaggauucaaagacauuaaauaaauggugggcugguauuuaauucuuuuuuuuauuuuuuaaauuuuuuguagaggcaagaucuugcuauuuugcccaggcuggucucgaacuccugggcucaaaugauccucccgccucaaccucccaaagugcuuaggauuacaggccugaaccaccacacccggccagggcugguauuuaaacccucacaaacuacccuuacaauagaguccaguaucuuuuuagaguaccauauugucuuucagaaagaaagcuaauguuuaauauuuuaggacauuuaugucacagcagacuuucauauguauuuuucauuguuugucuuuuacuggcuugugauuuugaagcccagagauauuuuuguguauaugaugggaccacuacaagcauguuucuuuugccuuccagcuccaaucauugcagucugaacuccaguuuaaagaugcagagaugaaugaauuaaggacaaagcuccagaccagugaacgagcaaauaaacuggcugcucccucuguuucccaugucagguaaugauggugcuggagggauaguucaguuuugcauuauuuaguaaaaaaucugcauaacagugucaggcugguccuaaaugaaggccauuuagaccccuccaccugggcagagauccucuuuuccugaaggauucagaggugguuuagaugaagcuugcaugguuugagacaucacagcauaaaggccuauacucuagaaaugcugccucuguauggcacuuuauaaacauaauucuucaggacuagaaagaccuggaaaaaugaucuccaaauuuugggggugggcuagucucuacuuuuauguaauuuguuuaacugauuuuguugcaagcauggguguauuuuaguuccagcuacuuggaauauuuuuuucucauuugcuuucuggggacccuuguccaacagccccauccuuuguggucagaugugcucaacuuguuuuuuuuuucuuuuuuuuuugagacagagucucgcucugucacccaggcuggaguacagugguacaaucucggcucacugcaaccuccgccuccuggguucaagcaauucuccuccuucagccuccugaguagcugggacuacaggcacacaccaccacgcccagcuaauuuuuguauuuuuaguagagacggaguuucaccauguuggccaggcucgucucaaacuccuggacucaaaugauuugccagccugggccucccaaacuacugggauuacaagcaugagccacugugccuggcgcagccuggaaauuugaacagugucagucagggcaucuucugguuuugaacuuucuaccgccuuuguucauaaugggcagugugugaaacugaacucuccaugccuugcauuguccacauaagacaagagaacugaggggauccucuucacacaucaguaacagaaagaccucagcauuauaugaucagaucagaggguuaauacugcuucucuaccauaaagacauuggcacuaaguugcucaguuuucaacauaccuaguagguuuaucaaaauuaugauauuuauuuugauagcccuuuuucuauuuaaagucuuugcauucuauuggaagucuuuuuuuuuugagacagagucucacucuguuguccaggcuggaguguagucacaugaucucagcucacugcaaccuccaccucccggguucaagugauucuccugucucagccucccaaguagcugggauuacaggcacauaccaccacaccaggcuaguuuuuuuguauuuuuuuuuuaaguagagaugggauuucaccauguuggccaagcugcucucgaacuccugacuucaggugauccacccgccucagccucccaaauuguugggauuacaagggugagccacugugcccagccuggaagucuugugacuauuaaaaaaucguuuguuccacauuggcugggugcaguggcucacaccuguaaucccaacacuuugggaggaugaggcgggcagaucacuugaggucaguaguucaagaccaaccuggccaacaugaugaaacccugucucuacugaaaauauaaaaauuagcugggcaugguggcaugcgccuguaaucccagcuauuugggaggcugaggcaggagaaucacucaaaccuggaggcagagguugcagugagccaggaucacaccacugcacuccagccugggcaacagaacaagacuccauuccagaaaaaaaaauaguuuguuccacauugaaaagauguuuugcaccaggcaugguagcuacagaggcaaucccagcuacacaggaggcuaaggcaggaagauugcuuaaggcuagcaguucgagaccagccugggcaacauagcaaaaccccauugcuacuuaaaaaaaaaauaaaauuacuggccccaguggcucacgccuguaaucccagcauuuugggaagcugaggugggcagaucauuugagcccacgaguucaggacuagccuaggcaacauggugaaacucuaucucuagaaauaacucuaucucuagaaagaauaaaaaguuagccagauguggugguugcacaucuguagucccugugcuacucagaaggaugaggugggaagaucacuaagcccaagagguggaggcugcagugagccguaauugugccacugggcuccagcaugggcaacagagugagacccugucucaccaaaaaaaaaaaaaaaaaauuagcuggccauguugaugugugccuguaaucccagcuacucaggaggcugggauuacagauggguggauugcuugagcccaggaggucaaggcugcagugagcuaugaucaugcuacuguacuccagccugggcaauggaacaagacucugucucaaaaaaaaauguuuugguggaauuguaaauagugauaauaaagaauaguaaaggaauuauggcuaauauuauauuuuuggaugauuagaaaaauauaaaaaugaguaaaagaauuuucaacaauuuggaucaaaaucccuggaauuagccaguaacaguggaucaugccuguaaucccagcauuuugggaggccagaguggguggaucacuugagcucagcaguuccagaccagccuggguaacuuagugaauccccaucucuauagagaaauuaaaauuuaaaaauauuuuuaaaaagaaaaacaaaugccuggaauuuugcacugcuccucugacaaagaaugguagacauauaauagauaaaaccuuugguuaaaacaccuagacaugaaaaguuuaaaguuuguuagaaauuuuguaaccagauauuuugaaugguuuuaguagaaucauuacuuugcuuucauaguuaacuuuuuccaguccuaggaaaaacccuucugugguuauaaagccagaagcauguucuccacaauuuggaaaaacaucuuuuccuacaaaggagucuuuuagugcuaacaugucccuuccccaccccugccagacggagucaggauacaagccucuggugggcagagaggguaaguccauuagucaucuauugauguauaacaagcuacccaaauauguggcuuaaaacaauuauuauuuauuuucucccaauuucugugaucagcaauucugacaaggcacagaggggacaaucucugcagggacuggaaucacugaaagcuugucuuaagcuggaggaucuauuucaagguggcucacucacauggcuggcaguguaauuucuugccacaugggccucugcacauggauaugggguauccucuuaaccugguggguggcuuccucuaaagcuagcaaauccagagagagcgagccaggcagaagcuauccauuuauggccuagccucagaagucacacagcauccccucugccacauuguauuuguuagaagcaaaucacugagucugggcgucauucaaggggagaaaccaagcuuauaccuuuuuuuuaauuuuuauuuuuuauuuuuauuuuauuauuauacuuuaaauuuuaggguacaugugcacaacgugcagguguguuacguauguauacaugugccauguugguguguugcacccauuaacucgucauuuagcauuagguauaucuccuaaugcuaucccuccccccuccucccaagcuuauaccuuuugaaggggaguugugucaaagcauuugugggccuuuuuuuuuuuuuuuuugaggcggagucucacccugucacccaggcuggagugcaauggcacgaucucagcucacugcaacuuccgccucccggguucaagugauucuccugccucagacucccgaauagcugggauuacaggcaccugccaucaugcuugugggcauauuuuuaaaccaucacagcaucaauugaccaugccaaaaaccuagcuaguaugcaggaaucuguuuuucuuuucuuguuuuuuuuuuuuucuuugaggcggagucucacucugucaccaggcuggagugcaguggcgugaucucggcucacuguaaccucugccucccauguucaagcgauucuccugccucagccucccgaguagcugggacuacaggcaugcgccaccacacccagcuaauuuuuguauuuuuaguagagacagguuucaccauguuggccuggauggucucaaucucaugaccucgugauccacccacuucagccucccaaaaugcugggauuacaggcaugagccaccgugcccagccucuguuuuccuuuuguaguccagcuuuugaguuuuuauaacucaguccagauugaggggaucugcuguuuuuuagagagagacaaucuaacaucaguagguuuucagacugcuaugucaguguaucuuauaaaucggauacauugacccucuucuuaccaucaaccuuucaaauccuuggccaucauaacacuucugagaaacuguagcccacuuacauuuuuggcaucuagcagcuaaaggggcaguguacaguaguguuacaagcgggcaguagagcccaguagccuggaugugagucccaguaaugcuguuaacuggcuuauaugauuugggcaaguccuuuagucucugugccucaguuucccuauauguaaaacagaccuaaugauaaauccuuguagggucacugaggaacaaaugggcugaugcguauagagcucuuaaaacacugucuagcacguaacaagcaccaugucaauguuaguggucacuguuuuaucuaauugccucauuuugagugaggcaaacagcuugauuuucuuuuccuuuccuuguaugaguuccuguuuuacauaaggaagguaaaagaugcagggcucuugagccgcuuuggcucuuguuuguuccaaguucgaagaaguagaacagcguguguuuuaaacucauugcauguaaaaguuucuaauaugcccaugcuucugggcucaaguuuugauuuacauuuuaucacauuucagauaguaagccccacagucugagaggugacuccauaaaacaagaagaggcccagaaaagcuuuguugacagcuggagacagagaucaaacacucaagguaccagaaucccugcuucuccugcaggggccugcauggcucugaguaauaugcagaagaauugcccaggccucugagaaccggugccccgggcaguccuucagagaguccagggaagucaaaguauguggcuuaagcagaagacuuuauaaaguggaaagggccaagggcagguaugucccagagccuuccgcacccacaggcaucuuccuggggcuuaguggcagccuagaggacaguuggcauccaaagaauccuuacuguuuccuucugaaagccaccgaaaagaucucccaugucagaaccuucuagagucaucuugucuucugcagguuccauuuugauaaaccugcuccugaagcagccuuugaucccagggucaucccuaagccuuugccaccuccugaguaguaguucugagucuccugcuggcaccccccugcagccaccaggguuuggcagguaagcauaagacuccuggaaagcuuguuugggaaggagcuuccuggaagcaaauuccuuucuggcccuggccagccugagaagucugugggaagggcaggcagccuggagaauuuggcaggcaggcuguuuggggcucuugaccuuaucuccaucccacacuuaaucuauuuuucuuuguguuuguugccaguaccuuggcuggaaugucaggccucaggaccacagguucuuaugaugggucauuuucccucucagcccugagagaagcacagaaccuggcauucacuggacugaaucugguugcccggaaugagugcucacgugauggagacccagcagagggaggcagaagggccuucccacucugccagcuuccuggagccgugcauuuccucccccuuguacaguucuucaucggcuuacacugccaggcccugcaggacuuggcagcugcuaagagaagcggagcaccuggggacucaccgacacauuccuccugcgugagcucugggguagagaccaacccugaggacucagugugcauccuggaaggcuucucugugacugcacuuagcauucuucagcaccuggugugccacagcggagcagucgucucccuauuacugucaggagugggggcagauucugcugcuggggaaggaaacaggagccugguucacaggcuuagugauggagauaugaccucagcccuaagggggguugcugaugaccaaggacagcacccacuguugaagaugcuucuucaccuguuggcuuucucuucugcagcaacaggucaccuucaagccaguguccugacccagugccuuaagguuuuggugaaauuagccgaaaacacuuccugugauuucuugcccagguauuaagcugcauaggagucaugauucuuugugggucucaccugaccucuuaaggucuaacccauggcacuuguacuuugcucacaucuugacuuaucuacacuaguuaguucuaaggcuugguucagggaguucugaagugaugggaaguggggccaaaugggagaaccaaggaagugguuuauuugauuuaauucugccucugaacaacagguaagcaaaaggcacacaugauuaaaggaggcugcuaaccucuguggaggagggcccugccccaggacaaggguuaagacaaggggccucugaaccugagauguggguaaggugaagaccacacaucacaagcacguugaaguuuagugguuucccuaaggaagcagaggauguggagagggucugcagcccacgggcugaccuugcugggagucucugccugucauugugcccaucuuuagcaugcaucugggguggccuguucuucuuaagguuuguggguaguauauuauagugaaccuagcgaaugaacacugugaucauaaauuccucccuugggauuccagagccgcaagauuggggagaacugugaacacaaccagcccacccccucauccaguaauccagucucccucagcacucuaccaaagggucaguuucuauguuggaaugauuccacuggcugaauauaucuuaaaucaucucaucucugagcucagcacugcuguuuccuagaucuguuuccaucugaauauuuuugguuggucuggcccaugcuaaaggugguacucagcuggacacagcacugcaguguagugugggcagugggaucaggcagacucaggacucaagugcccagcaggggcccagcucauaguggcuguuuuuuuuuguuguuguuuauuuguuuguuuuuguuuuuguuuugagacgaaguuuugcucuuguuguccaagcuggagugcaguggugcgaucucggcucacugcaaccuccacuucccagguucaagcaguucuccugccucagccuccugagacgcugagauuacaggcaccugccaccacaccuggcuaauuuuuuauauuuuuaguagagacaggguuucaccauguuggccaggcuugucucaaaugccggaccucaggugauccaccugccuuggccugccaaagugcaaggauuacaggcgugagccaccgggcccagccuugguuauuuguuuaauaauuguuaaaugaaugaaucccaggcugggcacaguggcuccugccuguaaucucagcacuuugggaggccaaggugggaggaucacuugagcccaggaguuugagaccagcgugggcaacaaagcaagacucccagcucuacaauuuuuuuuuuuuuaauuagccaggcaugguggcagugagcuaugaccaugccacugcacuccagccuaggugacagagugagacccuaucucaaagaaucccagaaaccauguuuuuacuggugguagacacaccauuauuccacuccuguugagcuuguccacagggacauucaaaacacagccacagcugggcauuuaucuauuucauguacuggggcucuucauaaaauuucauuuaaagagguucuuaggggcugggcaugguggcucacgccuguaaucccagcacuuuaggaagccgagguggguggaucacgaggucaggagaucgagaccauccuggcuaacauggugaaaccccgucucuacuaaaaauacaaaaaaguagcugggcgugguggcaggcaccuguagucccagcuacucgggaggcugaggcaggagaaucgcuugaacccuggaggcggagguugcagugagcugaguuugcgccacugcacuccagccugggugacagagcgagacucaguuucaaaaaaaaaaaguucuuaacgcuaucaaaaaauaacuuggaaaccacugugguguacauaaaaguggauuuuccuugcaguaccuucugcaaguggcagauauuggacaucuuacagcccaauaaugaaaccagguaauaaccauguuaaaauuccagcuucccacaaagggcugcacacccuggcaacuaaaaagcauugaacuuuuugucugcugugcaggauuugcccuaaagugaguucaccccacauagugagaccuugcuuccuaaggacacacugagggauaucuugaccuucugugcuuagaaacugcagaugucugaagggguacacaccuggccagaccccauagaguguuucagaauugcccuccuccccacccaccaggccaguccaucgugcucccccaggcuauguggguugagcaaacagcagcaguugccuuggggcuugguuuauugggguaauagcuuuccuuuugccccugagaccuggggcaguaugcccagaaccccucccuccugcacaccccacaguaggcacauucucccacuggcagcagauguguuuucuggcaaguagagaaaauggcuuuccuugcccugugagaggucucauaagauccagccauagccaaggccauguuugucaccucuggaggccuggucaguccuucugugggcacagaacauuucucucccaccuaaguuaggaccugcaucccuguuugggagcauguggaagccaggcaucccagauccaggaggucaucccacuuccugggcgaugcuacaccagauaagggccuguccucucagcugcagcagucuugcaguggaagugcccacuuguucacaugaaacaaguuucauagcaaguaaguaggggucaggccagcacugaaacccaagucuggcugaaccaacucaccuguucauacugacuugcucaauuuucuguuaccucuaguggagugugaagguagguuauggagcugggguuggggagugucacgucucucugggucccugucuuuuagguuccaguguguguuccaagugcugccaaagugccucagcccagagacaccccugccuagcgugcugcuggcuguugagcuccucucccugcuggcggaccacgaccagcuggcaccucagcucuguucccacucagguaaagcaggguggggcgggcaucuagacugcuccugcagaucaagggaaggguuggggugggaacagggucaagggccucagagggcuucugcaguauguagcccacgcucuuuaugagaaagggcacccugagugagaggugcgcuguccuuuucagaaggcugccuccugcugcugcuguacauguacaucacaucacggccugacagaguggccuuggagacacaauggcuccagcuggaacaagagguaaaaacuccagagccccuucuggacacuguccccaccccauccuaagaaccaacagaaucuccuuucuuuccgcugaggagaaacggagcuuuaauucauuuuaguaacaagaguugauaaagcaacuaaagagguaaacucaguuugggggcugugcaccacacagaugcaaugcagacaggacuuggcagaguugccugaugacugauccugucuuggcuuugggacgugggggcagaauagggggcuggaggcagguggguugcuggugacacaugagugcuuguccugggucuucccugggaaggucccacaccacuucuuggaccccauuugugcagacaaacaguugcugaagcaagugaacucuuauagaagcuuaagaaaacccucgcagggacuggucuccuucugcccaggauggaaccacucuguucuuguucuaggugguguggcuccuggcuaagcuuggugugcagagccccuugcccccagucacuggcuccaacugccaguguaauguggaggugaguggguaggggccaacagcuggcagcucuggugguaagggggccccgugcaaggacuguaggccccacugcaaacccccucacgugagguggcuaggcugagcggauuguuagggugcaggccaugguggcaccaggccucagucugcacccccccucucucagguggucagagcgcucacggugauguugcacagacaguggcugacagugcggagggcagggggacccccaaggaccgaccagcagaggcggacagugcgcugucugcgggacacggugcugcugcugcacggccuaucgcagaaggacaagcucuucaugaugcacugcguggagguccugcaucaguuugaccaggugaugccgggggucagcaugcucauccgagggcuuccugaugugacggacugugaagguaagccugccagaggccauccugcccagcccccauggcuucuuccagagguuccccaacaagucagauuccuggguguccccucagcaggcccccgcccacugcagccuguuccagcacuggggccauuuucuuuuaucuuccugccucaguucuucuccaagcauauugggaugccuuuugcaucuaucuguugagugugccuggcagagccacgguuuuuccagaaauagccgugucugaauugccuuuguaucacuuuguuugcaguagcugagggagcagggccuggguguggaagggacugguuaguuccugcggacguugggggaggagaggugggaccugcccuaggcccuggcaccuuugggcccucaccaggaaccucuccuuuuugucucagaggcagcccuggaugaccucugugccgcggaaaccgauguggaagaccccgagguggaguguggcugaggcccugaguguccagccacaugguggcaccagcaccacuccuuuccuuaccacaucaacugauuaaagcagugaccagcaggaacugcccagagaacuggcuggccuuguuuccugagucugaucuguuuggcggagugggagggguggagcaggacccggacccugaguggcugggauccuucuuccugucccuggcuguugcugagcccguccccaugguaacugaucugccuugaggaaggagcccugcccugccuguggaauuguccugagucauugcuuugggcuggggccaugggaagaaaccauuguguggcagggaaggagguggcucuuggcccaggccuaaaccaggaaagccugggaaacugggacccacaggugggcaugaaagggccgcagcaggggcucccagcaguguguaagaccgggagcuggucuggcaccacugcccugguccuuccagcugccugucacugguaugauggccccggugcauugugccaccagcaggccacagcuguggaucuuggaaggccucuggggucccccgggagcaggggagugggugugggggggaacggaugguggugagagggacagaccaggcaggcugacgagcagggcgggccuggcucacgugggccuguaggcgggcccacgccaaguuucacuucccgccacugcugccagcgagagccgcgggagagugugcagccgagucacuacugccugccugccugccugcuacggugaguguggcccccacaaugggauggcgcagggcaggagggccauggguucccccaccccagacuaagggggcacuaggggaggggccgagucaugugaagagggagacccucucagacagucgaaugugcuggucccacuaaggaaaccaccucacccucuccaacuuccugccugaaaaugggcccuggagcucgcagacagggcaggauugugcagggaaggccugagaugugcuucugcccacccccuaccccacucccuccccuucggaucuuaacacugggcacucacacacccaccccaugcuccucuccaggcucagcagcagguacguacccaaccaugggcucgcaggcccugcccccggggcccaugcagacccucaucuuuuucgacauggaggccacuggcuugcccuucucccagcccaaggucacggagcugugccugcuggcuguccacagaugugcccuggagagcccccccaccucucaggggccaccucccacaguuccuccaccaccgcgugugguagacaagcucucccuguguguggcuccggggaaggccugcagcccugcagccagcgagaucacaggucugagcacagcugugcuggcagcgcaugggcgucaauguuuugaugacaaccuggccaaccugcuccuagccuuccugcggcgccagccacagcccuggugccugguggcacacaauggugaccgcuacgacuucccccugcuccaagcagagcuggcuaugcugggccucaccagugcucuggauggugccuucuguguggauagcaucacugcgcugaaggcccuggagcgagcaagcagccccucagaacacggcccaaggaagagcuacagccuaggcagcaucuacacucgccuguaugggcaguccccuccagacucgcacacggcugagggugauguccuggcccugcucagcaucugucaguggagaccacaggcccugcugcgguggguggaugcucacgccaggccuuucggcaccaucaggcccauguauggggucacagccucugcuaggaccaagccaagaccaucugcugucacaaccacugcacaccuggccacaaccaggaacacuagucccagccuuggagagagcagggguaccaaggaucuuccuccagugaaggacccuggagcccuauccagggaggggcugcuggccccacugggucugcuggccauccugaccuuggcaguagccacacuguauggacuaucccuggccacaccuggggaguaggccaagaaggaaaaucugacgaauaaagacccccgcugccccauagcacugagu

SEQ ID NO: 16147 - RNA, 3943 nt, Homo sapiens
gugggaguggaggaaaaggggugaccugacaggagacccuugauagcuggugggaggugggaagagggugucucuagcucuagggcaguagccaguguggaugaccugaaccuccugauugaggcuccccuagccuguggaggccuuggaggcuuucagaugaugccugugacguuuuugccucccaggaagcugugccaauggcuuugagccaaaguccuccaaaaguccuaauaggaugggccagguucugguccugaguuagccgugggcaugccagggugugaagggcccugcacaggguacaaaugguccccaggagagaaccuuucugccagcguuuccucccgcagaaggcccagguguuugccagugagggagcccagacuugcccaacgcuucucagcuugggguggguccaggucuggguccugggcugggaagaaaggaaggaagugagcccuugcuugugcgccucugcagcccagguucccugccuucacagccccgcuagaggugggaucacccccacuuacuggugagcaaauaggcugggggggguuggugucagguuacaugguuuaguugauggcgcaagcccagguccaaagcccaugcucuucucaaacagccagaggugggggccggaaggagggauuggcuguuggggaguagugggagcaggggcggugagcaggggcggugggcagggccaggugcgcaggggagaaacaaggcgccuuggaguucagguaaagaaaguuggggaggaugaccaccggagccggguaaggaagggaaagggagcuccgggcgcggggcgaggccgggcgcuggcagaagaacgggucgggcuggugagggacucgggugcuacccggcucuggacgggcgggaagaggccgggacgcuguuccaccagcaccugcgggugcggagcgcgaccccccgccucggcuccuggcaaccaggaaaguucccaguuccgguuccaaggaggcgagcaggugaggccgacggggcggggcggcucuggcucccgggguucacuccucaccccuccgggcgacccgcguugccauggcgaccgccgcggugcagcccgcccccgcccucccccgugcgggaggggucggguccccagcccucggccgaugcggagcccgcggggcuggaaugcggggucccgggcgguucggggccgcgcgcccggcucuccgggcugcuuccggccuggcccgggcggcgggcggggggagggcagcccggcaggcgagggggaaggagcggagacgagcccggccgacgcggcuuugucuccuuuguucccggcgguggcagcgccgcgcgggaggggcgggcagcgggcgcaguuuuccgccccucggucuccggguaacagcugcggcuccaccagacccggggagaggccgcugcgcgcggagcccgagcccggagcggccgacgcccgccucggcgcgcacaucccgcggggcccggccggguggugagugcggggcucggggccagggcggcgaggaacggggcucccgagguggaacgggccggggccccgaucccgccgggcaggggcggccugggugaguggugggcggcuuugguuuugagaguugggaccacacuucuccgcgcgaagggaaacucuggcgacuccgccuggaacgcgauugggagacugaggagguggagcugcuccuccgcgcccccuccucgccgucgccgcgggggaccggccggccccuuccccgcccucccagggccagugaugggguccucgccucggggucuggggguuggggagggucaaggacgagccgaguggggaggucggggcuuccccucaguaguaacagcccuuucuggcugcucccggugggacugacaaaggcggaccucgagccuccugacccccgggcgggugggggggacccuccucuccacacacagacauauuaagugggugaucgaugagcgccuugggucaucgcaggugccugguaaaugguggaucuccccaccccuccucaacacacagaaaacagggcgggcagcgggcaccacugcacugucaaugaauaacucaccucuguagugaacccugggagcugagcaggagggugaaacgggaaggccgguuucccacuaacuggcaggcaaggcaaaugugggcuguccuauggccccucugcaggugcggaauggcgggguuugugagccccuuuuguugucgaggacagcuccacggggguccgggaggugcuugcucuacagacagaaguugggcagucuugcgcccccugaaaagguucagaguaggguggccccagaagagacuccagggcaugugugggggagcacugggcacaggcagaguuaggcuuuggcugugagucugagcagggccucagauauugggaaugggcaggagauccuggcuguguaaguuggggaugugaggucugguucuagaucagccuuuucagucugcccuggccuggucauuaauaaaaguggggccaauguguucccuuugagagaccaaguggcuuggagggauugugggcccccuaucuccccuacuuguuggguuuucuugggugugaaauggggguucguucaccauacagggagcaucuggucugugcugaagucuguguaaguugcuggggccucugaaucagaagccauacucccugccuucaaggagcuucaaguccagaguaggaggguggaacagggagaaaggugacccugguuggcaucacuaaugccaggcacacacuguuucauguuuacuggucagagcaauccugccucccauuguacaacuaggaaaucugaggcucggaaagccugaggcagagcggccgugccugucagggugguggcuagguguguccauucuguccaccgcaugcagcggccuccucaggagccugggaggacaggggaggcuccccagggagaggaugguugguguaggaguuaaugggauagcgagggagugggcauuccaggcagcggcaagagccugugcagcgguuggaggagccaagcagccugcaguucaggcuggcaggaacgaagggcaugugugggggagcacuggcauggaucgggugggagagguguggacuggagggguaggccuuuaucccucccgcucuggggugccccagaggcucuugggggagggguguacucaauucugcucaaggaaaguccugagaaguugggaguugggaggcuagauuggaggggcugggagcugcucaguggccuguggcagagauuaagugaaauccaugugccugaaauggaggagaaaaagucacugcucuucuuucuguccuccuuccgacacccaugguauguguggaggggcaaggggugcuagguccugauucacagggagacugcuggcagaagccugaccacuuucccuggagugggucagcggccgaccuccucaguggccuggccaggagcuguucugaucccgcccauuucuuccuguugucuccucauccaguguuuuuuuuuuguuuuuguuuuuaaccauuuuuucaucucccaaggcucugucaugcaucaaugcaguuuugauuucacauauggggagugguuuuguuacugccccuugagggcuggagaacuuuggcacgcaguaggcucugagcaaauauuuguaagcauguaggagugaguauuggucuaacuaugggacccugugcccaaggcccaucccuggcaugcgguggcaggagaauugaacaguagccccuugcaagagguggccucugcccauccucagguggacucugucuucccaugggaagaaacuuucuuuccucaucccuuggaaacuagguggggggcucuugggcagccuggucuugccacaguccugggauccuggccg

SEQ ID NO: 16148 - RNA, 27703 nt, Homo sapiens
ugcgcaggggagaaacaaggcgccuuggaguucagguaaagaaaguuggggaggaugaccaccggagccggguaaggaagggaaagggagcuccgggcgcggggcgaggccgggcgcuggcagaagaacgggucgggcuggugagggacucgggugcuacccggcucuggacgggcgggaagaggccgggacgcuguuccaccagcaccugcgggugcggagcgcgaccccccgccucggcuccuggcaaccaggaaaguucccaguuccgguuccaaggaggcgagcaggugaggccgacggggcggggcggcucuggcucccgggguucacuccucaccccuccgggcgacccgcguugccauggcgaccgccgcggugcagcccgcccccgcccucccccgugcgggaggggucggguccccagcccucggccgaugcggagcccgcggggcuggaaugcggggucccgggcgguucggggccgcgcgcccggcucuccgggcugcuuccggccuggcccgggcggcgggcggggggagggcagcccggcaggcgagggggaaggagcggagacgagcccggccgacgcggcuuugucuccuuuguucccggcgguggcagcgccgcgcgggaggggcgggcagcgggcgcaguuuuccgccccucggucuccggguaacagcugcggcuccaccagacccggggagaggccgcugcgcgcggagcccgagcccggagcggccgacgcccgccucggcgcgcacaucccgcggggcccggccggguggugagugcggggcucggggccagggcggcgaggaacggggcucccgagguggaacgggccggggccccgaucccgccgggcaggggcggccugggugaguggugggcggcuuugguuuugagaguugggaccacacuucuccgcgcgaagggaaacucuggcgacuccgccuggaacgcgauugggagacugaggagguggagcugcuccuccgcgcccccuccucgccgucgccgcgggggaccggccggccccuuccccgcccucccagggccagugaugggguccucgccucggggucuggggguuggggagggucaaggacgagccgaguggggaggucggggcuuccccucaguaguaacagcccuuucuggcugcucccggugggacugacaaaggcggaccucgagccuccugacccccgggcgggugggggggacccuccucuccacacacagacauauuaagugggugaucgaugagcgccuugggucaucgcaggugccugguaaaugguggaucuccccaccccuccucaacacacagaaaacagggcgggcagcgggcaccacugcacugucaaugaauaacucaccucuguagugaacccugggagcugagcaggagggugaaacgggaaggccgguuucccacuaacuggcaggcaaggcaaaugugggcuguccuauggccccucugcaggugcggaauggcgggguuugugagccccuuuuguugucgaggacagcuccacggggguccgggaggugcuugcucuacagacagaaguugggcagucuugcgcccccugaaaagguucagaguaggguggccccagaagagacuccagggcaugugugggggagcacugggcacaggcagaguuaggcuuuggcugugagucugagcagggccucagauauugggaaugggcaggagauccuggcuguguaaguuggggaugugaggucugguucuagaucagccuuuucagucugcccuggccuggucauuaauaaaaguggggccaauguguucccuuugagagaccaaguggcuuggagggauugugggcccccuaucuccccuacuuguuggguuuucuugggugugaaauggggguucguucaccauacagggagcaucuggucugugcugaagucuguguaaguugcuggggccucugaaucagaagccauacucccugccuucaaggagcuucaaguccagaguaggaggguggaacagggagaaaggugacccugguuggcaucacuaaugccaggcacacacuguuucauguuuacuggucagagcaauccugccucccauuguacaacuaggaaaucugaggcucggaaagccugaggcagagcggccgugccugucagggugguggcuagguguguccauucuguccaccgcaugcagcggccuccucaggagccugggaggacaggggaggcuccccagggagaggaugguugguguaggaguuaaugggauagcgagggagugggcauuccaggcagcggcaagagccugugcagcgguuggaggagccaagcagccugcaguucaggcuggcaggaacgaagggcaugugugggggagcacuggcauggaucgggugggagagguguggacuggagggguaggccuuuaucccucccgcucuggggugccccagaggcucuugggggagggguguacucaauucugcucaaggaaaguccugagaaguugggaguugggaggcuagauuggaggggcugggagcugcucaguggccuguggcagagauuaagugaaauccaugugccugaaauggaggagaaaaagucacugcucuucuuucuguccuccuuccgacacccaugguauguguggaggggcaaggggugcuagguccugauucacagggagacugcuggcagaagccugaccacuuucccuggagugggucagcggccgaccuccucaguggccuggccaggagcuguucugaucccgcccauuucuuccuguugucuccucauccaguguuuuuuuuuuguuuuuguuuuuaaccauuuuuucaucucccaaggcucugucaugcaucaaugcaguuuugauuucacauauggggagugguuuuguuacugccccuugagggcuggagaacuuuggcacgcaguaggcucugagcaaauauuuguaagcauguaggagugaguauuggucuaacuaugggacccugugcccaaggcccaucccuggcaugcgguggcaggagaauugaacaguagccccuugcaagagguggccucugcccauccucagguggacucugucuucccaugggaagaaacuuucuuuccucaucccuuggaaacuagguggggggcucuugggcagccuggucuugccacaguccugggauccuggccggguucgagacuuucccugcugcccccuuccccccgcccccuuggguggcuaacagaggcagccuuguuccugcucccauagagcugcccuguuuucugcacacuaaaaauggaaacccccaagcuauuucgggagcagugcccagccaggcugugaccacggccccccugcucccaccgggcuguggccacagugucccggcuuccaccaggcugcuggacccuccccugagccuugugcccggcccuguucacuucagggcagccucaggaguacccugcucaggccucaucugcuaggaugagccgaccugggagaagcaagcgcuugggauauuuugcacagacagcuuggcagcugggugaugggaggggcugggcaacguggccugggcacaggcaaguaggggaagugucucccagucugagaugcauugucugucccagcacuucaccaaccuuggugcuccuggcuagagaccacuggggaaggugguauugccauaguuucuugguucagggacucaggagccucagcuggggcccaagaaggggucuguguggaaagcaggcacccaaagucuggggagguccuggggaugggccugggaacagccaggcauggcaccuuccuccaggacacacuccacuuaccccacaucuugggcccuggcacuauucugaacugcaggagaggaaauagcaagagauggccuagcuucuacagcucucuaguacguagggcuccaacuaaguacucucaaacgaggggagugugccugagugugcguguguaugucuaaaugugagugguggucugaaugucucgggugagugugacauaugugccugcaguguguuucugugugggggaguugucucuauauggaugugucuucaugugguguuugaacauggguggcugugucugugugugucacugugcuguguguauagauggcaucugcaucucucucucuguguguguguguguguguguguguguguguguuguaggcauauacauacagggugggugguguguauguaucuugcugugcgacugccugucugcugaagcgcugguggcccuuugggcugggacagccccuggcuguguagaggguguguaccugggugccuuuacaggguggaguuugagcagagagagggaccucacagggagaaggccaugcugggggccuggcugggcccugccagccacggggcuccuuccuagcugaccuuucccaggccccucgggugccuggcucugcugcccucccccuccucaugugggcucugaggaggcguccucuguggaauguguuugguggccaggggccaggcugggcccagcuccaccagcaggcugggcgguggggagggggugcuucugugcugccuccccgguggggagcccagggcuuccacgugccugcagcccaggccccggcuucacacucggcuuucccgccugcuaggugacucccacacgggucaugcuguugucuccugauccagccggcccugccaggugagccugaccucacacuagauaucuaggagcagcaugacuccuaccuauucugagggcucucggagguggggggcagcccuucaggccccaccccuccgagcuggaaccucuucccaucucucaggccuguugguucugugguuauuacccuucuggauuccuggccugaaaggcccugcacccaacucuugucuugauucuaacauucugcugguucaggagaccucccucuccuuccuucuucugcccgggaaacccucauccauguagagccucuccuuucuuggggucugggccccuccuucccaucaccugcucuucugccccauccagacccugcuuccugggcauggccucucagccccucacccucugaucuggggggauggugaguggggugcaggucuccugagagaaucgugccugcagagaaugggcaguguugucuaggaagugucuccuauuucugaccuuguucuagugugugguccuggggucauccuggacauagugccuaucuaagaagccugguccuccucugcucacccccuagguuaggaggagcaucuuggcaaugccacaguccuaucccuuaccaguggccccagggugcucuggcggccacgugagccccacucucucgaccucucuuccugccaggugaccaugccugcucugggcccagcucuucuccaggcucucugggccggguggguccucacccuccagccccuuccaccaacugcauucacucccaauggcacguaucugcagcaccuggcaagggaccccaccucaggcacccucuaccugggggcuaccaacuuccuguuccagcugagcccugggcugcagcuggaggccacaguguccaccggcccugugcuagacagcagggacugccugccaccugugaugccugaugagugcccccaggcccagccuaccaacaacccgaaucagcugcuccuggugagcccaggggcccuggugguaugcgggagcgugcaccagggggucugugaacagcggcgccuggggcagcucgagcagcugcugcugcggccagagcggccuggggacacacaauauguggcugccaaugauccugcggucagcacgguggggcugguagcccagggcuuggcaggggagccccuccuguuuguggggcgaggauacaccagcaggggugugggggguggcauuccacccaucacaacccgggcccuguggccgcccgacccccaagcugccuucuccuaugaggagacagccaagcuggcagugggccgccucuccgaguacagccaccacuucgugagugccuuugcacguggggccagcgccuacuuccuguuccugcggcgggaccugcaggcucagucuagagcuuuucgugccuauguaucucgagugugucuccgggaccagcacuacuacuccuauguggaguugccucuggccugcgaagguggccgcuacgggcugauccaggcugcagcuguggccacguccagggagguggcgcauggggaggugcucuuugcagcuuucuccucggcugcaccccccacugugggccggcccccaucggcggcugcuggggcaucuggagccucugcccucugugccuucccccuggaugagguggaccggcuugcuaaucgcacgcgagaugccugcuacacccgggagggucgugcugaggaugggaccgagguggccuacaucgaguaugaugucaauucugacugugcacagcugccaguggugaguuccaguauugccccacuuuuccgccucucugaggccacuggccaagcauuugcagccaaggagcugcccagagaguccgagggcagcuggugguagcacgaggaugaucagaucagcaaauauuaagugcuuccuauguugccugggcaguggaaggguaccuuaccacaaaucuggcaugcggguggcagcagugucuggaugggcuuggaccaggaugcuggagggguggcacuugugucgguggauugggaggguguuuggggguucuuggguagggacagggaccuagaauggaaugagaccuuugguucuugagcaggagaggaaggugaggucgggauugaugagcuguagccucaggauggauaaaaaagggaagagagacugggggcggggaugagguugucccaggagggccagcagagaaaacacaguuguacagggagagcuaccagagcggcugggggagggaaugagguuguccagggacgaugcggccgaggagguuauccagggagggccuuccugaugcuucuugcugccuauaggacacccuggaugcuuaucccuguggcucagaccacacgcccagccccauggccagccgggucccgcuggaagccacaccaauucuggaguggccagggauucagcuaacagcuguggcagucaccauggaagauggacacaccaucgcuuuccugggugauagucaagggcagcugcacagggugagcccacaggaaguacuggccccugccccagagucuggagggaacagauugcuagggacccagccugguuuaagcuaucccugugaccccugggccaggagagaugaccugagcuccucuccccaggacugggugguguuuaccugugacuuuccuccauccccgcuaggccaguugguaugaccugugacugccuaggaggaaauucuauuuguaaauuacuucgauuggguggaggaggggagggcuuugggccucuggccauggacuugggucccagacccuguggucucugaucccaggucuacuugggcccagggagcgauggccacccauacuccacacagagcauccagcaggggucugcagugagcagagaccucaccuuugaugggaccuuugagcaccuguaugucaugacccagagcacagugagugccaggcacaagccagggcaugacugcugggaggggccucuggguggggccagggacccacuugugggugagccacugguguuuggauugcuggccucagguccucuuugcugucacagcuucugaagguuccuguggcuuccugugcucagcaccuggacugugcaucuugccuugcucacagggacccauacuguggguggugcgugcuccuuggcaggucagauuucugaccccaucccagccccagccucaagcccacaaugcuccugcauaauuguccuguccagaauuccugacccuuagaccaugacucucaaccccugauccccagacaccccaauuccucacccccauccucugcacugggcaucagugcccugccagggcagacacaggagccucuaucaugcccacucuagggcccugcccagguccuccagauuguaggagucccuacccuaugaacucccaguggcccaugagggucacagauagacacuggucaucucgcccaggugcagucgccguucugagugcucgaggggccagggcccagagcaguggcuauggagcuuccagccugagcugggcugucugcaaguggcagccaugaguccugccaacaucagccgagaggagacgagggaggugaaugaucagauaggcagggcccugguggggagggcucugggcaucaaggucuggguagagaucuuggauccugaugucggacaugccagauaccacauggccucacacaagucacuucuuuuaggagcucaguuuccccaucuauuucuaacucaggccagaggguguuuggggaggccugagggcuguugauugcuggugccugcccacauugggugucccauaaaugugagcccuggucugcugcccacuagccccaacagugugucccuggcucucuuggcagguuuuccuaucagugccagaccugccaccccuguggccaggggagucauauuccugccacuuuggggaacaucagaguccugcccugcugacugguucuggugugaugugccccuccccagacccuagugaggccccagugcugccgagaggagccggugggugagagaaugggccagccuggugggggccagccccugcuucaggggaugcggugggguuaaagugugaauccaggcaaagagccaugaauggaugccuuucucuggguccucccacuccccaaccaccugaagccuccauucugugcccuuggacuguauucccucauccuggguccucuuccccauucaagggcucaggauaucggcucugggucugagugcaccuccuugcugcuuaacccuggcccucucucccccucugcagacuacguauccgugagcguggagcucagauuuggcgcuguugugaucgccaaaacuucccucucuuucuaugacuguguggcggucacugaacuccgcccaucugcgcagugaguuccucgcccuguccccaggccugggcuucccuguggcgacccuugccccauggcugugcucugugcaggugccaggccugugugagcagccgcuggggguguaacuggugugucuggcagcaccugugcacccacaaggccucgugugaugcugggcccaugguugcaagccaucaggugagugugacuuugggcugggccauaccggggggguugggggucccagugugagaguuuuucucauggcccggggucugucugccuaugugaggcucuguccugagcaccagagccgcuguaugugacggacucccuggagaacagccgccgauacaucccgccuguuuugggagagggcauuuguagcugagaggcaggggaugucuggccuucaugccccaccucggcacagacaccccuggagccuucccccgcaguuuucuccaguggagaauuaaugggcuguuuuuauuucucuuuuccuuggucuccuuuccucuuaacauacacugugccugccugccuccugucccgcgccugccugcugaguggcccuuccugucuuccucugccucccccuucagagcccgcuugucuccccagacccuccugcaagagguggacccagccccuccccacccacagcccccaaagcccuggccaccccugcuccugacacccuucccguggagccuggggcucccuccacagccacagcuucggacaucucaccuggggcuaguccuucccugcucagccccugggggccaugggcagguucuggcuccauaucuuccccuggcuccacagggucgccucuccaugaggagcccuccccucccagcccccaaaauggaccuggaaccgcugucccugcccccacugacuucagacccucagccacaccugaggaccucuuggccuccccgcugucaccgucagagguagcagcagugcccccugcagacccuggccccgaggcucuucaucccacagugccccuggaccugcccccugccacuguuccugccaccacuuucccaggggccaugggcuccgugaagcccgcccuggacuggcucacgagagaaggcggcgagcugcccgaggcggacgaguggacggggggugacgcacccgccuucuccacuuccacccuccucucaggugauggagacucagcagagcuugagggcccucccgccccccucauccucccguccagccucgacuaccaguaugacacccccgggcucugggagcuggugaggcccagcccaggaaggaggccucaggggaggggauguggggaagaugcuaccccuagcuugccuugugauucugcacugggaggaggugaggggcaggguggagucugcagccccacaccggccuugccucuggaaucuggcaaggcagagggcugagcugggcagggugggcuccauagacugccuugcccuuggugccugcaggaagaggcgaccuugggggcaagcuccugccccuguguggagagcguucagggcuccacguugaugccgguccauguggagcgggaaauccggcugcuaggcaggaaccugcaccuuuuccaggucaguguguccugccugccgcuguccuugcagccuccuuagcuguugagaaacucugcacaagcccuggggagcaggaggagggcagaguccgagggcucaacuccaacccagaagcugugcugggggaucuguugggugaccugcaggacucccugggcccagcuccugaagcugcccaacagcuguguucucugcccucaggauggcccaggagacaaugagugugugauggagcuggagggccucgagguggugguugaggcccgggucgagugugagccaccuccagauacccagugccaugucaccugccagcagcaccaggugcacaccaugagcgccugggugggcacgggugcacugcacuggccacaggcuggcugccaacuguagcuggcugcaccacacuuuccagagccacgcucugaccgugucgcccugagggagucuccacacccauuucugaccucugaccaugugccccguggaguccuugcaucccagcucugaacucuaacuugagaccccaugggguccccauacuccauuucuggcucugcccuccaacuuguggccccauggggucccucugacccuaugcuccuaacuggucguuuuaguccuuucucugacuaaccccuccccaggccugacacuucccccagugcuugacucugaacccacucccauuucuccagcucagcuaugaggcucugcagccggagcuccguguggggcuguuucugcgucgggccggccgucugcguguggacagugcugaggggcugcauggugagccaccugcgggcugcugggcuggcggugguagcagggcucucccaggccugccucucacgugugucucugccacccccagugguacuguaugacuguuccgugggacauggagacugcagccgcugccaaacugccaugccccaguauggcuguguguggugugagggggagcguccacguugugugacccgggaggccuguggugaggcugaggcuguggccacccagugcccagcgccccucauccacucgguuuguugaaaggcuggccaucccuuccucagugcugcccuuagagggagggugugggggcccaaaggugggagguuggggcugccuuuccaguugaguagaggugagcaguccuuguccuggaacagguggagccacugacugggccuguagacggaggcacccgugucaccaucaggggcuccaaccugggccagcaugugcaggaugugcugggcauggucacgguggcuggagugcccugugcuguggaugcccaggaguacgaggucuccagcagguaagcuggcugcacccagcaggagcacggcgcagccuggggccuccgcgguuggcguugcugcuuggggccucccacccaccgcucaucugccccccucucucccuguuccuugauccuggccacaaugcccgagugccagcguugccacugaagacccugagcacccaccacaccuguagguuccuggccugggcugcuggggaauccuuccugggcccgucacugcccagaacugacucguggcucugcuuccugcucugcucaccuggucuucugagggacuguggauauauuaauagcuguggcagcaggacccucagaucagacagauaagcucaggggcuggccuucucaccagcucacucuuccccaggcauuguccugggcugccaggcucuucaggaagguagacuuggaaggcacaccucagaaaggcacacuggccgagggccaggcuccacugucgucucuagggaccccugcugccuuccuggggcuccuggguuaugguaaccuggccagcgguugcaggccccaaagguacacacgcaggacauuccuaaggagauguccauaagcagcagggcccaaacguggcugaauaucaggguaaccugcagauccugucccaaaccaacacaaacaucuggauucaggaggcccacgguggggcccccaaaucuguauuugaaacaaggaaccacucuccuggagcacggaguguccccugaauguguuaugaccgagaacuuacggugacuaucuagacuguuaguguuccagaccauaagacugcugugauuuaugaagcaauuagcauauauucugucuggagccuccccuggguggcucacacgucacuugugucuuccuaguguuugcaacaacugugacaaugucacugaguugagccacugcaggcuuaacacucuggaaguuuaauuugcccaagcuucuauuuucuggcuaagaaccagcauuuucuuagaugguucacuuucccuucaccuguauuucccugucugacuagaggcuuucagggacucuuuuuccugaauaaaucaaguuucuaccaugcuuugaguggguacugugcaugugacguggcggaggacaugggcggcuagcugugcccacucacuugcucagcagcucgccccacaaccaggcugacagggccccuuuguaaauuuaugccacagauaaauucuuccuuauugggggccccugggguugaacuuaaaugauugaagccacaaauauuaauucucagauaccaaggccuucugaugugucauaaagaauucccuccaaagugagagagggucucugucaaucuuauggagcaugggaaggggaagaccaccugacaguagggcagggagaggggcugccagguaagcuugaggggcccuugaugcagccuggcacccccuagccugcccugugccuacagccucgugugcaucaccggggccaguggggaggagguggccggcgccacagcgguggaggugccgggaagaggacguggugucucagaacacgacuuugccuaccagguaccugacugcugagccacccccagcugccagcgggccaaccucucugguggcuccucucaacccaucugguuauuccuugguggggcucccaguccugggccagccugucucucaggcugucccugccuccaugugucuggucugaugcucaucucucucccugucugucccacaggauccgaagguccauuccaucuucccggcccgcggccccagagcugggggcacccgucucacccugaauggcuccaagcuccugacugggcggcuggaggacauccgaguggugguuggagaccagccuugucacuugugagggccacuuccucauccugcaaaaauccaucugcuccaggggaaagauggaggggucugagauccuggggagagcagaaaggggaagagggccagucugcuccuucagagaguggccagacccucccuagccagcuguggugggagugcaccuccagggacaccugguggagacugcagucagcgcuugagggaagccaguuggggccugagugguccaaguuuucccugccugcgccccugcauucauucccaccuccccucccaggcugccggagcagcagucagaacaacugcggugugagaccagcccacgccccacgccugccacgcucccuguggcugugugguuuggggccacggagcggaggcuucaacgcggacaguucaaguauaccuuggaccccaacaucaccucugcuggccccaccaagagcuuccucagguguugggccagggguguggcugcauggcagguggcagggaggucuuugcagcuccacuauguggggguuuguagggcuuuauguugaggcacugagaaucccaugcugcuaguaggggcaaggggucgugugguuuggggcuggggcugagcugaccuagccgggacugggcugugcuuuagguccagguaacauaagccaucuuacguuacguaagcucacggucuguuucaguggaggacgugagauaugcguccguggccagaaucuggacgugguacagacgccaagaauccgggugaccguggucucgagaaugcugcagcccagccaggggcuuggacggaggcgucgcguggucccggagacggcauguucccuuggacccuccugcaguagccagcaaguaggacacccuuggguacccccacacucuccccuugccccauaccacacccuggggacagccagagcaggugccagaggaggcucuucccaucuuugcuuggccccucgucaaccugccugucuuccuuccaguuugaggagccgugccaugucaacuccucccagcucaucacgugccgcacaccugcccucccaggccugccugaggaccccuggguccggguggaauuuauccuugacaaccuggucuuugacuuugcaacacugaaccccacaccuuucuccuaugaggccgaccccacccugcagccacucaacccugaggaccccaccaugccauuccggcacaagccugggaguguguucuccguggagguacagcuccuacuuggaccuggcagggccccgagacccuucccuuggcuggacagcacugcuguguguggcggagaggccgagacaguagagcaagggccgguggauggacauggcuccucauccuugcuguggugggggcagagggggcugguggggggugccuagccuagcaucuggcacgagcuggacugcuuggcugguggcccggguccugaugcacuccauggcaggcucuggaaugacugcauuuguauguucggccugugcaguagcuggguggugugguccacauaggccaucgggcugacccccguuggcagccuggcucacauggacaugcgcuaggcaugugucuuggacauacacagugggcagcagaugggcaugcgggcagaccacagguugauacagcaucaucaccccccuggugagucaucagacacagauugggggcuccagcuuuguuagguagcugggcaggauuugggaggcagcuuuauguucuccagauuuuucguucuggagaagaaagauaggaaagggcaacaaagggugaugaggagcagcuuggaggacacugugugacuggccugcacucgggaagggugcugagaggcugucagcuuugcugcugcggcugggucucaggguccuucccacauuuggggaggacaggaucugagggaaggguccugagugacugaucggugacccucuguuccagggggagaaccuggaccuugcaauguccaaggaggaggugguggcuaugauaggggauggccccuguguggugaagacgcugacgcggcaccaccuguacugcgagccccccguggagcagccccugccacggcaccaugcccuccgagaggcaccugacucuuugccugaguucacggucagugggcaggucccuggccgggcugggcauugaccugggccaaacccuugcucacagguggcuccugacacaggugcagauggggaacuugcgcuucucccugggucacgugcaguaugacggcgagagcccuggggcuuuuccuguggcagcccaggugggcuugggggugggcaccucucuucuggcucugggugucaucaucauuguccucauguacaggugggugcagccagauguggcugggcuggggcaggucgugggaucuggcuggacugggaagggacagaccgggccaggagucaggaaacauucucuguaaauggccagagaguaaauauuuucgcuuugcaggccaaguggucucuguucaacaacucagcuuugccacuguggcacaaaggcagccagggacgacauggaaacacaugaaaguggcuguguucuaacaaaucuuuauaaaaauagguugugggauggauuuggccugguugugguuggcugaucucuaggcuaaacugugcugggcuagacggggcaugggugugugugacuugcuugggacgggacaggcugaaucguacugggcuaggcuugagcuuggcuggcauggcugcauuggacugugcuggaugaggccggggugugccuggggauugucaggcaggccugggcgaguaggacucaucuggccauccucuccugacccuggggcugagcaggaggaagagcaagcaggcccugagggacuauaagaagguucagauccagcuggagaaucuggagagcagugugcgggaccgcugcaagaaggaauucacagguguggcugggagaaugggccccgcccuccagaacucugcccaaacccacucccaucacacgggauuggugcuuaacaggugcuuaaccuggccucuucugcuuaacagaccucaugacugagaugaccgaucucaccagugaccuccugggcagcggcauccccuuccucgacuacaagguguaugcggagaggaucuucuucccugggcaccgcgagucgcccuugcaccgggaccugggugugccugagagcagacggcccacuguggagcaagggcuggggcagcucucuaaccugcucaacagcaagcucuuccucaccaagguacccccagcugcaucuuccuggccugccccuggcccugccccuucuccagggcaugguuucugagcccgccccucugucccccuaaaccccuuuucccaucccuucucuuuggcugcaguucauccacacgcuggagagccagcgcaccuuuucagcucgggaccgugccuacguggcaucucugcucaccguggcacugcaugggaagcuugaguauuucacugacauccuccgcacucugcucagugaccugguugcccaguauguggccaagaaccccaagcugaugcugcgcaggucuguguggcuguuggggcugggugggcccuggacagcuggagcugggguggggccucgggcuggggggucugcaggauagagaggcccgcagccccaccugcugacccuggcacuccccuuucccaucaucucaggacagagacugugguggagaagcugcucaccaacuggauguccaucugucuguauaccuucgugagggugagggggcagagguggacagggcuccuguccagggagggucaggcccuccaaacuucuaagcccucagccaccaugcagcucggacacuugugccagagcagagacuccugcucagccuguccucaguccccuuaagcccauguccuguccccuuccccagugugcgucaugucccauacaccucugccaccugcuggggggcccuaacugccugugcucuccuaggacuccguaggggagccucuguacaugcucuuucgagggauuaagcaccaaguggauaaggggccaguggacagugugacaggcaaggccaaauacaccuugaacgacaaccgccugcucagagaggauguggaguaccguccccuggugagggugugcaaguguguggccugcagucugagugcggugagggcgaggguggagaguguguggguguguggggucuggacaccagcuucugaugugguaccuggauguagagcuggguugaccucuggcuggcuccuggagagagcccaucagacuagcuuagcaggauagcaguuuagggcagacuuugaugauaaggccucuaugugccccaggcuagggauggaacuaggguagccacaaccaggguuugggagaagccagcccuaccuuagaccaugggcuugagcugugucagggccugacccugucugccuggcccuccuaccaggaaugcggccuugcccaccaagccagccucacucuggcaggcacuucucucuggguuugcuuuccccuuaguuacgcacaaggguuccugugggaaacccccauucaggccugcugaaccccuccccugucggauaggugggaauauuugcucccgauggugggaaugcaggcuucccgaaacuccgucagccugacccauucagccaggaaccuggggaucugagugaugagggacuugugcucacucauuuuuuucugccauuuaccccauagugguuuacaagugcacugcgcuaggugcuggggucacaauggggaggaagcugcugucccuggggaaggcaggcaggugaagagacgagaauuagggauuguguggugcguggggauuggaggcagcaguuucucaugaguugucucugcccuuggccugugucuuggucauccugagugcacaugaacccugauggcuccuguguguccugcacagaccuugaaugcacuauuggcuguggggccuggggcaggagaggcccagggcgugcccgugaagguccuagacugugacaccaucucccaggcaaaggagaagaugcuggaccagcuuuauaaaggagugccucucacccagcggccagacccucgcacccuugauguuggugagggcguggagagccccuggggaccugagccacuguugggccugggcuggccccggaccaacucugcagggacaacucaucacucaggguggggaggaugcugggaggcaggcagaagcuggcuuuggaacaucuuucuuggacagccucucaucuggggagggggucccugcucuuggucuuuggagagguugaguaaggcugccccaugauggaggggcuggugucccuguggaggaggagaugggcuccacuaugggaaggguaucuuccagcccugcacccaguucugccuugcccuugcagaguggcggucugggguggccgggcaccucauucuuucugacgaggaugucacuucugagguccagggucuguggaggcgccugaacacacugcagcauuacaagguaggaggagugggagcuggaggagggcaugguggggugggacugguggagggaucaccagcugugcucagcaggucccagauggagcaacuguggcccucguccccugccucaccaagcaugugcuccgggaaaaccaggauuaugucccuggagagcgugaguaccgcucccaucacgguccucugccccugcugugcccagcccggagucauggggaagguccucugggccucagggcaggcuugugccuauuuccauucggcccaggaaaucccucaaccaggugcccccaccccugggagagcuggcaagaaacagggggccuggggagguggcaccuggggaggggugacagcugugggcucuuggcacagggaccccaaugcuggaggauguagaugaggggggcauccggcccuggcaccuggugaagccaagugaugagccggagccgcccaggccucggaggggcagccuucggggcggggagcgugagcgcgccaaggccaucccugagaucuaccugacccgccugcuguccaugaaggugggguggggccugccaagguaguggggccugggcugagagggagcauggccacucgugggauuugggggugguguggggcucgugcaggcacagugccggggggugucugaggcugggcugcugcugagggcccuuugcugaccacaccucucugcuucuuccuucccacagggcacccugcagaaguucguggaugaccuguuccaggugauucucagcaccagccgccccgugccgcucgcugugaaguacuucuuugaccugcuggaugagcaggcccagcagcauggcaucuccgaccaggacaccauccacaucuggaagaccaacaggugggguggagcugggugggcucuagguguguguggggggucuucucuucugccuccccagcacauucaucggccaugccugccccacccgcagcuugccucugagguucuggaucaauauaauaaaaaacccgcaguuuguguucgacgugcaaacaucugauaacauggaugcggugcuccuugucauugcacagaccuucauggacgccugcacccuggccgaccacaagcugggccgggugagcgagucugggauggacacgggggggaugggugaggguggacagugcugugugugcacucagauuccaggcuuuucugagaacuucaaggagggcuuaggggagaccucugaccucccaagccaaggcuucaucccggggccaccucaguuuuaagggaugagcaagaggaggggacacugugugccaauucacaggugaaguugugugcagcaaguacagccugguguggcuggggcauagaaugcuggccaggcguggcaguaggccagggccaguuggucaggacucacuccuggggcagugggagccacagaaggucugggaacagggaaguuaugugaccagaccugagaguuugguggaacauuguggcugcugugcauggaugagcugagugagggagucccaagagggcgcugugcuguccugacaagcaguggcuggguucaagccgggugggagggugcagggcaggcaaaagcugaagguuggaugugggggaugaggaagaaggaggggagucacacaugaucccugggccucuggcugugguaagcuuagacuuggagaaggugagucugguguuugugggguuuccagauagagacauggauuguucaaucccagagcagcucugggcugcugauuagguuuaauuccuuagggugguggaggugucugccugccaguagggaaguagggaagagaguucauggagugucacaguuugagggaugugugaggaggggagcugggaagcacaggagacugagugguuggagccguccgggagcacagagguugggagucuauugucauagcagucaaagccgggaguccccugacauaugagguccccaaggugucugcucaagcacccagugggcagggcccucgugugacucugcagguccaugaguggggcucugcuuagccuagacccccaggucucaguuggcuugggacuucuugagagauacaucccuacaccucugggaaaaaucaaaauuagcuuggcacgguggcucacaccuagaaucccagcacuuugggaggcugaggugggcagaucgccugaggagcucaggaguuugagaccagccugggcaacauggcaaaacccugucucuacaaaaaauacaaaaauuagccaggagugguggugugugccuguggucccagcuacuagggaggcugaggugggaggauggcuugagccugggagguugaagcugcagugagccaugacuacucuguucacugcacuucagccuggguaacagagcgagacccugucugaaaacaaaaacaaaaacggaaaguucuguccaaaauuguagcacugucuuuugggagccauuuuuguuccacaugcugucaucaugccuauaaugagcuaagaaucaaagggccacaccaggacccgcagggccaccuccaggguagacccuaugugguggcugggauuuuugccagauccuuccaguaccuccccuucccagcagaacagcaaaugguuccuggguagcucaggaguaguccgaacaaagaaugccaaggguucccccauggggaguugucgagaaggcgcgaauccugacucagguugacagaggagcuggccuuggaucccugcucaugggggacagugccaccucgagauauucucaccuucccagcagcucuaggaugaggagagguccugagaauagaaguaugcugcccagagcccauggcugcugggacuugaacccaguucaguuguagacgcugugucuagguguguuaaagugguggaaacuggacagaccugcuugaaauccuagcucagccacuggggagagagguggucuguggccgcuuagguaauguucugggucuguuugcucauuuuuaaaaugaugacccugggagugaacagcaugcguccugcccuacguaccgggcucuugcuggaucuagaugguggcauguggagcugagaaaugauuuccgaugacaucagagacuggacauugguggaagggagggagcagcagaggcuccugcggaaggaaguaggcgagggugaccaccuguccugguuuuccgggacucaggggcuuccugggaugugagacuuuuccuuuucaaaacugaagcaguacugggaaacccaggacacuugaucacucgaacagggacccucauccuuccuuccuuccucuuuugcuguccuccugcuauguccaggacuccccgaucaacaaacuucuguaugcacgggacauuccccgguacaagcggaugguggaaagguacuggagggcacgguggguagagguuggagggcgugugcagcugaggcuuggggggugggcucugguugggagcaggggagugggcuuguuuacccagcagcugcugugcccuggcucucuggcagguacuaugcagacaucagacagacugucccagccagcgaccaagagaugaacucuguccuggcugaacuguccuggguaaggccucccucugcuucuuggguugggcauaggccuccugccacaacgguccuucccccuucacacugccccuuugcagggaagcccuugggaaccucagcagcccugugagcugguuggggcaggaaacauaaaugcagaauguuccaacugccacugaaagaccagggcucccaccaucucaucacagagcaagcaggggucuuguccuggcagcugccauguacccugauucagccaggcucuugcaagguagcugggauucagccccaggccugccugggucugccugcaugcgucuucccacugcugugcuucccuugguggcacagguguccccuucaccucucccauuccugaaaccgcccuaaaauguaacuccagggaguuuaugaacaauguuucugaaauguugaugaugacaaccacaacacuaauagcagauauaauuuugggguguugugugugaagcccuucauggggugcuuugauugucuuauuugauccucacaagaacuccacaagcuaggugacaccaauuccaucguccaggugaggaaguugaggcucagagauguccccauggaggggccugagagugaccucaggaaauacuugaguuaggccagagcagaaucaugcugggcugucagccugcaaguggcaucugugccacuuggcucuggagucaucuggguggcagagggucugggcuagaaccucaagggggugagagaggcagggcuucaguggaaaccccagaccuugcugaagcagguagaccugggcugucuuccuaccaaggaggcccccuugcucuacccuguucuguccccaucuggcacaccuggccuggggucccugggccauggaggggacucugcuucccacuguagugcccaucccauucucuaccucucagguccccuucucccccagcccuucccugggguccugggcugccuccuguggcucucugcaccccucgucucucucaccuuucauuuggccucuucccuagaacuacuccggagaccucggggcgcgaguggcccugcaugaacucuacaaguacaucaacaaguacuaugaccaggugggcaggcccuggaccccgacugggaggcugacccaaggccucccaggagacuuaaggggcucugacccugugacucacguugggggcuuuggucuuccccagggacagaguaguggggggccgggccccuugguggcuugagaaguguuuuccaggcgggcuuccuggcauuggcugugcucucaccugucccacugcuccccauuccagcuccccagcaggacggcgaggcacagugcuggugguugugggggccaaggggucuaccagggccuggagauggugugcauuugcugaguuggcagcauguugggcacggccaacaugcaagugcaggccuggcuuggcugcaugagcugcgaagaggagaguccaggcacagggccaggggugugaggguacacuggagcuggugaagcuuuuuggaggaucccugggcugugccugaagagcugagcaccugccagucaaccugcuggaugccugguggaauaguccacuuagauguuuguguggcaccagugacauggcuauugcugcucagagaugaggaaccugucucauggcccacagccuuccucggcauggugugggccauggcacggggcuugggggaggcagggugugaugcaggcauguccccuuguggagacauagugggcaguagcuguuuucccaagugcugcugcccuccgguuccuaccgguucccuugguggcagccccaaauucgugguucguguuugaucagugucuguuuucccaccacgugucuggucauucuugggucucugccccuugucuggcaccgggcagacaggaacuugggaaauacuguuggcuggcggguggguuagccaggauggcugcagcagggcuucugaggagcucgcuacugagucagguccuucauuuccuaccuuauucauccuggaaccccgcggugacuuugauguuauuaccccucccgccagcgaggcccugaggucccagaaaguacgugaagugaccggcuggguuucuuggccuccuaccccacucaugccacagcgucuuaggagggcuguugaauuuugcagcaaacacguuggccaaagaagucuccccugauggcauuggucucuguuucagaucaucacugcccuggaggaggauggcacggcccagaagaugcagcugggcuaucggcuccagcagauugcagcugcuguggaaaacaaggucacagaucuauaggaacccaggagccacggccugcuguugcuucagccuggccugggcagcccuggaagcucggaggagaggccaccuucuuaggugccuguagugacugacaagcagaguuaguggaaggugacucccagucuccugguggcucuggccucggcccugcuggauccaccuccuagacccggggccucaaggcucaugggguaguacccagccugcuccccgaguccagcgacccugugacaccggucugcagggaguuggggacuaagggcuuccagagaguggcuggaagagacuccaggccccuggggagacuguacuguuccugaacacuggccuuggccacacugggauucggagaggaaggaggagagccccaugcuuccugucugccuccuccaccaucccugaccucaguugagcugccucuggccuuguugcugcugccacauccuaggucuaagaguugaacgccucuccuaggccacuacaaacugaccccucagcagggcuggcugccacagggcugcccugccucauagguagccauggugagggcuaucugcugcaggggggucuuggggagaguggugacuccauugacccagcuuuucauuaaaggauaacacacugcacugagucugaugugugagcccggccuagccccuggcuacuaggaggacggcagcuaugcccagcagguaccagggggaggugguaucuauacucuuggggagucucaugguuccccaucauaucccagacugcagggcuggcugaggcucuccuugacgccugggcagggucugguggggucaaagcuuccgugaaggaagaaccccaucuggggcagggcgggugaccgagauagaggggucuacagucucuucaagggggccugcuuuaucugcaguuugcguauucucacuucuccacucauguucuauuuaucuugaaagggacuaggaaaggaugacauaauuacaggcaacucuaggcagagggggucucgagggccauuuuccaugguccuguuccuggacuuaggguuucuguguugccuuccaaaucagggcauccuagggccggcuccuaaacugucugccuccaugaaggccgccuuauaugguucuuccugauuuguaccuggaggugagcuuggagacugucuuaucuggucucauguugcuaguugggucuguagggcaggggguugauacuccucuugacuugagaccacccucggccuuagcagaaggccagccccccauggaacagaagagauaggguggcagcucugccuggcagaugagaggaaggcccuucagccuugaggccuucagagggaucaucccuuuggcccucugcuuauccuccauaacccagugacccuuagcauuuccucucgucuggcacagagaccacaaccuccccucgaggucuucauugaguguuuagagagagacagacugauagaauuccaggaggacuccuauccccugccuuuuuuuggcccuaaauaaagccauccacuguaggguugccccuacaauccacaaaguccuugucccuaaggagccauguuggucuugucugugccggggguagucauagcugcuauucuucgcuguggcuccauugucccuucuuucccauuucugccggauguggggaccacagucaggucagcagccaggugccaucauuugggagcaugugagcuuggaugcucuggccagguuuucauagccacccagaaugguccugacuuuucccguuggagaccauggaaugggucuccaucuugaccaucucugggagcaggguggaugggaaauccacuugaggguggacuucaagcagacacagagggaagcagccuuggucagcaccacagaccucgacagagccaugccucuguuccagaggccucucuguuccagguucaggccccugcagguuuuagggguaggugaaggcucccgggagaggggggccaugugccugcaagccugggcacgugcccgcgggaggggugaguacugaacgugcuuugagucacucacugagucauggcucggccgccacagaacauuguuauaauaacagacauagagaagaaaaaccuggcacaagaagauaggaaa

SEQ ID NO: 16149 - RNA, 781 nt, Homo sapiens
aaaaaaaaaucuuaaaaacagaauuuuagaagaugccagaaaaagaguuaguaaagaaugcuugccaagggaaagaauaaauacuaagaguuuuccaauaaaauauuuaaaaguagccaggcaugguggcucaugccuguaaucccagcauuuugggaggccaaggcaggaggaucacuugagcccaggaguucgagaccagccugggcaacauagcaggaccccauuucugaagagcagucacucaacaacauguguaagucaacaggcaauaagaaacaagaagggacaaaacaccaaaaccucacuccuuuacuuguaaucuucccuaauguuguuacuugguguuaauacuuaguauccaguaaaauuacugaaaggaaaaccauaguauauuuaccaacagcuuacuugcauuauugaaauuauuauaguacauaccaauugauauuuuaauuacugguuucuauucucuucauccuacacauuuuccaggcaaacauuuuucauucuauaucgagguaauuucuacccaaggccuccccugaggaaaaaaccaaguaauaaauaauacaacccuuaaaaguuugcaaauuaagaaguccacuuuaccugcugugacucccaugguugcucugagaaacuggcugaacaggaugguuuuuguugauaguuuguucauaaugaacuaggaaggaaggcaaagcuuauuugucuuuucaagguuccaaugccuggaaguagaagagagugagcuuugaaauuaggaaguguagauaug

SEQ ID NO: 16150 - RNA, 2163 nt, Homo sapiens
cacucacugcccagcaaguccugugaagcaauagccaggggcuaaagcaaaccccagcccacacccuggcaggcagccagggauggguggaucaggaaggcuccugguugggcuuuugcaucaggcucaggcugggcauaaaggaggcuccugugggcuagagggaggcagacauggggaccaugaagacccaaagggauggccacucccuggggcgguggucacuggugcuccugcugcugggccuggugaugccucuggccaucauugcccagguccucagcuacaaggaagcugugcuucgugcuauagauggcaucaaccagcgguccucggaugcuaaccucuaccgccuccuggaccuggaccccaggcccacgauggugagcuuugggggacauucugcucugcucuggcugggcuuggccacguguuguuccuucugcuccugcugcacugccugccaggagggcaucucccccuuuaaauguggucccguguuuuccagggaaccuucuagagcucgugucuccucccagcucgagagcuuccugccuuauaauuccugcuguggcagagauacccucaccccgaccccacgcagguuuugggacuucugcgagcuccaggcacuagaauggggucauuggcucugggcagugaccuccucugcuuuaagucucuucuguaccacguuaccccacauagggaagaacucuauccagacuuuagguuccagugggcaugucuugucccccaggaagcccccugacuucccuugcccccaccccagagugggaggggcuccuuguuagagcucaucugaggucugcuccuacucacuguucaccuaggaggguaggaauggcucaguccuccuccccucaaugccccagugccaagcccagcacccagugcccgucgcacaucagguacuguggaaagccugcccucuugguggggaggucauggacacaaaucagaaaauacaagaaugggccuccccauuuccuccucugacuaggauggggacccagacacgccaaagccugugagcuucacagugaaggagacagugugccccaggacgacacagcagucaccagaggauugugacuucaagaaggacggggugaggcugggggcuggggguguuggugggugccucccaaggagcugaacagggggcaccuggggaauauuucccacugggauguggcugggaggucauggcaaaugguuucaaguuugaccuugagcuucuccuuuccagcuggugaagcgguguauggggacagugacccucaaccaggccaggggcuccuuugacaucaguugugauaaggugagugggcuguucugggaugcaggggcugaugggggcauagaguguggaccauccaaugggucaauuaacuacucccccaacccaggacagagaaagccccuccuacccagggcucuuccccaaaccugaguuccaucuccagggccggcucuggaaucccuuagagcgguagaucuccaaguguagcccuuccuggggacucguuagauaugcaaauucucaggcccuacucagaccuacucagacagacucuggguagggcccagaaauucguauuuugauaagcuuuccaggagauuccggcuucuguaaaguuugagagccacugucuaagaguacucagcucucagcccuguguucccaucucaguguugcugggcugggcugugugacccugcagagccccucacuaucuccgggacucuguuuucucaucuuuuuauuggguguagggauucaaucacaugcuucaaaggucacagccagagguugaacuggggccccaaagcuccugcgggggcccacgaagaggggcgucuagguggggaggggucuuggauugacccuggguacauccccgacaaggaaccuguuucuuccuguacacaaccccaggauaacaagagauuugcccugcugggugauuucuuccggaaaucuaaagagaagauuggcaaagaguuuaaaagaauuguccagagaaucaaggauuuuuugcggaaucuuguacccaggacagaguccuagugugugcccuacccuggcucaggcuucugggcucugagaaauaaacuaugagagcaauuuccucaggc

SEQ ID NO: 16151 - RNA, 3394 nt, Homo sapiens
uagagccagcggaaaaguccgaaucaccuuuaauauggguuacaaaaguagcaaaaccagcugaggcuuaauaagaggagguggaguagggauccaaagggcagaaccacuccucacugcccacuccccaccauauccugggcccucuucuggaggggauggguggauaaggggaagugaaugguggcuggaucuucgguuuucuuccccagaacagagcaggcugagcccagcaaccccaggaagcccacaaagggaaagauauaugagauggggguaggggagcaccggagcagucuccgagagugcaggcuauggagacagcacucacaccacagaacagcccucagcuugggggcccaggaccuggaccacaucuuccuggcccauggcaaccagggcauucucuagcaccuuguggguggcaccacugucuucuuggauagcccagucccucagcaguguguaggcucacaccuggccuugggccaugauuucuacagccucagcuugguagcccagauggucugccaguccccgccagcccuugucagguucacgugacaccucuaacagccgcuccacuuucuccuggugcugccgagggagaucaaggugaagucggcacccaagcucaggaugugguccuggggcaggagacaugaggaucacacaagggcuggguggugaggcaguucugggaaaggggcucacccuggcugggggcacagggcuccagacugcuaggagaguccaggaagacacugcuauccccaugcaucugguccuuguugagaccucccagcucugcaguucgagcuuuggccagcugcugucuuuguuuaugugagcgccagcuguggggagaaagggagaccuaccaaccugcccccaccuucaagacagggaauugguugggaguccagacagggaagggggugccacagggcagugcccagaccaccuaccacuugaaggccauguaggcaagcagaccgaggaccacaguggccagaaggguacaguagacugggaugaugcugccugagaccucuuggagacuccaggaggaaaggggaggagguauugggggccagggcuccuccugccccuacccauacuccuucccugucccucuccugccuccucaggaucuuaccuguggaagaaaagacagaucaggucaggagcaaggaacaaaggcuagggucccuggguagccucaccuaaacuuuguugccaaaaagauuugaagccaguagucccuacuauuagagucaaaagcuuauaccacagcaucaggagcugucuggccuauuuuuccauuuucaucuacuucuuccccuuugcuuaccacucuggacaccuuguccuuccuagaugcacccuguucucauaaccuuccagacuucugcucuugccaaucucccuucuccaucugacauauuggcaagaaucuucuacucugggaagacuucuugaucucuuccuuuuugggguccauuugcaccuccugucuaccacggcacuaaauccaauuuuuuuuauccaauuauccagggcacaggaagaaagaccauggcacugucuaccauggcacuuguguccugucuccgccaccaagucuggacugugagggcacauugauucaugugguccccacaagcaucucugugcaaaggaggccuuguaaauuuuugcaaaauaaagcugaacuggaaaggaaguguuguugcuuucuucugccuggaagcgacuuguccuuccaaucuagugcagucagggcacacggggcagagacuccagaaccuguggcuggacuugggugugaccuacccacuugggguaccucccagccugcccagugcccaugaucuggaucaacggaugcuuacccacauaggccaggacuuugcuguggcuagaguugugaaucauggcucuguuagugguuaauacuccuggggcuguuucuuggagaagacguuagagaguuuuaggcagcgcccaggcaggggagcugggagcugcuucucucaguccaaaaagggcugugugcaggaggaauaugggggaaaucuccaggccugacguuggcagucccuugggguagucugucccccuuuucucacuucaaccugauucauucuagggcuggaccaguuuccuccugugucagauggggcggaggugacagagcuggucccagcuggccaaaauuagaagggucagauacagcucaggauggaagacagguuggaaaccacccugucucaaagacguugccaaacaccuggucugaguccagggaugguagggaggauaggggagacgugccuucuagcuccaucuuggccagaaccaggcuggagagauguacuggccagugggaggcucaccaccaggcuuuuaaacuagaguucaggaacccaacauccuaaagccccaaggcaggaggacuuucugcagugaccaugcucgcacucuuuccucaagggucaguguccagcccucuccugaucaggaacuggguggaaugcuacccugguggguucagcgagggaauaggggauaugggcccagagacucccuaguugauccugcuucauccagaaauucagagagggccugagacucaaaggauaggaccgcucaguccuaccuggauccuauagggcugaaucugcugggacccacuuccugagguuuggggaagagaagcuccucgucuagacuaaggagagcuugccuggagaaggaauggaggagacauccgggaaggcccuccagcuccccaguauccaccaccacauauuggguaccgaucuaucccacaccaugugcccauguguauggcuaaaucagcaacccagugcuguggccaagugggugcgaccugguagcccuugccacauauggguguguaccuuugugucacuuacauuaaggggcccugcaggauccuggauaguggaugggccugugaccaggacgcagcagcagacaggccuggcuuccgcccagccuacucugagcagcgggacuggaaccccucccgccucccaccugucuccaggcccacgaauacgcacacacaaugcaaccaccccgcacacccacacuaccccugacuucucacgcacacgccgacaccagcacauacaacacccgcaggaucgcgagucuggagaugggggacagagaggcagcccccggcucccuccgcucagcaagggcucugcccccaacuccucaugaccaguggccgccaggauggauccacucagcagggcaggaccgagcccuccgggaagacaacguggacucucuggggugguucuggccccccacccccaaccccgagaccacagcggcgccacagggcggcccaaga

SEQ ID NO: 16152 - RNA, 3394 nt, Homo sapiens
ucuugggccgcccuguggcgccgcuguggucucgggguuggggguggggggccagaaccaccccagagaguccacguugucuucccggagggcucgguccugcccugcugaguggauccauccuggcggccacuggucaugaggaguugggggcagagcccuugcugagcggagggagccgggggcugccucucugucccccaucuccagacucgcgauccugcggguguuguaugugcuggugucggcgugugcgugagaagucagggguagugugggugugcggggugguugcauugugugugcguauucgugggccuggagacaggugggaggcgggagggguuccagucccgcugcucagaguaggcugggcggaagccaggccugucugcugcugcguccuggucacaggcccauccacuauccaggauccugcagggccccuuaauguaagugacacaaagguacacacccauauguggcaagggcuaccaggucgcacccacuuggccacagcacuggguugcugauuuagccauacacaugggcacauggugugggauagaucgguacccaauauguggugguggauacuggggagcuggagggccuucccggaugucuccuccauuccuucuccaggcaagcucuccuuagucuagacgaggagcuucucuuccccaaaccucaggaagugggucccagcagauucagcccuauaggauccagguaggacugagcgguccuauccuuugagucucaggcccucucugaauuucuggaugaagcaggaucaacuagggagucucugggcccauauccccuauucccucgcugaacccaccaggguagcauuccacccaguuccugaucaggagagggcuggacacugacccuugaggaaagagugcgagcauggucacugcagaaaguccuccugccuuggggcuuuaggauguuggguuccugaacucuaguuuaaaagccugguggugagccucccacuggccaguacaucucuccagccugguucuggccaagauggagcuagaaggcacgucuccccuauccucccuaccaucccuggacucagaccagguguuuggcaacgucuuugagacagggugguuuccaaccugucuuccauccugagcuguaucugacccuucuaauuuuggccagcugggaccagcucugucaccuccgccccaucugacacaggaggaaacugguccagcccuagaaugaaucagguugaagugagaaaagggggacagacuaccccaagggacugccaacgucaggccuggagauuucccccauauuccuccugcacacagcccuuuuuggacugagagaagcagcucccagcuccccugccugggcgcugccuaaaacucucuaacgucuucuccaagaaacagccccaggaguauuaaccacuaacagagccaugauucacaacucuagccacagcaaaguccuggccuauguggguaagcauccguugauccagaucaugggcacugggcaggcugggagguaccccaaguggguaggucacacccaaguccagccacagguucuggagucucugccccgugugcccugacugcacuagauuggaaggacaagucgcuuccaggcagaagaaagcaacaacacuuccuuuccaguucagcuuuauuuugcaaaaauuuacaaggccuccuuugcacagagaugcuuguggggaccacaugaaucaaugugcccucacaguccagacuugguggcggagacaggacacaagugccaugguagacagugccauggucuuucuuccugugcccuggauaauuggauaaaaaaaauuggauuuagugccgugguagacaggaggugcaaauggaccccaaaaaggaagagaucaagaagucuucccagaguagaagauucuugccaauaugucagauggagaagggagauuggcaagagcagaagucuggaagguuaugagaacagggugcaucuaggaaggacaagguguccagagugguaagcaaaggggaagaaguagaugaaaauggaaaaauaggccagacagcuccugaugcugugguauaagcuuuugacucuaauaguagggacuacuggcuucaaaucuuuuuggcaacaaaguuuaggugaggcuacccagggacccuagccuuuguuccuugcuccugaccugaucugucuuuucuuccacagguaagauccugaggaggcaggagagggacagggaaggaguauggguaggggcaggaggagcccuggcccccaauaccuccuccccuuuccuccuggagucuccaagaggucucaggcagcaucaucccagucuacuguacccuucuggccacugugguccucggucugcuugccuacauggccuucaagugguagguggucugggcacugcccuguggcacccccuucccugucuggacucccaaccaauucccugucuugaaggugggggcagguugguaggucucccuuucuccccacagcuggcgcucacauaaacaaagacagcagcuggccaaagcucgaacugcagagcugggaggucucaacaaggaccagaugcauggggauagcagugucuuccuggacucuccuagcagucuggagcccugugcccccagccagggugagccccuuucccagaacugccucaccacccagcccuugugugauccucaugucuccugccccaggaccacauccugagcuugggugccgacuucaccuugaucucccucggcagcaccaggagaaaguggagcggcuguuagaggugucacgugaaccugacaagggcuggcggggacuggcagaccaucugggcuaccaagcugaggcuguagaaaucauggcccaaggccaggugugagccuacacacugcugagggacugggcuauccaagaagacaguggugccacccacaaggugcuagagaaugcccugguugccaugggccaggaagaugugguccagguccugggcccccaagcugagggcuguucuguggugugagugcugucuccauagccugcacucucggagacugcuccggugcuccccuacccccaucucauauaucuuucccuuugugggcuuccugggguugcugggcucagccugcucuguucuggggaagaaaaccgaagauccagccaccauucacuuccccuuauccacccauccccuccagaagagggcccaggauaugguggggagugggcagugaggagugguucugcccuuuggaucccuacuccaccuccucuuauuaagccucagcugguuuugcuacuuuuguaacccauauuaaaggugauucggacuuuuccgcuggcucua

SEQ ID NO: 16153 - RNA, 4294 nt, Homo sapiens
gucuggagaggggcagccgguauccaugacauguccucuggcggcggcucccggggccuccuggcguggcuucugcuccuucagcccuggcccgggcagaacugggcgggcauggcggcgccacgccucccguccccucuccucucagaggagggcggcgagaaccccgaagcgagcccggcuccaggaccugaagcgggccccccacucaaucuguuuacguccuuuccaggugacucacugcgugggaggcccggaggcggagguuggggcgccaggcuggggcaggugcuaccugggagccugcgguccgcggcccggggaaucugaagcguggcucgggagccccgggggacauggccuccuucuuggcugucgucggggcgcccgggggagucaacuccugugucuuugagugaguucuucauccuacacuauccucaccccaguguguggccgaaccccucugagaaucgugggaggaguggacgcggaggaagggagguggcccuggcaggugagcgugaggaccaaaggcaggcacaucugcggcggcacccuggucaccgccacgugggugcugacggcaggccacugcauuuccaggugaggagcggcacgcggggcugggggccggcccccucaagcacacacaguuccauugccccggcaauuuggcgacaaagaaacaaaacucacagugaagccggagugcaucggucgucuugcuguaggcaugucuaagucgggcagacaaaccaaguuugagagugaucaaggaaggguuuuuggugauggcgauggggugguagggacaguggcccgggagguugaggccaguuucagaaacauuggaaauguauggaaaaggcacaaaggauguuucccaggccuucucuuagaggcaucucuuccacagccguuuccauuacagugucaagaugggagaucggagugucuauaaugaaaacacaagugugguggucucaguccaaagagcuuuuguccacccuaaguucucaacaguuacaaccauucgaaaugaccuugcccuucuccagcuccaacauccugugaauuuuaccucaaacauccagccuaucugcaucccucaggagaauuuccagguggaagguaggaccaggugcugggugaccggauggggcaaaacaccagaacguggugagacuucaaggcaggaagcaaacuuggggcagagaggaggcacccuuacuccuggaguagacaugaaggccacagaaaggggcagggaggcaaacugccuggugaguggcagguggugaggggcacgcaguuuagcagcagucagggucaugguuccugguuggcuugggugacaucagaaacuggguugaguucuuuuguugcaacacaaauauuugauggcagccauuuaggaagacuucuguccuggaacuggaguugcucagccaggagaagaagaaacacaugggcaacaucuccuucuguggauucgugggggcacugugcuugacugguuugggggauuuuuagguucccuggacagagcaagaugcuauaaaguucuccccaggaacagcucagagggugaugagcugucugccagucagagcugcuccucauucgaagcaccugcuuugguggauaggguauuuucuguuccuggggauguagagagaaccagaagacuccuaugggucggguguaugcccuccuaucccuggggagaagcuggauuugguacuucuggggcauuuucugccugagagucugugauccugcucuagacaguaaagaugcuuuacugaugcacaggacacacucucacuauuacuacugauacuuacagugacgauacuugguugucauuucucagguuggcaaggccuugccucucccucuccugaaauauucuuccuguuccugucuugguuuuguuucuuacguccuccucucuccaugucaacuuugggccuucugugucaaaugagaauaauacucacugccuuggccuuuuuccagagggaugcugggugcuuaggggccuauuguccacuugugcagaucugaugaucuucuuugauaggagagaaacuugcaucagaaauucuucaggauguggaccaauacaucaugugcuaugaggaauguaauaagauaauacagaaggccuugucaucuacuaaggauguaauaauaaaagggauggucuguggcuauaaagaacaaggaaaggauucuugucaaguaaauucauggauccuuuccccauucucagauggcagagucuggguuauuugcugcuuccucuauucacaccuaguugaguuaaagagauucauagagggaaaccugccauggcugcccuaacuuggccuggucuguucuuucaaaagggagauugcacugccugggggcacugcuggcaugugggaaaguugggguggguaaugcuaauaacauaugcuguacuaauugagguucuccuaugugacgcucaccaugccaguguggacauuaacccucauuaucucaguuaaaccacaccacaaccccgcaacauaaacaucacaccccuuggaugaaugugaaaggugauauccaaggacauuacuucaggauccuccugugaguaccaacucccagacccaugcucuucccucggcaccaagcugccuuccugaggaggaggcauuagagcugggucuuagagaaugaguauuuggauuucuuggaaagaggaaaacagcauuguaagaagagggaauagcauguacaguggcucagaggucugagggaacuucucauguuaagggacacuuuacacauuuggagaaaugaggcagcaaauguggcugagaaguggguuggagucagaauguguauggcuuggagugcggugccaaguuucuagauuuugcucuggcaggacuugggagggaggcuuggugagcauaauuagauuugccuuuuagauaaaugacucccugagcuguguggugcauagauagaagucuaaaugcuuguuuucaucaccuaggcugugauaaauggaguccugagcagugccuggggcagggaggccggugaagguguuuuugaguuugacccauucauucuuguugacugacugcauguaggggugggggugagggagagguucaggaggacccuguuuuucugacugagaugauuggucagcagaggagguuugggaaaggacacgcagaauucugcuugaguuggaggguguggggcugucugagaguggaacugaaaauauggagggagcuggcuauguagguuaggaguuguagagaaacuucaggcuaaauaugaggauuuagugggcugccaugcagagguucaagacguuuaacagccacuauaguuuggaaaaugagaagccaucauuuucucagagcauauuaaaguuuucccauuaacuuuuuaguucccaugcucacauauucaguugucauauucacagaaaucugggugguggggccuuugaggugccagaggaagcccuaugugugccugucuccucaacaccuuguaguacagucagucugcucugauauagauccuauucaauuucugaaguucguuucuuucucuuucucuagggagauucugggggccgcuuggccugugaauauaaugacacauggguccagguagggauugugagcuggggcaucggcuguggucgcugaggguugccuggaguuuauacagaaauuggugucuacaguaaguggcugauugcagugguggaucaggcuaccuguuuguauccagcaguguuccucaucuuaguccugcauuuggugcugccccugggcauccugguggcccagugaucaccccagcccacuccccuuuuguuucugagucucauacuaggccucuccuccaaccucccacuccuucucaaugccguuucugaaaaucccaguuggaauccacgggcccucuggagauccauacaauagagcacagcagggagacuggggccuggaaagugccccugccuggugcucuggucaccugccucagccaugccugcaccagggcugugcucuggcuagugggaaggagggggugaacuaauuccagcuagaggaccagccucccugccaggugggccacagugacucaucaguaucugggggaacaucuaucaaagaagagacaucaucaacagugaagcaaguguuagaugugguucugguuucagggcucccaccuaagacuuugugaaaccagccagcugggugauugcuca

SEQ ID NO: 16154 - RNA, 4019 nt, Homo sapiens
ggagacucuccaaacauuuauucaguugauuuaugaaaacuccacacuucauaacugccucaacacaacuuguggugucccugaaaguggccacuagggcacugaggaagggggugccaagaauggguugcuccaaaagaacuaguguggcagaggcuguccacucacagauggauccacacugggcugcaggggaacuucucccagccccagacaacugagccagaguggaagucccaggccucacacgucugcagggaccugguaacgccuccuucacucucugugagcaaucacccagcuggcugguuucacaaagucucaggugagagcccugaaaccagaaccacaucuaacgcuugcuucaccguugaugaugucucuucuuugauagauguuccuccagauauugacgagucaccguggcccaccuggcagagcagcuggcccucuagaccagagcaccaggcaggggcacuuuccaggccccagucucccugccaugcucuauuguacggaucuccagagggcccguggauuccaacugggauuugcggaaagggcauugagaaggagugggaaguuggucagaggagacaccuaagugugagacucagaaacagcagaagaguggaauggggucugaucacgaggucaccaggaugcccaggggcaucaccagacacaggacuaggaugaggaagucuuugaauucaaacaggaagcuugucucaggugaucaauaauccauuucuuguagaaacuaacuucuguguaaacuccaggguauccuuugcgaccgcagccaaugccccagcucacaauccccaccuggacccaugugccauuuaauucacagaccaggggccccccagaaucucccuggaaaaagaaagacagucacuguaggaaagaaauaggauccacaucagagcaggcuaauugcacugcaaugcgcuacagagcuaggcacucagggggcuuccccaggaaccccuaagacccuccuagccuuagguaucugucaauaugagaucugagaauugacaauuuccaauaaaccaaaaucauguaccuacuaaaaaggcguguuccaaaaaacggaauauaccuaaugaaaucgugccuacucugagacaauaaugagucaagugcuaaccugaguacacugccugucacacagaagggucucaaaacauggagcauguauuguuggugggaccugccugauucaccccuccucccacuccaggcugugucaguugcucucuccugaaggaucagguaggcugcccaggagagccuugguggcuuguccucacaucccauuaccaugaauaaggguaaacagaggggcuaggagauaacccaggcccuacuggcugggaaugaggaagcuuugaggagacaauugcaaugcugaggcagcaagacgcccaugaacugaccugacaggcauccuucccuuggucauuauagccacagacggucccccucgugaccauuuuacucuuggauauauucuuguucuugagcaucucacaacauuucucaugacgcauaauguuuagcucagucuccugaagaacaaguggcauugguccugaaacugcaaagacacaauuuacaagagaguggaucuucacaaagggauagaacaggagcccccagugcccacucugaguccugauugguguguuuaacacaacugcccaaauuaaaggaagucagggcaguggacaaugucaccacuugacauagaaggaaacucgagcuuaauguugacauggagaaaggaaaggacaagaagcaaaaucaagacaguaaaaggaaaaacagaucaggagagggagaggcaaggccuugucagccugaaaaauggcaaccaaguaucugucacucugaguaucagcagaaaugacaggcuguccugugcaucaguaaagcaucuuuacuuucuagagcaggaucacagacucuuagacagguagugccucucccuaaggauaggaguccccacagccucacuggcaggguugcucuggcuuggccuacacugcuagggugaagaaguucaacccaucaaggcagguccuucuaguggggguuggcuccuauuggcagacagcucaucacccugagcugaaauuuacccugaagagaacccacuacacuuggcccccaagccccaaggucccaauaugacgacagaaauucauaacauaguuguuaaauuacuuccuggcagcaucuucuccacccuccucccucacccaccugcuagaaaauggccucccugccucucccaauagcuugcaggccaagcccagcccaccagacugucccaccucagcauccugccugucucaccacucucugacacuuggccccauccagucacccagcacucugucccagcuuccacuucaaaaagcuuuucggggaggcacgcaggcuggauaugugaggaauaauucacagaguaggcgagcagagcaagggcaaugucgcuugucaaaguggcaaaaucaaaauugcuaggaaaaaugaugucucaaacugggaucaccagugccucuuuggaaccagcaugcaagucagggucucccagcuucaccuuguauuccaaauuacuguugagagaaaagauggccuucacagagauccuggggggacgucuaugcuccccuuccacaccuuccaggugcuuccaagccuggucccaucuuccuaugccagccagcagccaccucccucccucccaaccacauccccucaggaccccugaccacuuuagccagugguccccagaucggcggcggcggcaacacccggaaacuuguuagaaaugcaaauacucaggucucacccagacuggauaaaaacuauggggcugucacccccuuuuacagaugaggaagaggaagcucagggaaggggacagacuggcuccaggucccacagccugaucagggcccaagcucugagccccaaacacucaccuaaagacacagugggcggcagugagcacccagcgccugucgaugagggagccuccgcagugguguauguugcuggucugcaggcucaccugccagggccacuucuuguuuggggcuggcaauccuccaaucauccuugaaacacgguggccacaggcuggugggcucaguaaagagaggggacuggaagugaagccacuaccuucccaccaccccaccaggcugcccagggcggaggcggguuaucuauccucucucucaaaucaucuaggucagggucugacccucaaccucccugagccaggcuguguccccuuugaccuaccccgcaggccaggacagaucuagcaccagaaacaauacccugagaaaacugccuuccaaggucagagauuccgucggauuccaaggcuucucccacuguagaugcugaaguaacccaggauccuggaggcccugcggucgcuggagacccuggagcuacagaaguuucuggaauuuuggggaauuucgggugcacaggagacguccgggcuucugggcuugccggggucauucuggaauccuccucgggucgguauggcucaccuggugaagacggggacccgcggcgaacaggagcuggccuggcggcgccuccuccgcgucugccuguucccacagcgcccccacugccaccccacacccaacgugggugcagcccagccccgcccuguccacucccagccucacugagcagggguugaaggaacugaagccagaucaggagguggaggcucaggcgugugccuccacggccccugcggaggccguccugggacgccaugggcaccgucagcacgccucguggugcccccucgcggcggcuccgcccuggucgugguguuggcgggaccccagugugccggcggagaccugaggcggcucucgcgagccccggucacucagcaaaaacuaauccggguagugcugugaaggaaguggcuuucaauauguaauucguccugugaaccuuaa

SEQ ID NO: 16155 - RNA, 8834 nt, Homo sapiens
cucaaguuugcacauguuuaaucccugcucuccuggucccagauuccagaauccuucuaggccacacuucccuucuccugcucacccaaggccuagucauccaccacacuucuccucaccgggaugccaaagccagacccauucucccagggguuacucuuccccacccugacucuuuuugaagauggacacaugaccuuggucaaaccaucuggccccauucagcagaggcaaggcaggaggaggaaaagguagggaggucaggagcccaucuggggcugcagcagccagcacaggaacaggaggcaggcagaggcacagggaccugagaaggcuccauugcucauuugcuucuugauccauuugguguauuuggugaugcggguguacacaccuggauucugugccuucacgcaggccuuuucccaggacaacaccccagccagaauccaucugcccucaacuucacaagccaauggcccuccagaaucccccuaggcaaaaagagaggagugauggaggcuguggguccagcugggccugcugggcccuguggacccaugcccacccucugagcucugcugggaggguuuucacuccuccaggaccucacuacuugggguccucuuuuggcuccucaguugggacccacaccccagaaucagggcaaaagucagcaucacaggggaaggaagacaggagcagagcacuacugggugaugguaacggagggaggccgggccaaccccgccccagggaacugccuccacccaggagugguucccagcagaagcagagcuaccagaaccucccagaaacucacauagcacaaguuuuccccauaauugguggcacagaucaugucccccaggacaagggggacaacuggggggaagaaggacuucuuguaaugccggucacaccucuuguuguccaugauaaacaccucagccuccugcagcucuggggucagcauggaguuggcuguggagccuagcagggugagcagugaccucucacuccacccaacccugaccucuguccaggguccuguccccuucacccuggagacucagcccagccaccgccugucauaccuccaagcccuccccuccuucaccggccccucccccugcagugcaggccuugucugaaaagcccccgcccucgaaggcucugaguccagauccccuucuugggaaacuucugcuucugaaccaaaccagccauaacucaagucucagugcagccgcuuccaaucuggggcccagccccgcgcugcuucccugcagacucucagcucugcuggcacggccgcucuccccaccuucguuaacacucgcuccuccuccagggccucaaggcagucccucugcccagagcucauuccagaucccucccagcuggaucucaagaccaccagacaagaacuuugccuuguucuccucagccugugcccacacccacacccaaucaugacuucccuccaggcagggcaugcauuucuaaucccaagggcugggugccgacacucaaagugugucaagugaaggaaugagugaaugcccagcucugagcuucuauaagacacagauggucaugcccagcccaggcacuaccaggccugaaugagguguccacauaaacagugacaauggucaccacaugaggaguggucaacacauucagagaaccagguccagcaggaaaggccccagaaggaaaggagugugcucucggugguacugcacccaccccccaucccauccugcucaucugaaaagcgcugcuuaaccuggcuccagccagucacccaacacugcgucccaaccuucagguugaaauugggcuccgggaggcagaugggcugcacguacucacugaaggugacagguguuugaagguggacaagggcaacgucacccaugaugaaggcccggccccaguacuuggggugcauaaugaugucccucacagggacccagagggcccugcugaaguucaugggcugcagcuuggaggugccaagcaccacugaguacucuuuggugcugugggaaacagagagccccaccugguagguaucagacucccaagcaggaacacacuccuaccuccccguggcccuaccccuuuagcaagaguccugccuccacccaaucugccuaauccagccugagggcacugaagaucucagagcugacugccuccucauucaucauucaaauugauucaagguggccuggucuguguguugugcgugcagguguggaaguguugguguacacauaugcucucaugcgugaugggguagggggcguguucuggguuuuccuguugcucagcuuagggugcagucuuuguugcuaggggcucccgcccuagcucagucccuggcccccaggagaccccgagcacaauucucacuuaucccagaugcccuucccacucccuaccucccucccacacuguuucacucaggaaaugaggaagcugggcugggcccaugguagcuugaggucuccaagcccugcacacaugggccauacucacccuuggaugcagugggccgcagucaccacccagcuggggucaaugagggccccuccacacacgugcucauuuuccauccggaggcucaccucccagggccaauggcgggucauuuccaaauccuccgaccaccagggcucaccacaaacuucaggaagaagugugccagggagacacaggaaccacauagaggaggaugagaaagacugagaccuagaugcccuacagggccaauuugcacaaagcuguaaacucggggccucuucccauuucagagauggggagagugagggugagagaagggcaguggccugcccaaaagcacugagcuugacggaaagugacagugacagagguaaaaagcaucaaggcagagacauggagagagagagauucugagucacagggagccuucagcccaggaccucaaaacaaaggcaagcagagaaggagccccaaggcaagcagagaaggagccccaaggcaagaaaugcauuuucuugcaucuggggaaguuccuccgccacuucugaaaagcuauaaugcuugcugcauuucuuagaugcagaaggccuguguccccuacacugcuaagagucaagaaaagcuccugacuucugugucagaaguuuucacauugaacauucaaagugccagcagggagaccccagaggccccucauucacaggucacacacucaguuuucacacaguucuaucagucaaguuauaugguuguaugaacguaugaagaaacacagaugcacgcauucuaaauaaaauaguagcucauguuguauuuuuaaaaaacaaugcaccaugaugauuaaggauuggcccaggagugcaagggugguuccacauugaaagaauucucaguggauucuccacauaaaagguucuaacaaucugaagacagaaagaccaugugcuuuccuccacggacacagaaaaagucauuugaaaaauuuaacacauauuuauaacuuacaaaaaaaccccucuuacuuaaacuagaaauagauggaaaacccuuaacuuuacaaaaguuggauauaccccaaacuuacaacaaacaucauacaacacuaaagaacaggcagaaaagaaccuaucccaccagagaccaggaauaaggacacuuuguggaaggagggcagaggaaauaauugagagaacgcaagggggcugcugggugcugguuuagccuuuuuuuuuuuuuuugggacagggucucacucugucacccaggcugcagugcagugucacagcucacugcagccuugaccucccaggcucaagcgauccucucaccucagccucccaagucaccaggacuacaagcaguugccaccacaccuggcuaauuuuuaaaaaaauuuuuauagagacagucuugcuauguugccagggcuggucucaaacuccugggcucaagcaauccucgcaccucagccucucuacauacuuauucuacuuuuuaaccuggguggugauaacacagguaugcucacugugugacaauuccuucagcugggccuucauaauuugugcauuuuuuuuggaaugcauauaauacuucaauaaaacaauuuccuuuuaaaaacaauaauguuuuuuuaucccagcacaaccaacuagaaaauauacugaaguaacauacauuuucagcagcgaaaaaaugauaaaaguucauaggaauuaacuuaccuaacaccacauaagacuccugugguaauaaauuuaaaacucuaauaaaggacacagaaaaugaucagcauaaauggcaagacagucccugcucuuaaaacaacagcuaaggccuggcgcgauggcucacgccuguaaucccagcacuuugggaggcgcaggcaaguggaucacaaggucaggaguuugagaccagccuggccaacauagugaaaccccgucucuaguaaaaauacaaaaaaauuagcugggcgugguggcgggcaccuguaaucccagcuacucgggaagcugaggcaggagaauugcuugaacccaggggccggagguugcagugagccaagaucacgccacugaacuccagccugggcaauagugcaagauucugucucaaaaaaaaaaaaaaaaaaaaaaaagaccagcuaaacauuuuagauguaauuuuuccaaaauuaaucuauaaauucauuuuguaaguuagaauuuuuaagaaacuugauaaacuuauucugaaacugaaacagaaaaacaaaggucuaugaauaguucagucuuugaagaagcacagcaaagaagggucauuuguccuagcagauauuaagacacaugugaaagccauaauaauaaaaacaaugugguacugucacaaggacagacaauggaaagugacaauggaaaagaauagagagcuugagauuguuucaugugcugcacaaacuugauguaaagaaaggagccaccacuaucaguggguaaaagaaggacuguugaguacaugguguugggaaaacucgcucacuauaagagaaauaagaaaaccaaaacuggauucuuugcuaauagcacuugaagaucuaaagguaaaagguaaaacuguaaaauaaauaaaucaugugacaugggguaggaaaggacuccuuaaaaccucaaacacaaaccauaaagcauaaacugauuaacgugauuauaucaaaaucgagagguuuuggcccgggagcaaaguuaacagacagaggacagauagggaggaaauauuugcaauaucuaaaaugaauacaagacuuuaugcaagaaacuuuaggaaaccaacaagaaaaaaaaagauaauaggcaaaggauagagacaagcaauuuauuagaagaggaaacucaagaagccaacaacauauugagacaugaucaaacucaucaguaaugagaaaaaugaaaauuaaaucaauaagugauuuuucaaucuauuagauuggcaaaaaacauaaacgcaggaucacacuaaggguugguaggucuguggcaaccuauacaccuucaugcacugcugaaguaggaguuuagagaacugaccaaauuagaauauggauaguagauaaaaguacgguaugaauguaaacuuuugaaguuguuaagcacacuguaguuauggaagagaauauucucagaaaauacauaccaaaguauuuagcaauaaagagccaugcuguauguuacccuccacugauucugaaaaaaauuauauauguaugcguguuccuuguacuacuuguauuuuugcaguguuuuguaaguuuaaaauuauuuccaaauuuuaaaaagucuuaaugaggcugaauuaaaagggauaaccgaaagagauacagagaacauaccauuuauguaaauuaaaaauacaugcacacaagacagcaauauguauuuuuacaagagcacacacaaacagaaagauccccaagaaagauuaagcggguggagaaggggaaugggaguggagcuuggacagaagcaaggauaacuaacuuaauccaucagucauccauucuauaaugaauuaggguagaguucuggcaggaccgaugagaauagaggcccauaaacugaagaacaggaguaacccaacgcuccaugccuaagguguaaggaaaaagacaggaaacccagaagagcugggcucuacugacacugccacaaggcccaggaaguucuaucugcaacugaauggcuuagagcucaaaagguucugugugcaaaagggucugagaugaggccugggcugaauuccaagaggcucagcauucuuaugggaggccaagauccucuuuccucuagacuguuaggucuauauguucugguagcugcaggcuguucuuuagaaaacagaccccuuagaccaaaugccugcuuccuacaaacccagcaccacugucuaugugacucccuucagacauacccucccaagagcuucagcuuuuccugcagcagggucucacccuaccuaccuggauugguuguguccucuuuauaaccuggaggagaaaagagggacagagaugaagcaagcauucacgacaggaugacagcaaagaggugcauuuuuaaauuaguucauucauucauucaccaaauagguccuaaucucccacucuguucccagccuggagccagaggcuggggagacagaggugugucaaauagagccuacucucaaggaauacaguguccagcaggguggacagagguaaauacacaaccaccugcaugagaucagugcagggacaggguggcaggcuucaggggagcccagaagaagugguggacagaaaagaccacuucagugggaggagggcuuacugugccagguguuaaagaugagaagguaaacagaaaugaaaagugaucaucacauuccuugcaggagaaacaucgucguguaugccagacugcagaggaugaagggcaagaccugugauggcaagagaugagccaggggaggagagucaggcaucagucaugaaggccucgaaagccuggccaagaagccagggugagacccucugggaaaagggagaucaacagagguaugacugagccaggcuugcauaggcagcccagauauuagacaggaagaugacaagacugaggcacugagaucccaccagaggcucugcagaaccaaggcaagaaaugaggagguccgaaugaggaaguggcugugagaacagacacggugagcugucugggggacuuaggcacaugggugggucuaggaucacaccgcaguuucugauuuuggagaaaaguggcugccauccacuuaguuaggaaacaaugagagaagucaguuggcaagaagaagaagaccucagcauugaccccaagggguugagauguuccuaggucuuucagguagagauguccaggaggcagcugcacauccagacauguuuuaugaggcaccaucacauaaauggcagcucaagugaguucacccagggagcaguuaagaggggaggagcaggaaaaagagagcagcuuaggggacaccaacacgucugggaugaacagagcacgguggcaugggacagacacagaggagagggggaguuacccuugagguagaggagaaucaggagaccacagaaaaugaaagaggagggggugguacaaaggucagggaugaucaggguggagagagcccaggaaggaacuaaggguuaaguggagagcgaggaggcacuggcaggaagcauggagugaagacauuugggaggucucgcagugaaggggcaagagaugggggagaaaaaucagcaaagcaaaaacaagaggauaccuaugagagaggaugguggagggagugucgcacagggagagcccacacagcagggcacaggugagccgcuggcccugcaccagaagcaggccucucugacuccuaaagaaguaggugagggugguguugagcaguccaguuuggaggggccccuguggguuuggggauuggguucaggaagacagcacccaaagccuguguuuucugagggaaugaugggcugcuagggaggcaagcuggguuggaauagaggaucugggaagaaggugaauuuuagaauauuccuguaguggauggggaccaagaauuuuccugggccaaagagcauguccaaguggggucuccaguggggcucagcuccaugagaagaucagagcgggggguggagggggagccuaugagaggccugagggcggcucgggugguagggacauuagccacgguguccagacuggcagcgaaagggguucccgcaccgcugguucagggcgcuguaggacaggugugcccugacggaggaggccagagagggcaggaguuuaagauccuggaaucgcccuggcgagguccugggcgcgaguaguagaggagagcugaccgcggggugcgugggccgcaaaaauccccgacccaggaguaggcagccacaccccgggccagucccccgccuccaaggccaggcacggagcuggaggcggagcagggcuggggccggggagagggaagguagagcugcggaggagcgcccaccucacccgagcucagcggcagcagaaaaagcagcggcagcaggacgcggcggcucaggaccgagggccuggagguuccgggccccacgcccggccaugaggcuggagggucgaggccaugaggcugggggccaucauaaggccaugaggcugggggaucgaggcucgaccgugagacggccaugaggcuggggaggugccaccuggcggcugcgg

SEQ ID NO: 16156 - RNA, 125448 nt, Homo sapiens
gaaauaauuuuaaggucaugcgucuucauuuuugaaacgaggcuugggcauuucgaccacacccacccucccucccucgcauacucguuuccuaacagagcgcuacuccagcccacuugcccaagcccaccaggccgcaggguuuggggcaaccagggguggggcagcccugaaccggaacaagugucaauucacauuacccgcacugguccugguucgaagagccugggcaggaaccgugggacccagagaagccacccgcccaaggccgccuccggccuccgccccgccagcagcccagggccccgcccuaccggcagccgcgccucgccgcccucccuccagcuuggcccuaacggcucgcaauggcggaacagggagccaggggcaucgccgcuuggggaaccucacccgccggcccagggcucagcucgccgugugacagccccggguacuuugcccagcggggugcaagcccggaccgcggcaagcgccacucccgggcagucgcggccacaacugcuuccgggugagugggucgucgacccuguggccccgcccauccuucgccuccucagucggccgcucaggcugcggcuccucccggggccgguucccgcugucucagccgcggcgcagagggcacaucggccugaccgacuagccggcugccagugccgggagccgccgcguccauccccgcccgccuggccggggacccaggacugagucguccagcugcgccccucgcccauagccccagcgggcgccgggcgggcgagcagcucuucggcccuucccggacagcgacgcagucgcagcgcgcgcccuaacacagguaagggccgcuccucccgccagcccggugggagcagggagcggggaguugggaaccuuuuucccggccuccgcagucccgugggauccgcgccgccuccgaccucggcuagggggccgggcuucccuggggacuggccggcccgcggcgggcucccgggcuggggucgcccccugccugcggcguucucagacaucccgucugauuucuaacgcucacccuuccaccgcgcuggggaaaagguacguguuauucccacugugggagaaauuaaauugggcagcugucccuccguuucgggugcccuaggcgccuucucuuccuccuuagacgccacacuacgguucugucccaggacgagcacccccagggaacggugucaggacgguguagggcguagcauuuuuugggaauuuuacuucuuccuccuugaccugagcuggaucgcgcggguuuaacaggcgcuagcuggguuaauacuugacuaauacgaggcguuauugacacccagauuguuaaguuacagaacuccagucagcccugccugugaguaaccagcagcaugcaggaggaccuaaggaaacccacuucuuuuucuuucuuagagggaaaaaaguucaaguguuugcuuuacuuuuuucaccgugggagauacaaauacaggcugcugagacauggcuagauaaauauuguauccuaaaccuuaacuguuaguagcugguuuucuuugaguuuccauuuagugacucagcguuucuacuauaaacagaaaaauuguagaguggauugauugacuaaaaaugauauguaaggauaaaggugacuuaauuuuuuuauguugucauaaugggaagagaauguggauguaguaaugaaacaagagagaaggagagcgggguauggauguauaaguucuuaaucaguguuuaaaauaauauuuuuucaagauaacauuuuauuuugaggauaaaucuauaugaaaaagugcaguuauuggagaaugcaguguugcaaauagaauuaguuggcagggacuccacgguuguugugguuugaauaucuugcagcacuaacccuguuuaaccaacgucaugcucuguuuaacagaugcagagauaaugaccuaguauuauaauauguagaauaagaauuucagaaagugugauucauuucgaagguagaucacucacuuugugaaucauugcuaugaaucugaaaauugaaauagaggaaaccuaaguucguaucugccuaaugagauggcauucuuuacucauuuuauaggaaguguuguauuauguuuuguuaggucuguugcuggauauuuaucaucgugaagaaugguaaugaaauaaaaguugaaguauuugcagaaugcuggaauuuagaauaguuuguugguuuauaagugauugcuuugauuuuacuccuucccccccuuuuuuuuuugccagaugugggaagauaaaugaaggggucuagauguaaaugucaguggaaaggagagcuaccaucacuaagguaugaaaauguucacugaaagaauuugcacuauacaaaauagucuuuugaguggaaagcaucacccauuuuugugauucugucuuuaaaaauguagaaugaaacuacaugaguuauuaaguucuguucuagaagaaaguguguauugaaguugugauuggaauggauucacuuuaaacuagaaauagcuuuuuauugcugaaauguaauuugcucauuuuugacuuuaaaaauguuaaguaaaauaagguugaaaucacagaguucuuaauacccuuacccuuguuuuucuuuuccuucuguuagaguucagcugauuuuuaccuugauuuucauuuauaaagaacuuuaguuaaaaaauaauggcaagucuauccuguuggucuagcuuacuaaauuccuuuacuucuuucacuaaauuuuggcaucuuuuuuuuacuuuggauauccauuauauucagaguguucccuaauguugcuuuugauuuuuguccagcuaauuuaaauagugacuuaagaguuucaguucccugugaacacagauucccuuuuggaaaaucccuuuuggaaaucaccguaacugacagucuugauagguaaauaugcaagggaaaccuuccuaggucaggauuuaaguaucuccguuaacgaaaggaaaagguaauauggagaauauauuuggcaaaguaucucugucucucaaaacaaaaacaaaucuuuauuagaaaugaauuuagcaagagggagggagcaauuucuugaagaacucuuuguggauuguuuacccuguuccuagugugagaagcaacagaguugaugauauauagaaaaaaauaauucuugcagugugcugggaauguugaugaggaucauucagaaggaaauaaaauucuucugucuuuaucuuaggaucaucauccauugcaccugcaaaauacaggcuguuucguagcuuuuuccuuuuagguaguugcuuucuauguggaacaucuaaauugagagaugguccuuuaauagggaaaauguacuacuuuguucagucugcaaauaaagaauauaaucugugaucaucauuuaaaacucaacuuuuggaagccaaggcagaaggauugcuugagcccaggaguuuaagaccagucugggcaacauagugagacccugucucuacaaaaaaauuagcugguggugugucccugcagucccagcugcuugugaggcugagaugggaagaccacaugaguucugcagugagcccugaaaacaccacugcacuccagccagggagacagggugagacccugucucaagaauaaauaaaugaaacucaacuuuuuuuuuuuuuagguggagucucgcucugucgcccaggcuggagugcaguggcgcaaucucggcucacugcaagcuccgccuucuggguucaugccauucuccugccucagccuacccaguagcuuugacuacaggcgcccgccaccaugcccagcuaauuuuuuauuuuuuauuuuuuaguagagacgggguuucacccuguuagccaggauggcuucgaucuccugaccucgugaucugcccgccuuggccucccaaagugcugggauuacagggaugagccaccacgcccggccaauaaaacucaacuuuuaaaacuucagaaggaaggaauugaacaaaacuugccuugugaacuuuuuggcuuauaauaaauuaugcuggacuucaaaggagucaaacaacuaggcuaaaaacuggguugaucauguguuauacuucuucauuaguucauuauucauuuauuuugauggggaggucaagagauaauuccacuucauagggaacauauguaugcauuuguuuuagccuagugguagggagagcaguagauaaaaguagagauaauuagggaaggggaagaaauggcauuauagaaggagaaugcuuauuucauggguucaguagauguuuaugggacuuuuaaaaauugauaaaacauuuuaaaaggugguauaugaugaaaagaaagucugcuuuccaccacaaacucccagccuuuccuuaccccaaccccccaauccaagcaaccauauucaaucacauaugucuaggagaaauauauuguaucuuucauucuuaucuuuggcauaugaagaucuuuuuguauuuagcacauauuucuuacuuuuuuaaaaaagaccgcaugccuugcuaguguagaugaaccauaauuuauucauuuuccguaauuuauuuuaccauuuucuauugacagauauuuagguuguuuuuagccuucuacaaacacugcuguaaugaacaauacauauauaagucuuugcauuaguuaguaucuauacagaauguauuuucaaagugugacuguaagauugagacugaaguuaugaaaaguuaaaacuauuucaaucccauguuggcuuuauuuauaauagaauuuaacuuauuucuugggcuuguggaaggggaaaggagcucuuaauuacuuuguauucuuuauccaucucuccauuuaaaaaauauugcaaauuauuuuauaagguacuuaaaaacauuugagugucaggugauuaauuuuauuuguauugguaaaaguagaaauauugugguuugaagacugguacugucauauagaagcauuuauauuugauaauaguuaaauggcuacaucuuaaguagguugauuguuucagaauuuuaugaccaguaucaauuaaaagcauuguguauaguuuaaauucuugcccugcauaagucggcuacuauauuauuagucaggaaagaaguaaauaaucuaccuccuuuuuuccuuuaccuuccacauccuaaucuauacauaauaaaauaaaccucuauggaguuugagauccaaaaauccuuuugcaaacuagagugcuauuugauggauuacuuucucaaggcaggaaggagguacagauucaaucuuuauucugcaaaguuuuuguaaacagaauaaaggaggcuuagguuugauguuauauagguuacuuguggccaggaggagguucaggauucuuugccuuuuugaaaugagagagacacuagagagaaaaaaaaaaaauuacauacugaagggcuauaguuugaugaagucggaacucaugaguggcagcuucccuggcuugugcccagggucuauuuugagaccuugucaaagcuugccugacagaaccuaccacauaaccauaaucuggccugguccucuugcaagucaggaaggccugcgguuuaggaucaguggcaagcacagaagggggaguuauaaaggacauuuugccuucagaagauuaaggcuagguuuuggggugaacaacuacuuagcccguauauccgaggauccaaguuuuuagugcuaccuccuccuccccugcuucuuccucuuauuaaggaaagcuaaggaauaaagguuuuguuuguuuguguguuuguuuugagacagggucucacucugaugcccacgcuggaguccagugguaugaacacagaucacugcagccucgacuuccugggcucgggugauucucccaccucagccucccaaguagcugagacuacaugcauacaucaucacacagggccaauuuuuguauuuuuuguagaaacgggguguccgcauguugcccacgcuggucucuaacuccugggcucacaucguucacccaccuuggccucccaaauugcugggauuacaagcaugagccacugcgcccguccaggaggaaaguuuuuagaaaaaggugcacaagaaagagcauaggauugugccagcauugauguuaucuucugguuauaugagaguguuugccaagaaucggucaaauguuuuacauuagggaaaaagcauuauuguuacuggcauagggagggccccaguuaaaauagcaguccaauucagagaccuucguauuugucguuaagaucaaaaggacucuuggaauaauggacuaugcuacaggauuauuuuaaguucagauagauaaauuagcuucuucccaaauucucauucugcuuuuccugugguacuauauaguaucaugaaguuauaucuuuaaacucuuaguuuguacuauguggugucuuaugaaaaccuugauuuguuuauacuuagugaaugaaacacuuggguuuaaaguucuuuaacugaugucacuucuuaggcuagaaagcuguugaaagaacuuaguguuccacccuuagaccaagguucaugucaccauauuuaacagcagcuuuguauuacggucaagauuguuugaagaauucagcauacaaacuuaauuuacagaugcaagccugcagauggaccuccccacccccacuuuuuugcuuuagauuagguugugacuggaggaaauuuaguuuuccuuugccuucaguuauuugcagcuguucacauuuaugaugaugagaaugaugaugaugauaauguauuuaggauucagugugaggagaaaaaauaaacuaguuuuucuuucuuccuuaucaguuuauucccauuaucuuauuuucccuucucugucucugccuuccuuuccuccucgggaaaaaaaagaaaaagaaaagaaauaaaaagcagcagugaaagaaagugguaaagagcugggaaaagccuuggaauacauaccagggugcuuucucagagguggaauauaaacaccuucauuaaagaaucauggauuaucuuuuuccauuguuuucauuuugaacccuguauaucuuaguguuccuucauuaccacauuuuaacuacuuuugauauaacagauaucuuuacugcuuuagggaagcaaauuuaauuuuuauguuacuguucugagcauguuguuccuuacaugcccacuuuccuaaguagaaauauauuaacagcuagaagaaaucuuuuggcuuucuguuuuguaaguuagaguauaccguacuguaugcagaggauuaggauguuaaaauauuuauuucccuguuaaauggcuuaaaucaugaacaaacugaauauauagcauugcuuuuuuuaaaaagugaguaucccaguuaagugaccuaaggauuauaggacuaaauguagaaaaaaauucagcuuuagauuagauguuuuuucccuugucacagauaaugcuguaucuaggugaacagucaaggaaaugagagggcauuguucuugucuugccagauucauccuuugcaaucaaauaaaguuuguuuuguuuuuaaaauugugguacaauauagauaacauaaaauuuacucuguugaccuuuuuuaaaaauauuuuuauuaugguaaaauacagucauuuguugcuuaaugacaggaauauguucugggaaaugcaucauuagguaauuuugucaagcaaacaucauagaguauacuuacacuaaccuggacaguauagccuacuacacaccuagacuauaugguauagucugugguuccugggccauaaacuugugcagcaugucacuguacugaauacuauaacuguagacaauuauaacacagugguaaauuuucguguaucuaaacauagaaaagauacaguuaaaauaugauauaaaagauuagaaaauaggccaggcaugguggugugcaccuguaauuccagguacucaggcugagguaggaggaucacuugagaucaggaguucuaggcuguagugugcuaugagcacaucuaugaauaggcacugcguuccagccugggcaacauagugaggccccaucucuuaaaagggcacacguguauaggacagcuccauuauaaucuuaugggaccacuguaauauguguaauccauuguugacuggaacauccuuaugcagcacaugacuguguacauaacuuaaaauuuaucauuuaaaccauuuuuaaguguacaauucggugguauaaaguacauuuacauuauuguguaacuaucaccucuauccaucucccuaacuuuuucaucauccuaaacaagcucugcccauuaaacaauaucaccucaugcccauagcccuugguaaccauuguucuacuuuuugacucuaugaauuuguguacuccagguaccucguauaaauggaauuauguaauauuugucuuugugucuggcucauuucucuuagcaugaugucuucaagauucauccaugucauagcauguaucagaauuucauuuguuuuaaggcugaaaaauauuccuucguauguuuauaccauauuguuuaaucaucuuuugauagauggguuguuuccaucuuucugcuuuugggaauagugccaccaugaauaugaguaugcaaaugucuguuugagugccacauucaauucuuuuguguauguacccagaaguggaauugcuaguaauuugauaauuaccaaauuucauuugguaauucuaugcuuaauauuuugagaaaccaccauacuauuuuccacaguggcuauaccauuuuacauuaccaccagcaaugcacaaggguuccaguuucuccacauccuugccaacauuuacuauuuucuguuuucuuauugauugauuuuuauuuauguugagccagggucucacucugucaccaagacuggaaugcaauggcccgaccacagcucacuguagccuugaccucccgggcuuaaguguuccuucccaccucagucucucgaguagcugggaguacaggugugcacugccaugccuggcuaauuuuuguauauuuuguagagaugaggucucuccauuagcccaggagggucucaaacuccugagcuccgccagccuuggccucccaaagugcugggauuacaggugugagccauuguuccuggucccguuuucuuuuuuuuuucuuuuuucuuucuuucuuuuuuuuuuuuuugagacagaguguugcucuguugccuaggcuagagugcaguggcgcgaucucggcucacugcaaccucucccuccuggguuuaagcgauucuccugccuuagccucccaaguagcugggacuaugggcacccgccaccacgcccggcuaauuuucguauuuucaguagagacgggguuucgcccuauuggccaggcuggucucgaacuccugacuuugugaucugcccgccucggccucccaaagugcugggauuacaggcgugagccacugcacccggccugcuugugccuggcccuguuuucuaacacaaaaaaaucgauuauuuuuaaaauaaaaucucuaauagggugguauuucacugugguuuugauuuguauuucccuggugaugggugacauugugcaucuuuucuuuuucucuucuuuucuuucuuucuuucuuuuuuuuuuuuuuuuggagacaagauuuugcuuuggcacccaggcuggaguguagugucacaaucaugccucacugcagccucgaccuccugggcuaaaaugauccucccaccucagccucuccaguagcugggaccacaggcauguaccaccauguucagcugauuuucuuuucuccuucuguuucuuuuuuuuuugagacagaguuucgcccuuguugcccaggcuggagugcaauggcgcuaucucugcucacugcaaccucugccucccagguugaagcgauucugccucagccucccaaguagcugggauuacaggcaugcgccaccauguccagcuaauuuuguauuuacaguagagaugggguuucuccauguugaccaggcuggucucgaacucccaaccucaggugauccgcccaccucagccucccaaagugcugggauuacaggcaugagccacugugccuugccucuuuuuuuuuauauuuuguagagacauguugcccaggcuggucuccaacucuggguucaagcaacguccaggcuggucuccaacuccugggcucgagcaauacuccugccucagccucccaaagugcugggauuacguauguugagccaucaugcccggcugagcaucuuuucaugugaccauuuuuguaucuucuuugaagaaaugucuacuuaugucuuuuaucuuuuuaauuggguuuuuguuguugcuuaguuguaggaguucuuuauaucaauccuuuaucagcuaugugauuugcaaauuuuuuuuuauuccgugguuugccuuuuuacuuuuugauagugugcuuugauguacacaguuuuguuuuuauuuuauuuuauuuuauuuuauguuauguuauuuuaagauggagucuugcucugcccaggcuggagugcaguggcccaaucucggcucacugcaaccuccgccuccuggguucaagcuauucuccugccucagucuccugaauagcugggauuacaggcaugcgccaccaugccuggcuaauuuuuguauuuuuaguagagacggguuuucaccauguuggccaggcuggccuugaacuccugaccucgugaucugccugccuuccaaagugcugggauuccagaugugagccaccgcgcccugcccagaguuuuuaauuuugaugaaauccaacuuaccuuuucuuuuguugcuucugcuuuugguauuauguccaagaaaucauugccaaauucaauaucaugaaguuuuucccauauauuuucuccuacgaguuuuaugguuuuagcucauuuguuuaggucuuugauccauuuugaguuuuuucuucuuucuuucuuucucuuucuuucuuucuuucuuucuuucuuucuuucuuucuuucuuucuuucuuucuuucuuucucuuucuuucucuuuucuuuucuuuucuuuucuuuuuuuugugacagaguuucucucuuguugcccgggcuagagugcaaugguguaaucucgggcucacugcaaccuccaccaccuccuggguucgagcaauucucuggccucagccucccgaguagaugggauuacaggcaccugccaccacgcccagcuaauuuuuguauuuuuaguagagacaggguuucacuggucaggcuggucuugaacucuugaccucaggugauccgccugccuuggccucccaaagugcugggauuauaggcguuagccaccaugccugaccccugaguuaacuuuucuauaugguauaaggcagugguccccaaccuuuuuggcaccaggauucaguuuuguggaaagcaauuuuuccauggacgggggugggguggguggggggguugguuucgggaugaaaccauuucaucucagaugaucaucaggcauuagauucucauaaggaacgcacaaccuagaucccucacaugcacaguucauuuuuuuuuguuuuuuuguuuuuuuuuuugagacagagucucgcucugucacccaggcuggagugcaguggugcagucucggcucacuggaagcuccgccucccagguucacgccauucuccugccucagccucccaaguagcuggaacuauaggcgcucaccaccacgccuggcuaauuuuuuguauuuuuaguagagaugggguuucaccauguuagccaggauggucucgaucucccgaccucgugaucugccagccucggccucccaaagugcugggauuacaggcgucagccaccgcaccaggcuggaagacagucuuauauaauguaacauaguuaugggaguagcauccuguauaaccuuugccauauucuguugguuagaaguaagucacaggacccaccuacauucaugggggaaguaauuacacaaaggugugaacaguaggaagggcgauuaggguggggaaccaccuuagaauuugucuaccauaacugauuacaaaauagcauguuuuaggaacuuuuuuuuuuuuuuuugagacggagucuuuuucugucauccaggcuggagugcaguggcaugaucuuggcucacugcaaccucugccucccacauucaagcaauuuucccgccucugccucccauguggcugagauuacaggcgccugccaccaugcaugccuggcuaauuuuuguauuuuuaguagagauggguuucaccauguuggucaggcugaucucgaacuccugaccucaggugaucugcccacuucagccuuccaaagugcuggaauuacaggcaugagccgccaugcccugccauauuaaccaauuuuuguuuaaaaaauaauguuauuaaaauaggaguaucuucggauggugggacuuacuggugguuuuauuguuauuuuguauuucuucacuauuucaucccacuuucccucccugcaacauuccaauuuugaaauuuuaaaucaauaguugguguuuucauuauaaugaaauaaauauuguuuacugaucagccaugugguauaucauacuuguuuccuuucuuguuuaacuuuguuuuuucagggaguuaaaauuugccuuuuacauuuacauaauuuucuguuuaccuguugcuuucccccuaaaugcgccaacagauuuuucaagagucuucaucuaucuauguaucuauccauccauccauucuagcuuauaacaucaauuuauaagcuauaaaacgaauuuauuuugcauaaaauuaguugugaacuauagagaaauauaaaacaaaaauacaguuuuaggaagaagaauacaugaacaccuguggucucacuaccuaggucaagaaauuacauguuacauuuauccuagaaguuuccucaagauauccuuuaauggcacccccucccuuccaggaaaucacaagccuauuuuaacauauuagucauucucuugggaccauucucugcucaagccugcaauauccuccauguccauacauguauuuuuggccaaaauuuuuaauuuugaaaaaccaaaaagcucuacuaccucucuaagucuguuagucaggauaggcugaacuacuuuaaugaauaauuaccaaaucagugguuuuuaacacaaaauuuauuucucacucacaucuuugcugugaguugaaaagcagugacagagugguggucuguuccacagagucauugagggacucaggcugcuuucagcuagugauucugccacccacuggggccucagagacuuugaauuuccugcaucuggcuggcagaugcgaggacaaagagagggacugugguagauugcauggaaaguuugaugggccaggccaggaugugguauacaucaguuuuguccgcauuccacuggcuagaacugagucaaauggcuacacuuaacugcaaggaaggaaagggaaaacgccuuggucaacaaugagccaaucucugccaugguauguaucccuaagaaauauaucauuuuguuuuggaaaacugaauagcaagcaucaacugaggcugugaaaggaaagguacauacugcugcuauuagaugaaagcucucagaagauaagcugaaaagagucuuccuugaucuuuuuuggauaagucauugggaaaguuuguuauugagucuggagaaacacaggcuccccacagucagggaaucuggcaaaacuaaaguguuuacaagauacuacgguaaauaucuagaagaaaugugauugggagaguagauugcucuaugugguuuugcuucuaagcuaagcuuaucacgcuuuagcucucaagaauaaggaaaagcaaaacaugucugugcugugaaauaagucuucagcccaucuaggcuccaggaacuuuaucaacacggggucaagacaaacuaaauuccaaugaaaaccuggaccaggcacaucucauguuaaauggaugugccccaaaggcuguggggauuuugguaaugacaguccuucauuaugucucuugagucauauugcuccaaucuguagcuuucuuucugagauacaccuaucauucuucuggagguucccuuuugccccucuucuguguuugauuuauuuccuguaugcuaaguuucccucucuguugguuuuucaguuuuacuugcugaagccuaucuucuaguagcuuauugacaaagaguguaaaagagguaaauuuuugagaccuuucaugucugaaaaugccuuuaauaaucaaguaugaaaaagagggauuugacugguauaggcuacuuauagauugucuauaauuuuccuucaagaguuugaaggcaucacucuuaucaucuucuuguuuccagaauuacuuuugaaagucuugaagccauucuuaaucuuuuauguguggccugacuuuccuacccuguggaagcuuguaaagucaucuuuguucucauuguuuaaaauucacuaagauauaccuuggugugaacucaggacuuguguugaacacucugggcccuuuuagucuggcaccucauguucuuaacuucugggaaguuauuuuauuaauaauuuauuuuuguuuucucucucucucucuucuuuuuuuuuuuuuuuuuuuuuugagacagggucucacuuugucacccaggcuggaguacaguagcaucaacaugacucacuacaaccucgaccuccugggcucaagcgaugcuccugccucaguccccaccacgccuagcuaauauuuguaguuuuugauagagaugagaggagguuuugccauguuguccaggcucgaacuccugagcucaagggauccaccugccuuggucucccaaaauguugggauuacagacaugaaccaccgcacccagccuguuuucucuuucuccaguuauuugaacguuagucccuauggacugauacuuuaaccuuauauauuuuucuuucuuauuuucuaccucucucucuuuuuuuuuuuuuucuguuuucuguaagacuucuugaacuuuauuucccaaccugaguuuuguaaaacuaauuuuuuuauugagguacuacucgugugucauaaaauuuaccccuuuaaaguagugaccuuuucagugguuuuuuaguguagucacaaaguugugcagccaucagcccuaauuccagaagguuuucauuaccccuacaaggaaacuucauaccauagcagucacucuccauuuccucuuuacccgagacuuuguggaaagcacuagucuguuauacuuucugucccuauggauuuaccuauucuggacauuuuacauaaaugaaguuauucaauauguaaucuuugugucuggcuuuuaucacuucucauguuuucaugauucaaccuuguuguauguagcacgagucaauacuuuauuccuuuuuuuuucuuucuuucuugaaacagucuugcuuuuugcccaggcuggacggagugcagugaugcgaucuuggcucacuguaaccucugccuccuggguucaagugauucucaugccucagccuccaaguaacugggauuacagaugugucccaccgugccuggcuaaucuuugcuuuuuuuuuuuuuuuuuuuuaguagaugggguuucaccauguugaccaggcuggucuccaauucuugaccucaagugauccaccugcuuuggccuuccaaagugcugggauuacaggcgugagccaucaugucaggcccaauauauuuguuuuuauggcuagguaauauuccauuuuauggauaugccgcauuugcuuauccauucaucagcugauggacauuggaauuguuuucacuuuuggcuguuaggaguagugcuacugugaauauuccguuacaaguuuuugugugggcauaaguuuucaauucucuugaguauagaguggaauugauuauuucuguuguguuuuuaauuucuacugucauguuuuaauuuccaagaucuuguauucucugaauuuuuuuuucuuuuuuuuuuugagacagaguuucacuccuguugcccaggcuugagugcaauggcgugaucucggcucacuguaaccucugccuccuggguuaaagugauucuacugccucagccuccugaguagcugggauuacaggcauguaccaccacgcccagcuaauuuuguauuuuuaguagagauaggguuucaccauguuggucaggcuggucuugaacuccugaccucaggugauccgccugcgucagccucccaaaguguugggauuacaggugugagacacugcgcccgacccuguucucugaauauuuuaauagccccuuguucuuguuucauggcuauaauuugccuuaauuuucugaagauauuaaugaugguuauuuuugaaguuuucuucucccugcguaguuuauuuucacuaaguuauucuucugaguuaguggguuuucacagacuucuugguuugaaaguaggugggguuggucaauuuugaccucccucgaaaagggguauauauuuugguagcaggaugggugauuuaaagggggcugaagcagucccacauuucaaaaugcauacuuucaccuaagcccacacuuccuacucccucccuguucccauugcuuacccuucccuuccccagagccccuuugucuucuagaacuucugguauccuggagaauaggagaugaaguugaagcugagguaauagccuagcaauggaaaggggaccuggaggucuaacuacuuaauuaaagacuuuuaagugaauuuuuuuuuuuuuuuuuuuuuuuuuuuuuuugcgcauagggcuuacucauugggcucaagcaauccuccugccucagcccugcaaguagcugggacuacaggugugagccacuauaccuggcuaauuuuugugucaaaaccccagcugccuuuuuuuccuccccuucuuuuucuuuccuuuuuuuuuuuuuucuuccagaaauugagaaacucaggcugggugcaguggcucacgccuguaaucccagcacuuugggagguggaggcagguggaucaccugaugucaggaguuugagaacagccuggccaacguggugaaaccccaucucuauuaaaaauacaaaaauuagccaggcgugguggcacaugccuguaaucccagguauucaggaggcugagguaggagaauugcuugagucagggagaaggagguuacacugagcugagaucgcaccacugcacuccaaccuggccagcagcgagacucugucaaaaaaaacaaaaaagagaaaguaacaaacucauucuaaaauuuauaugggaauguaaagggcccagaauagccaaacaguguuaaagaacaaaaaauuuggaggacucacuuuuuccaauuaaaaaauuuacugcaaagcuaugugaaucaagauggugugauacuggcauaggauagacauuuagcucaaugaaauagaauuaaguauccagaaaguaaacccuuacuuuuauggucaguugauuuuugacaaggguggcaagguaauucagugggagaaacaauggucuuuucaacaaaugaugcugggacaaauagauauccaugugcaaaagugugaaguuggaucccugucuuauaccauauaugaaaaugaacugaaaauggaucauggaccuaaauauaagagguaaaacugaaacucuuagaagaaaauguaaaaauaaaucuucauggccuugagguagguuucuuggauaugacaucaaaagaagcaacaaaagaaaaaaauggauaaauuggacuucuucaaaauaaaaacuuuugugcuucagaguaccuucucucuggucucuuuacuuuuauuuucccaguauucucuuuugccuacugagaaggcagugacagugcuauauaaauagugccuugcaaauucucaguaaauauuuguugaaaagggaaaaauuaaagguaugugauagguuuuacuuuaugaaaauuucuagcuuuagagccuccuucauauuaauugcauuuuuuuaauauugaaaaauuauauccuuguuacauguguucccauuucccuuacuuuuuguuucaucuugauucuuugguucuuugcuaccuaggcuuauauuguucuuucuaauacuucuagucuuuuccuguuuucugcuuuauuucauacuuuuuuuuuuuuuugagaggagucuugcucuguuacccaggcuggagugcagugaugcgaccuuggcucacugcaaccucugccucccaggaucaagcaauucuccugccucagccucccaaguaacugggauuacaggcaugugccaccaugccuggcuauuuuuuguauuuuuaguagagaugggguuccaccauguuggccaagcuggucucaaacuccugaccucaagcgauccaccugccuugaccucccaaagugcugggauuacaggcaugagccaccgugccuggccuguuucacacuuuuaagucuuuccuacucucagcaauauguaauuguuggucucccuuucuuuuauacucugauuguauguccauacaucucugagauacuuuaaaagguaucaagaaaggaggcuauuugaaugguacuagaaagugguuugcuucucagaaaauacggauaagugaauuguuuagucuaucuuccuaauuuggguucugcacaguugaugaaauaguauaaagauuuauguccaacauauagcccauuaauguucauuuauagaauaacauaacuaccaaguaaagaaaugcaaccacuggcauguuauaugaagggaggaaauggaaagauuaucaguuguguuggagacaugaggauaguggguagucaaaauaugauacuuuaaaaauauuuuugauaauucuuaggacaaaugacuauaaaaguaggagaaauaauuauauagguucucuuccuuuguaagcauuucucuuuauaaaguaugaguuguaaguuaaccauuauaguuucuaauguucuucugacauuuaguuuguguuuagcauuugccuuuccuuguuuugccaaguucuccaguuuugccuguauauauuuuuuucauuuuguacuuugccucaauuucugaauguaccuucuauauucuuucuguagguuuugcuaaugauuuauucauuuuauguaacgaucucauuuagauauuugcaggauugaugucuuuaacuguaaucccucccuccuuccucuuuuccccucucucuccucccucuccuucuuaauugucuuccucucccuuuacuuuccuuguuuuccucuucugguuggagccauuuucugccugcccauaaucuuuauuuuaucuuacuuuuuugagacaaggucucacucugucauccaggcuggagugcaguggugugaucaaggcauacugcauccucuaccuccuggguucaagcaauccuuccaccucagccuuccaaguaguugggacuauaggugugugccaccaugccugguuaauuuuuguguuuuuuguagagacaggguuucuccauguugcccaggcuggucuugaacccuugggcucaagugauccgccugccucagccucccaaaguacugggauuacaggcaugagccacagugaccugccauaaucuuuauuuuguuuguuuguuuguuuugagacgggguugcacucuuguugcccaggcuggaguccaauggugcaaucuuggcucacugcaaccucugccuuccagguuccaggaauucuccugccucagccucccaaguagcugggauuacaggcaugugccaccacgcccagcuaauuuuguauuuuuaguagagauaggguuucuccauguuggucaggcuggucuugaacucccaaccucaggugaugcgccugccuuggccucccagagugcugggauuacagacaugagccaccacaccccgcauaaucuuuauuuuuaauguguauguaacuacuagguauucuucagugcuaugauuaccucugccuuccuuuucuuuuccacucuagauuuuuaauugcaauuccuaauucccaugccuuuuuuucaccuagucauccacacuucuuuuuuuuuuuuuuuuuuuuuuuuuuuuuugauacugagucucgcucugucgcccaggcuggagugcaguggcgcaaucuagguucacugcaagcuccgccucccagguucacgccauucuccugccucagccucccgaguagcugggacuacaggcgccugccaccacgcccggcuaauuuuuuguauuuuuaguagagacggggguuucacuguguuagccaggauggucucgaucuccugaccucaugaucugccagccucagccucccaaagugcugggauuacaggcaugagccaccgugccuggcccuagucauccacauuucuuaagcaguuacucuuuccccaacauuuuauuauaaaaaauuaaaaaaaaaauuuuuuuuaaagauagaguuucacuuugcuuucuaggcuggucucaaacuccugggcucaagcaacuugccugccucggccucgcagagugcugggauuacaggugugagccaccaugcuuggcugaugauaaaaaauuuuaagcauagcccgagcaugguggcuuucgucuguaauccuagcacuuugggaagcugaggcagguggauugcucgagcccagggguucaagaugagccuggcuaacaugguguagcccugugucuaccaaaaauacaaaaauucgccaaaugcagugguguacgccuguuguaccagguacuugggaggcugaggcaggagaaucgccugagccugggaggccgagguugcagugagccaaggucgcacuauugcacuccagccugggagacagagugggagacccugucuccaaaaaaaaacuuuuuuuaaacauacagaaaaauugaaagaguugugcugugaacacucauguaccuaccaucuggauuucaucauuuuaucuuuuguuguugcaguuuaaaguagcagaucucaguacacuucaacccuaaauauuuuagcaugcacaugauuggcuagaguuuaauauuuguguagaggacuuuuuucuuuugagguaaaauuuacauagaacaauaugcaaauauuuuaaauagaacauuuaaugaucucuaucuucuguuucaagucacuuguguucuacuaagaggacuagcauaaccauuguaaggcugcacucccaaaacuuggcaguuuuagaaguaaacuuugaauacaaaguaccuuaaaaauuucuccuuuuuuguuuuuauuguauacaugugcuagacagcaaaaugauuauagucaaggcauuuauuuuuuccaaauuguucuauacuauagcagaaacucuuagcaugguuuaaugcuauuagacagugcaugcuggaggaaaucgaggauauuuuuguuuaguuaaaaguaugaaaaggauugcuuuuuuuuugucaauuucacaagcuaaauaugcaaaauagguaguuaauucaaaaugcuuuaaauauuuauggagugcuuuauaguuuauuaagugcuuggauuuuucuuaauucauuugagcuucacauuaaccauguuauaucagugaaacugauaaagagauggaggcuuagaaaguggggaggguaacacaggaagugguagugcaaucaguugaacuuggaucuucucauuuuaaguuuugucaaguggcaacaacugcagucacacuaagucuuuaguucagggacaauuccauauacugggauuuguuuaugaauaacuaugaaauguuuucuugugcagacuagcguucacuguaauggcagcugugaugcaaagacauacuaggacaauauuuugaauucuccaugaugcaauacuuagauauaaaagaacuaucuaucaggauccagauuaggcacagaacuuucuaaguguccuguauuuagaaugugacauacugaugcuacaugcacauucuguucuuacaaaaguggacaauaucaugauugaagugccacuuuuacuguggcaaaaugccuauuguuucagacguauauuauaugagaagcucauuggagaagacaaagccuuauugaaauaucugucuguuuuggaagguuuauauucugcaagauccugaagauacuuuccuucuuuucuguaaguaaaauaugucaugacaaaaccaucuggggaaaaucaacuugacacuauguggguaaaggacuugacaaaaauacaggcaguuuuguucuuaccaauugaggaaaagguuuaguucuuuaaguuguuugauaccaccaaggaaacacuggaaggaguuaaugugcuccugaagaaaaggguucuugaggaaaccuuaggguagaaauuuacugcaaguccuuuaggaucagaaacaaaauuauuuaagguuuccuuugagucuacauucucaguuuugucauuuuguugaaaaguuucccacuggcuauguuaagaaucguauuccuuucaagguuuccuccaucacugauacagaaugaccuggaguuacuagaaaauagauugcaugagaacggaaaaaccuuucaucuuuccuucuuuuuuuucuuuuuugagacagggucucccucugucacccaggcuggagugcagugguauuaucacggcucaccguaaccuugaccucccuuggcucacauaguccucccaccucagccucccaaguagcugggacuacagguguucgucaacaugucuggauaauuuuuuuuuuuuguaaagacagaauuucaccauguugccuagucuggucauuuuucuaauauugguaaggaaaucugccuacaggguccaaauaauacaguucuuuuaaaaguacuagguuauccuuugaacuagguaguccuugaucugcaucaugugaacugaaaaagguaacuggaccuggccaaucagucauauaaaaaccuagguguucucuguagauaugacaagaagaauaaggaagauagacaggaaguucuuccuauuuccugcuuauccugugcugcuuuuuccugucaucucuuucucagggcugucuauucuggagcuuguugaaaccauuuuguuuggaagcaauuuuaagaaagaauaauuuuuuacauaaaucugugguccaggaauacucuggcaggucuaaggcauaggcauuguuaguugagaaggaaagaaaauggaucauggggguagaggagaaagaaaagaaagaaguacauucaaaagaaugcuaccagaagugguuucagauuagugucucaguaguauggcauauuauguuuaauuuugaugugauccaguuggggacuaguuuauuuuuugagccuuagauuggaauguuuuuauuuuuauuuauuuauuuuuugagauagggucucacucugucacccaggcuggagugcagugaucauggcucacugcagcguugaccucccagggucagucaguucuugcaccucagccucccaaguagcuggaacuacaggcgugugccaccaugccuggcuaauuuuuuuaaaauuuuucuagagacaggguuuugcccaggcuggucucaaacuccuaugcucaagcaguucuccugauucagccucccaaagugcugggauuauuagaugugagccaccacgccugguuuuaaaaugcaucucuuuuuccuuaaugcuauugaaauuuuagagaauuaagaaaaaaugcauccauaauccuaucuuccuaaaaaaaccacuguuaaacuauugauauacuuccagccaaaucuauuuuuauucucuaaugauuuuuaugugucuggaauuagaaaaugcuuacauuuuuguuuccugcuucugugaaauaucuuucauuguguccuuggaaagcugacugauggacaaauauuggaugauaccauagugcauucacuaaauugucaaucuagucugaaaaggaacauugcauugcauguugcuuauuuuuaguagauggcuaauauuugcaugcaccacuaccauuuuuuuaaaaauuucauuucggucauguggcucaugccuguaauccuagcacuuuggaaggcugaggcgggcggaucaccugaggucaggaguuugagaccagucuggccaacauggugaaaccccgucucuacuaaaauuacaaaauuagccagguaugguggcacacacauguagucccagcuacucgggaggcugagacaggagaaucacuugaacccgggaggcaaagacugcagugagccaagaucaugucacugcaguccagccugggcaagaaagagcgagacuccgucucaaaaaaaaaaaauuauuucaauaguuuuuggaguacagaugguuuuugguuauguggguaaguucuuuaguggugauuucugagauuuuagugcaccugucacccaagcaguuuaugguguacccacuguguaguauuuuacuccuuacccagccguccuugcccccaccaccaaguccccaaagucuauuauaucauucuuaugccuuugugucuguauauuuuagcucccaauuauaagugagaucauauguuacuucacuuacaguaauggccuccagcuccauccaagucacugcaagagacauuauuucauucauuuuuauggcugaguaguauuacaugguguauauauaucacauuuucuuuaucuucuuguugguugaugagcacuuguguuuuuuccguaucuuugcaauugugaauuguuuugcuauaaacguguguguguaugugucuuuuucauauaauaacuucuuuuccuugguagagaccuaguagugggauugcugaaucaaaugguaguucuacuuuuaguucuuuaagaaaucuuccggccaggccugguggcucaugccuguaaucccagcacuuugggaggccgaggcaggcagaucacccgccuccugaggucaggaguucaagaccagccuggccaacauggcgaaaccccguuucuacuaaaaauacauaaauucgcugggcaugguggcauacgccuguaguuccagcuacuuggaaagcugaggcaggagaauugcuugaacccgggaggcggagguugcagugagcugagauuguaccacugcacucuagccugagugacagagcgagacuccaucucaacaaaaaaaaaaaaagaaaaaaaaaagaaaucuucauauuguuuuccauagugguuguacuaguuuacauuuccaccagcaauguauacacuguuacuauuagguaagugaauaaucuuuaaaauuaugcugaagaugauuagagaacucugagaaaaguuuucuguccuuaucaggaguuguucugauuuguaucugggauauaucagcugcuacauuaagaaguaccuuuugucauguucccuuuuuuuuuuuugagauggagucuugcucuguugcccagguuggagugcaguggcacgaucucgguucacugcaaucuccaccuccuggauucaagcgauucuccucccucagccucccgaguaccugggauuacagacaugugccaccucgcccagcuaauuuuuguauuuuuaguagagaugggguuucgccauguuggccagacuggucuugaacuccugaucuccugugauuugcccgccuuggccucccaaaguguuguauuacaggcaugagccaccaugcccagcugguguuuccauuuuuaaaugaguucuuaauaaucauauccagauauaucuucucuagugaaguaaaaguaauaaaccaucaucagucuuuauucugguggacagaauaacaagcuagcucugaugaaugagaaauggugucagauaaguugggaauguccugaaucuuuauuggagaaaacuuuuugguggaauaguucugcuuuauuuagccggaaucaacuaaauuccaguacauuaaagucacuuagaauuucaguauagccaauuguguuaggacagacuuacuugagaauuucuuugugauucauacuguaaugaaauuuugcugguuuauuuuguuaaagcaagucaaaaauuuuuuaaguuauggaauauuuagcuaaaugagcuauacuucuuagcaauguguauagaagaaaagagggcaugaaauuuggguugcauucuuucaugguaaucuuuaaucucaaauaccaucuaaccaaagguuagauggucuuuuucauccuuauuauuuaauccugguggauggguuuuucuucuuccuuuuguuaaaauaggucuaauaaguaauaguaacagguucauagauauauucuuuuuuuuauauuucgagaaggaguuucucucuuguugcccaggcuggagugcaguggugcaaccucggcucacugaaaccucugucucccagguucaagcgauucuccugccccagccucccaaguagcugggauuacaggcaugcaccaccauguccugcuaauuuuguauuuuuaguagagaugggguuucaccauguuggucaggcuggucuugaacuccugaucccaggugauccaccugcuuuggccuuccaaagugcugggauuacaggcgugagccaccgcgccuggcgauauauucuuaaucauuugacuauaucaguuuucuucaucaccguaccuuuagcaccuccuauaguaccugguaacaacauggacaguguugguuauuguuaauugcagaguaauaaaccuucauuuuuucuuuuauaugguuguggguuuuuuuugucuguuuguuuuuguuuuuuuuugagguggagucucucucugucacccaggcuggaguccaguggcgugaucuuggcugacugcaaccuccaucuccuggguuuaggugacucuugugccucagccaccauaguagcugggauuauaggcaugcgccaccaugccuggcuaauuuuugaauuuuuaguggagaugggguuuuaccauguuggccaggcuggucucgaacuccuggcuucaagugaucugcccaccucagccuccccaagugcugggauuacaggugagagccaccgugccugacguugucaugguuuaauuggaauuuuucuuaaauuacacuaaaaagcaaaguuacuuuuguaacuauaaggcuuaguaguaaaaccucuugaacauuuucuucuaaaaguuuaggcugaauaacuucugaaauguuuuucauucugggauggaaauugguuuuagaaauaacuauaguuauuuauuuauuuauuuauuuauuuugagacagagucuugcuccgucucccaagcuggagugcuguggcgcaaucuuggcucacuacaaccuccgccuccuagguucaagugauuuuccugccucagccucuagaguagcugggauuacagacaugcaccacccugcucggcuaauuuuuguauuuuugauagagacaggguuucaccauguuggccaggcugcccagcuauaguaauuuuaaaugguuaaguagaauuucugcugauggcagcuuucugaggcuaauauuauaauacacacagauugcuguggguagcauagugaaaagaaguaggaguuuuaguaauuaguauaaaauuaaauauucuaaaauuuauuggaauaauuugguagugggaagagguauuuggugacuaauuucucuguuaaaagugaauauauaaaugagcaugaaaauugcacaaagaaauaccuuaaguuauuauguuuuuguuuacuucagggcugaaaacacaguuaaaucacuuucaaaguuaaaagacuauuaagaacacaagauggggacuccugcuucuggaaggaaaagaacaccugugaaagaccgauuuucugcagaagaugaagcuuugaguaacauugccagagagguauguuugguaaauccccucucaacacugaguugcacagauguauuguaaaaaugccgauuugacagagauauagacguuuacucauugaacuaguuucagauguuuauuaugagcaagauguuauagcuagucucuaaaauaguguguuagaauaaaauauaguuggauauuaucaacagaaaucaaauauagagaugaaucucugaacaacacauuuuauuugagacaguagaauuguaauuugggcauacacacagacugcauuggucuuugguauguccaaagaacaaagaaaagauugagguuuuuauuagagaaauguuaugcauuguuuugaaagaaaaugcauuggcacuagcgaaguuuuugggagcuggcaugcucugauuugugagugacugugguagguaaaacuagucuuagaguuauagcaguucguuuccgcagcuacuagguaaaacugaucuuaagguuauagcaggucauuucagcagcuggcuugccagauaaucccugggcaggugcuugugcccuaagugcuuuucuuuuccuuuucuuccucccucaucucaugacuguaauuuaauuggguaugacaagauaauuccaauuuauauaaucaauuuucacaauauccaaugcauccaaaauuaauuuuucuuuauauuuuuauggguuacuugaguuccauguacuuguuauaauguauugaaguuuauaauuaaucuuucgaauguaaacuuaggauaauuagaauguugaagauaugaugacuauauuauagaaauacucauugggcuaugcaguuaauaugcuucagacgugguauguaaauguugauggaaacaauauuucaugucgguucagauucaguguuuuauuuuuugaaacauugcaguggaauuuuuauguuuaauucuguuagcugguaacagaacuucuggggcaauuuuguuucaguuuguuguaacucagaaaaaagaaaaagggaaggggcgucaccuauugaaucgcuggcaacauuuccugccguauauuggaaauuuaagaugacugccagcugggauuucuuacuuaauugccaacuuuguuucagacucuaucugcaacugcagacugaccacaaacuaauaugguauaagaauugcuuagagcaucauuaaauuauauucuuuuggugagaauuauuaccauaucacuuccucuuuguuauuaguaaauaacuuauuuaggaauaguguauuuccuuuugacacauuacacacuuuuuugauccagcucauuguuaugauuuuccuuuuggaagcugcucaguuagcuuuugaauuagaagucaaaugcuguaggaggcuauuuguagcaaaggaaaguuauuaccuaaaaccugauaagaaauugugauauuacuauaacaaaaauacauuaaaaaucaaugagagcguuuggguugauuccaugucuuugcuguugugaauagugcuccagugaacguacaugugcagguauuuuuauaauagaaugauuuauauuccuucaaguaaugggauugcugggucaaaugguauuucugguucuaggucuuugaggaaucaccacacugucuucuacaaugguugaacuaacuaacauucucaccaacaguguagaagugcuccuguuucuccacagccucgucagcaucuguuguuucuugacuuuuuaauaaucaccauucugacuggcgugagaugguuucucauugugguuuugauuugcauuucucuaaucagugauguugagcuuuuuuucauguuuguuggcugcauacauugcuucuuuugagaagugucuguucauguccuuugcccacuuuuuaauggaguuuuuuuuuucuuguaaauuucuuuaaguuccuuguagauucuggauauuagaccuuugucaaauggauagauugcaaaaauuuucucccauuuuguagcuugucuguucacucugaugauaguuucuuuugccuuacagaagcucuuuaguuuaauuagaucccauuugucaauucuuacuuuuguugcgauugcuuuugaacaugaaauuuuuugccugugcuuauguccuuaaugacauugccuagauuuucuucuaggguuuuuauaguuuuggguuacauuugaguuacaucaacucaaaugcccaucagugauagacuggauaaagaaaaugugguacauauacaccacggaauauugugcagccauaaaaaggaacuauaucauauccuuugcagggacauggauggagcuggaagccauuauccucaacagacuaacacaggaacagaaaaccaaacacugcauguucucacuuauaagugggagcugaacaaugagaacacauggacacaggaagaggaacaacacacacuggggccuguggagagggagcacaguggggugagggagagcaucaggauaaauagcuaaugcauguggggcuaaauaccuaggugauagguugauagguacagcaaaccaucaugacacguguuuaccuauguaacaaaccugcagguccugcacauguaucccagaacuuaaaaaucagugagauauuuuucaguuaaaagauuuaaaaaugaaaacguagauacgacucuacagugagugaucuuaacuauuugcacaaaugaagcauuuuggaaacaacauaauuguaguugaaauuugaaacuacccagaauguuuccuuucaaaauuggagggauuuacccagauuucuguaagggaggaaaaugccaccaccuucuagucuccuuuuguguugucacuaaguauuugaacuuuuuuuuuuaaugugaugcuuucuuuaaaaaauuguauaggauucuaacauccagcacuugcugagugcuguguagcaaacacuauucuaagcauuuuacaugcauuaauucauuuaauccuuauaaaaucugcagucaguuuuuuuaucugcauuuugcagaugcggaaaccauugcacagaaaaguuaaguaacuuccccaagguuacguagcuaggaaauaguagagccaggauucagacucugaagcuuggcuccagagucugugcauuuaaccucuuacuaugccagauuguuucucaaucagucuucucuaauuccaccauuaauagcuuauuuuuuguuuuucaguaacuuuucaugacuuugaaagcaguuucacaucuugauucucacaaaagucuugagcuaaguaggauagauauuauuacuagccauguuuacagcugaggaaacagaugauguucagauagcucucuaaaauguaucagaagcaaggcuaacauucacccauuugaagucauuguucauguuccaggagaggugggcuuuggagacuuacagggauuuggagaaaaaaauucagauggcacaauaucauuaaccuaaauuugaagacaguacuagcaacaccuuuuuuucccccucucacaaguauuuauauuaguccccaaauuaguauuuuugguuaaauguaucauugcagauccaaaguuuuacuuuuuguauacuguuuauuggguuguauaaaguccucucucauuccaaaagaauauuuuugcugucaaaaggucuccgaguaaauggaagauauaguuguuugacaucagaaaaagaugaguuaaaauuccuagaguuuaucuacuacauguugguguuuaugcucagaaaaauuuaaauauuuguccucaacuaccaaaaacuuaaagugguuaaacauaaucauauuguaagauuuaauuaaaaauuuuuguacuaaagggaaguugcuaggaaauagagcaguaauuuuuguuaauuuggaaaccauggcaacacaguaaauauuaugucucuuaauuugucuuucaguguuuuuuuggcaugagugucauggaagaguaaacaaaauuaaacacagugaacucugagucuuugcuaccugaguuagucauuuucuuugaauguuuuacuuucucaaauuuuguauuucaaauuucuugaaauuaaagcauagucuguaaaggcccaaauuguacauuaucucucuuuuguccaugccaguugcauagguuuuauguuauggaacauauguguggcuggcaauuccagaccucauuggcucaguucagugcauuucugucaaauuaugaauuguaaauuugccuccuuuaaaauagcaguuuuagcaccaucaacacugugauacuaaaguuuuaaagcuagaggauuuucuucuuuuaaagucauuugaguguguuuucguguacuacuguaguauuuuguuuuguuuuguuuuugagaugaggucuugcuagguugcccaagcuggacucgaacuccaaggcucaagugauucucccaccuugccucccgaguagcugggauuacaggcaccacuaccaugccuggcuuguuuuugaaaaacauuaaauacagaaagauuuuggcaauaauauaaguauccaugaguccaacacccagcauuaacaaauguuaacauguugucacaguuguuucagaucuuuucuuuaaaauguuaggaagaaaggaagggagaaagagauauaaaccaaguuuaagguccuuuguuucauuccccaggccuaucccucuccuuccuccuauuaaggaaucagugugauaaaauaaaaauguguccuucuuguucauguauuaaaaguucuaauaacuucugaaccugccaccuggagucgauguagcuaugaggggccgugucucaccaccacugcccaggccaggcaugguguugggcgccaggccugccucaccugucuuggggugcccaggguaaaggcaggaguagcgcugacaccuguaagcaaacugaagugcgaugacagucucgaagggucugggacgucagccauagcauccggccccagucagaggguucugugagagacaaguugauuguuaaagagguugcagagcuugagcuuauuuaccuuguacaugucaagaguauuuccugaucuaaaaagcuucauugcuuucugcugacuguaaccccagacgaggguuacuacuaggguggaaaauuucagcucgaaacuggacuuccugaugcauacaauguggugccuuccaaagugaaaugccugaccaggaucugguacccuaacaucagagauaggggaaauaugucuaaaguuuacugaggacauucgauugacagcacuggcugggcucccacgagaucauuaaaggauguuauuuggagauuaaauuauuuguuuacuaaucuucugaauuuugacgauccacugaauguugaagcugcagaacaucauuuguaggacaaggaggacuucuugaauaaagucgaugacuacaucaaguguuaaugccagaugauaaaaggagaagauugcaggcccauggacuguguguuacaguuugucucuaaugugaaaaagcagcaagaggcauugccuucucuccccuguccccugacucucccucucauuccccuggauugucccaguccugugaccauguuguccugacgaagaccaucuucaugacugcccguuguagauggagaauucaacauaaagacagcaagaaaacguauuuagguuucuaaagaguuaucugcuugucuuauguuuuaggcuguucuugcauugcuauaaaugcccaagacugggugauuuauaaagaaaagagguuuaauuggcuuaugguuuggcaggcuguagaagcauggcacuggcaucuacuuggcuucuggggaggccucagggagcuuuuacucaugguggaaggugaagcaggagcaggcacaucauauggcgagaguggaaacgagagcgcaagggggacagccagaucucacgagaacuuacuguuguguugaaagcaccacgucgugagggauccaccccgaugacccaaauaccucccaccaggccucaccuccaacacuggggauuacaucucaacaugauauuuggaagagacaucuaaacuauaucaccuuaacauguuuacuuuuuugaacucguacuguuuaggcuguuggugauacucuugagaaguuguaaugaacucaaaauugaggcuggagcuuucuuauucuuuuccccaacaaaauugguuuucucccgaagugaugcucaugauguguucaguguaacuugcagauuggaauaagaaaccugcuacaaauugugauuggauacaaaugcccuuauccucugugaauguuggcccuaucuacauguuaugaaguuucccagaaugcauaaagucuuucacuguagacauuuuuauugaaaugcauauuuuauuuaaguauauuuuggaccaauuaaauuaaauuuuuacaauguaaugcuuuauuuuuuguguucucauuuuguauuuuguauuuucauuguauagggcaaagacguuggguuggccgagcaugguagcucacgcuuguaauucuagcacuuugggaccagaggccgaggugggcggauugugugagccccggaguugagaccagcuggcuggggcaacauggugaaacccugucucuacaaaaaauacaaaaauuagccaggcauggugacacgugcuuguaguuccagcuacucaggaggcugaggugggaggauugccugagcccagggagguugaggcugugaugagcugggaucaugcccugggcaacagagugagacccugucucaaaaaaaaaaaaaaaaaaaaguaggaaaaauguugggucaaccaccuauugaagagaaauacaaagaaacuaugaaaggcauuauucauuuuguccaaaugcaacaagaauauggcucugaaaagucaucucuugcucucagguccacauguggcaaggacauuuuggagcucuuugaaacuagaucuggaugauaaaaauaaaaacaaacaaacaaaaaggcaggaagcccauucucacaugcugcccagaggaaacuggcuggagcugggaccugcugggguugguguucuugcagugaucuuaugaucgugagccaguagcuacuuagagugccaaacccuggcuguccugagggacaggauagauacucaggaaucagcccaaacaaugucugaugcuacugagacuguaccuguggccgccuucugcauuugcuuugacuccgggcccugccuggggaugagccucuuaggccuuagaggaccaggauucagcaacagcauaugccauacuuggccagauuaacacacauuggaggaagagcccagaagaaagacagguggauuuacuccagcuuuuaaacauuugaaccaaugaaaucaaaugcgaaauaaauguuugguuucaaaaaaaagguuuaauauguaucaccauaaacagccuuguuuaauggguuuuuguauauugccuucuaagagcucuauagacaccgggguguaaaacagcuagcacuauggugggaaacugccagaauaguaaguaguucaguauagcuggagaggggcuagggaaugggaggaggugauguuagggaggaaauagggaccaaucaugaaaggauuugugugcugaggaauuuacauuugauuuucaaagcuguggggagccauuaaaggguaaauccuuuuucagauuugaauuacaguauaauugcuuuagccacccaguggagagugagugguagaagguagaaggcagaaaacaggaagcuguuauaguuuuccauuuauuuuuugaaacagggucuugcucuguugcccaggcuauagugcaguggugcaaucuuagcucacugcaaccucugcuucuuggguuuugggacuacaggcauguaccacgacacccagcuaauuuuuguauuuuuuguagagauggggguuugcuuuguugccuaggcuggucacgaagcuguuguaguuaucuuagugaaagaugaugagaaccuaaaauaagacaaugacaauaggaauaaagaggaaggucuggauagaagaaauaguaaagagaaucuugaugggagcaaaguaguugagacuuagcaacugaauauggagggaggauagaaaagaggaaggacccuuaugaugagucuuuguuucauauuuuggguaaugggguaguugauggggaauauaaaaaagaagaggaagauuaagggaaugauuauaaauuaaauuaagguuguauuaagucugaguucuagugggagagccucaguuuuuuuuuuuuuuuggagacagaaucucauucugucucccagauuagagcacuguggcaugaucuugcgcuaccacgcccggcuaauuuuuguuuuuaguagagacgggguuuucccauguugcccaggcuggccuugaacuccugagcucaagucaucugccugccucucaaagugcuaggacuacaggcaugagccacuguguccggccucaauaaauaaauacaugaaugaauaaauaaauaaagaugcuucacaaauuuguauaucauccuugcacagaggccaugcuaaucucuguaucuuuccaauuuuaguauaugugcugccauagcgagcacagcuucaauuuuuaauagcaaguuggaucaggauugugggagaaaauucuagcuugggcauagagauuuacagacuaacaguauggcccaggagagaauauagaaugaaaagagcaagaggugaagcuugaaaacuuugguuauauuaacauuuaagaugcuagcagggaaaaaugugcuuaugaaggaugcugaaggagagagaugagagaauaaagaggaaaaccaggagacacuaguauuggagaaagcuaagagaugagaguuuuaagaaagaauauguguuuagugauauugaaaguccagaaaagacagaugagauaagaauagaaaaauucuauuggguuugguaguuagaggucauuagugacuuuugugaugaacaauuucaauaaggugauaugagcagaagccagauugcagucauuugaagagagugagaagugaagagggaggugugagaaagcuuagcuguaaagagaagauaggguagaauuggaccagggugagauuuuuugcuugccuuuuaaagaucagagagacuuugaaccuaguuaugaugaagagagugaaccaauagaaguagagagcaaagacccagaagagagaucagauaguugggacaaaguccuggggaggacaucauaaaauggaggguguguaugugugugagugugugugacggggcuugggaggguuugacuuucaacaacagaagaggcagcucuucaguagaaccacagggaaaguaagaaagaagggaagacugggaagucuguuaguggcuuuggagggugugaagcgaaugccuucuucagaccuuaaaaugccuucugucaugaaaacauuggcacaggaggggaaauacuaaaagugucagaacuggaauaaugaaagaagugcugaacugauaaggucuugcagagaaacuuuuuccauugauaauucagaucauuuacauuauauaucuuggaaauaccuuccuguuuuguuguuguuuuuuaaauaggcuacacauugauugguacccauuuuguuuuuaaaaaccuuguaugguucauugugcagagccucuccuucaugugauuuugcuuucugagguuucaguuacuuauguuugaccacaguuugaaaauauuaaauggaaaauuucagaaauaaacaguuuguuuauuuuuguuuaaaucgugcaguguucugaguagcaugauuaaaucucacaucauccugcacaggacauaaaucaucccuuugucuaguguauccacacaguguaugcuaccugcuagauagucucacaggagccggcucuguuaucagguugacugucaugguaucacauuguuuguguuugaguaaccuuuaguuuauuuaauaaugaccccaaagagcaagagugacucuggcaguuuggauaugccaaagagaagccauaaaauucuuucuuuaagugaaaaggugaaaguucucaacuuaguaaggaaaaaaauugugugcugagguugcuaagaucugugguaugaacacaucuucuauucaugaaauugugaagaaagaaaagaaaaaucuguguuaguuuuccuacugcaucucaaaccacagaaguuauagccagugugugugauaaguauauuaugauggaaaagacuagauuucugaguggaagacaugaacagaaacauguucugauugaugacagugggauaggguuugguacuaucugcaguuucaggcaucuccggggggacuuggaacuuacuuggauaagggggaacuacuauauacuuaaaguaccuacauccugaagaaauacacuuauuugugguucauuagauacaguacuuaaauauacauacccuuuuccuccucucagauagcagucucaagugaaauucaauuuauggauuuuauuuuagggaaacagcacugccuagcccauugaauagguuccuccuacuuguagacccauuggauggauggaaaauuuagaauacgauugauuggccucacaugagucucugauuuggaaugccaccaugagccacaacaaguuuauuuuagccuguuccccucuguuuauuuaacugaagcaguaacaaaauccaaauuuaaauaucagaaaguuuaagaaugcuuuggguauugggcaucacagaauauagcuaaucacguuuuacuuugagacauuuuuaccucacuuguuccuuguuucagguaaauugcuucagguaaauuaauuccacgauggaauaguacggauggggauagaguugagauggagaaacugaaguuaggauuagaaaacuugauguauuauaagugaaaguacaaagagccuauuuggaaguagagggagucuguuggaguagauggagaggauggauucaagggauauuguaaaggaagauuuguuaaggaaguaggaggucgucagaccuuggguuugaacaagagugacaagauuccauuaauggaaacuggaaaauaaggaagcaaagccuguugacugggggaaaaugagacugauuuuauucacucugguuuuggugcugacaagauagauguuagaaauguaaguguuuauuuugguagagaagucagagcuugagaugcuagauuugagucauucucauuggcugguaguugaaacugggaauaaaaaaugagaguaaaggcuguguacaguaaaaggagauuaucuacauuugguuauuagauacuguguaugguaaaaggagaagauuauuuaccuaucuaguucucuauucagagaacuagaauaguauuauuucauagaaaagagagaaucugugcuaaguugaaaauccuaggauaauuauccaaaguaaguuuuuaugauuugucuaaggauaugcaauuauacuuggacuauaaagauguaaguugguggcaaugugguuaagagugugaacugaaguaagauucuuaggauguagaucucagcuccaguauuugcuugucuggggaaggcaaguuacuuaacccuucuguacuucaauggguuauuuuguggaagaaaagaaaauaaggccaggugugguggcucacaccuguagucccaucacuuugggaggccgaggcaugcagauugcuugaguccaggaguucgagaccagccugggcaacauggugaaaccuugucucuacaaaaacaaaaacaaaaacaaaaauuguuuggauguggugguguaugccuauagucucagcuaaucaggaggcugagaugggaaagaucacuugagccugggaggucaaggcugcagugagcugagaucaugccacugcacucuagcuugggugccagagugagagccuguccccgccccccccccacccccccaccccccccaaaaaagaaagaaaauaaggaucuauccuugcuaaguaaguggucaaaccaugguagauauauuaucugaauaguuuggguuuucuauugugaggugauuauucagauaauuuaguuuaauuuuauaaguaucaagagcaaagguaagauuuaguacaguuguaauuggauccugauauauuacuuaaucauuauuucccaaacuguguuucuuggagcaugacccuugaaguaucauuuaggguuuauuuaguaauguggucaagucugagaaauacuauauauucuauccucuucuuugagauucauaaugcauauuauuaaggacucugauuuuaaaaaauguuuaacuuagcauuuuccaaacuuguuauuaauagguuauaagcuccccuuuaucccauuuuauauauuaaguuuuauguauuagaauuuuauauauuuuaguauuuauuuagcuuaggcauuuuugaugcauucagucucaucuauuuaaaaaauuuaaauugagauauaauucacauaccaucaaaacuauucaccauuuaaaaauauucaguaguuuuuaauauauucacaaagaugugcaacugucaccuaccuaauugcauaacauuucaucagcccaaaaagaaaccucauaccacuuagcagucacuccucaucuuccccuuccccagccccuggcaaccaguaaucuacuuucugucuuuauguuuuugccuauucuggacauuucauauaaauugaaucaugcaauaugugaccuuuugugucuggcuucuuugacuuagcaaaauguuuucaagguucauucauguugcauccuguaucaguguucgauuucuuuuuaaggcugaauaauauuccauuguauggauaaucucgcugguuuauucguucaucaguugauggauauuuggguuauuucuacuuuuuggcuauugucaauaaugcugcuaugaacauucauuuacagguuuuuguguggauauauguucucguuucucuuagguacauauuuagagguggauggaugguaucacuguguuuaacuuuugaggaacugccucagcaguucacacagcaauugugccauuuuacauuuaccccuguaauauaugaggguucuaauuucuccacauccuugccaauuuuaguuauuuucaguugaaaaacauuuuuuaucauagcaauccuaguggauaucaaguaucucaauaugguuuuaauuuacauuucuuuaaugacuaaugauguugagcaucuuuuuauguacuuauuggucauuuuuauaucuucuuuggagaaaugucuauuuaaauccuuugcucauuuuaaaauuauuuauauuuuuauuguaucucaucuacuuuucucaaauuccaaaagaacauaauacaaaauuaugaugguaaaggaaguaucuaauguagaaauacauaaaccauaguacauguuuaguucucuuuuccuggaaguucuuuuuuuuuuuuuuugagacugagucuugcucuguugcccaggcuggagugcaguggcauaaucucggcucacugcagccuccgccuccugggugaagcgauuccccugccucaggcucgcgaguagcugggauuacagguucacgccaccaugcccagcuaauuuguguauuuuuaguagagacaggauuucaccauauuggccaggcuggucuugaacuccugaccuagugaucagcccgccuuggacucccaaagugcuaggauuacaggugugagccaacgugcccagccuuuuuuuuuuuuuaaacaguaauuuaaaguuuauuccagcuauaaugcagguuauucugacuuuaagguagcaucauauggcauucuucugaguccauucccgagauauucuguuguacuuuuacgucugucuauuuuauggauccgugugcucucuggcacuagggggucaucuggguuuggaucacauagcagugaacaaauggauaaaagaacuuuagaaauaguuuuaaagcaggcaaccacugugaucuuagaauaucgagacaaaugcugccauuacuguuaauauuuggaugacaaauccuuguuguacaugcaaccuuaggugguuugaaggagcagucuguaggaaaaugaauugccaaaaagaauacaccgcuuugauaugggcugucauuaggucccauaauuguggcuugccaaugaaacauaccauccucaacuggaccugcagaacauugugcuggagggucaugggccaaaucacuaaguuccuuauuaaucugucuuagugccauaguaugugcuugucaucuggcuccucacucucucgguaugugcucaaaagucuggccaaaacuccugguuaucccggaggugggacagcauugucucaucucauaccggcucugccagacacaagcucuugguauuguggagacgacucucaugacaacuuuguggcuggcuaaccagagcuguagcuuugcaaugacuuaagagcaguuuuuugugcucuuccgaaugggguuccacccccaaauccacaaauucuugcgagaugcagugagguaccggcucgaacuggagcaggccaccgccaggccgagaaguucuuucuuaguguccauuaugugauuccuaauuauucauugagugauacagugaauauucuacaaauuuaaaaguucugugaguuuaaauacaaccuaaugcauuuguucugggagugaucaaagcccaugauuuucacugucuuuuuuuuuuuuuuuuugagacagagucuugcucugcugcccaggcuagagugcaguggugccaucucggcucacugcaaccuucgucucccagguucaagcgauucuucugccucagccucccaaguagcugggacuacaggcaagcgcuaccaugccuggcuaauuuuuguauuuuuaguagagaugggguuucaccauauuggccaggcugguguugaacuccugaauuuuucugaauuuuucugaauuuuuauauuaacuuuauuauaacaguuggggucauaucagccgaaagacucuaaaaguauuuaaauaauuuaggcuucugaauacuucuaauuuauaucuuauucugacuuuuaaauuagccaacuucuuuugguaaaauauauguaacaugaaauuuaucaugguaacuauauuuaaguauauaguuuaguggcauuacauccauuugcauugucaugcagccaucaccacuauccuuaagaacucugucaucauccaguacuggaacucuguacucauuaaauagugagucccauuucccccuacccucagucccuggcaaccacuauugugcuuucugucuguaugaauuugacuauuuuagguuucucauuaaguggaaguauacaauauuacuccuuucugucuggcuuauuucauuuaguauaaugucuucaagauucauccauguugcagcauguaucaaaauuuucuuuuuaaggcugaaugauccaaaguauguguauaccauaauuugucuauccauucguccauugauagauauuuggguuguuucugcauuuugacuguugugaauaaugcugcuaugaacauugguauauaaauauauguugucucugcuuuccaguucuuuuguauauguacccauagguggaauuauuggaucaaaugguaauuguguguuuuagccaacuuuauuuuguuuuguuuguuuguuuucugagacagaguuucacucuguugcccaggcuggagugcaguggugcaaucuuggcucacuguaaccucugccuccaggguucaagugauucucaugccucagccucuggaguagcugggauuacaggcaugcaccaccacgcccagcuaauuuuuuccauuuuuaguagagacgggauuucgccauguugaccaggcuggucuugaacuccuggucucaagugaucugcccgccuuguccuccuaaagugcugagauuacaggcgugagccaccacgcccagccuuuacugugaauuuaguuaaaucuugguuguccuuuauuguuauaucccauuuauuuuguauguaugagguguauauuaaaaugaaucuguagcagcucuuuaucugauuguauucugagguaaaaaugcuaguguuaacuaccuagaaguauguuuuauguacccauaauugucuauucaaaaauaauuuuaaaauauaucacaauaaguuauagagcauauauuucgucuacuagguuggaaucaguguuggcuccuugcuacuccugcuuauccauguugcuucaagcaucuaguaauaauguauagaaagaaccagauaaaguaguuuuaaauccuguuuauuucuuuuaaagcaugugguuuuaauggccucucuucaacacagucuccaagggagguaacaucugaguuggcuaaguaacaaagggaaggguguuugugugucucugaagcccauguucuuucuguuccuuuccuuuuuguaguuaaaaaugucuuauuaaagaauagauuuuaauuaucucuaaguuggguuuuaugaaggaagucucauuuuaguauauauagauuguacagaauuggccacagacaaaucuuagaaggauaaaauuagcauucuugaauuaaauuucuaaaggaggcuucagguacaauuuaauauacauguaaaugaaaauuccuacacauugauagggcuuucuuaaaaagguuugaaaguuuugaugcuuugugauuuuaaaauacauuugcuaucuacuuaagcuuaaaagccuugaaguguuuccuauuaaaaaaaaaaaacucuaauaagaaacuagugucuacucauagaggggugaagaaggcagauaacuugaagcagagcauagguuuugaaaagacggaggccaguguaaaauucaugggagaaaacuaauuucucuagauuguuagugguuacagcuuacgguugguagauuacaauuuacuuugcagggguuuuucuauuaaaagaccaguuacacagacugggaaauugccacaauuggaauaguugaguagcaguuaacuauuuaacucucucugcuucuuagaagccugcugugacuuugccaggcaaaacuaauuucucccuccuacaugcuuccuucccauaagcauugugucucuguauucuucaacuuugugagcugcuuuagggcagagaugucauacuuuacucuguauuuucagcaccuagcauaauugcuuaauguaguagauccuuuuaaacauugguugaguuuauucuuacuaugagacuugggcacgaauauaacaacaugggaagacaacaacuauaguuaucagaggggauagucugaaucagaguuaggaugugaccaaggacagaggaaaccauuccacuaccauauagaaagcagacagaagauuucuaaguuucauguggcacauuaagcuauuuccuuaucucauuuccuugauacugugaccuaugcccugcaauucauuuguuuuuuuuuagcagaccuugaggcauaaaaguuguggggugagagaagcauggaauuuuaauacaacauaauaaagccgcaauagagacauggguauagagccuuacuuuaugaaagagggacuggggagaaucuucauagaagguaauauuuuacugaauaagagaaaggagaacagcuccugccaaacaguuugugaagagaggcguaacagaacacaauagaguccaggaauggagagagaugggaugcacccaguacacguggagcaaguagaguaguccccaccccuccaauccaugggagauacauuccaagccccccagcagaugccugaaacuguggauaguagcaaaccugauugccaucaaucagaacacauuucuauucauguuuuccaccuacaaauguaaugccuuuuccaucuuaacuaucaugcacuguggcuguaacuuuugccguuugaggugcggcagcaaaacuagcacaaauuucuuuuuccuucuucacaauuucauggauagaagauuuguucuuaccauagaucuuagcaaccucagugcaugauucuuuuuucuauuaagguagaacguucaccuuuucacuuaaaggaagcacuguguggcuucucuuuggcauaccugaauugucagaauuacucuugcucuuuggggccauuauuaaauaaaaugaggauuacuccaacacaaucacugugauuugauaacugagacagcuaacaaauggguagcauagacaggauggauauacucgacaaagggaugauugacguccugagagauuuuaucauacuacucagaauggcguacaauuuaaaacuuaugaauuguuuauuucuggaauuuuccacuuaauauuuuuguaccuugguuaaccauggguaacugaaacaacagauaaggggggaacuacuggacuuggaaguaagguggggaccugacugugaggagccuuauuucaguuuuaccuuucuucuuucuguuccucccuuugugcuguucuguggaauuuuugcuuuaaccauaaguaauaaggaguugguggaggauuuuaugcaguggaaugaugugaucagaaauaauacauuuugaaaggcugauuuguccaucauauaaccauguagaagauaaauuauaaggcagauucuggaaguaggcagauggauuuggagguaacuguaagcaagagaugaagaauuccuaugguaugauuccauguauaugaaauguccagaauaggcgaaugcauggacacagaaaguagauuagugguugccaggagcugggagaaaggguuaauggggaaugacuacuaauggguaccagguuucauuuuggggugugagaauguucuggaauuagucaugaugauugcacauccugugaguauacuaaaaaccacagaauuguauacauuuauuuauuuauuuuugagacagcgucucacucugucaucuaggcugcagugcaguggcaugaucucagcucacugcagccuccaccuuccagguucgaguaauuuuccugucucagccacccaaguagcugggauuacaagugugcaccaccacaccuggcuauuuuuuuuauuuuuaguagagacaggguuucaucauguugccuaagcuggucucaaacucuuggccucauaugauccuccugccuuggccucccaaagugcugggauuacaggccugagccacugcauccagucggaauuguauacauuuaaauagugaauuugaugauaugugaauucugucucaauuuuaaaacagagguggggaguggggagaugaagaguuccugaaaugagcaggaacagugagaauaaagaaagcugagauggguuugauagagacucagugguagagaauugucaguacuuggagacugauuauuggcaguguccaaaaugaaagagagguuggcucugaaguuucuaguuuauaugauugaaucaauggggaaaaaauucuggaaaaagaguaaguuuggagaggcauauaacaaacuguaugaaauguguugaguguguaaucaaacaagaaguuaaagguaaaggcccggauuugaggaaagacuuaggaacuagagaaagaaaugaguuuauaagaguugauuaaaacaaucaaucaaacuugcuugcugauagauaauaucuucuccugcccaccccuuuugcgugguaaugucccauucuuuauuuucaaaucugguguacagguuguuuuuguuuuuguuguauaaagcugaguuuuauauuacuuuucaggcagaggcaaggcuggcagcaaaacgggcugcccgggcagaagcaagagauauacgcaugagagaacuggaacgacaacaaaaagagguaauuugagggaauaacccuaauuucauauuugucucccccaaaaucaguacuuggcuaguuuauucugaugugaaucugguuuccuuugaaacauugaaaauaguauaaacugauguauguauuuuaucaagccauucugugccagcaaauuaaaugugauauuuguuuuaaguaguaacaacaaacacauuuauagcuauuaucguguccauuguuauaaguuacuaguauuaugagugcuucacuuacauuagcuaagguagcuuuagcaaugacaaaguguaguauagcuuuaauuguccuaaaauuuggauuaauuauauuaugauaucuauauaguaaaacacuguaaagucauucagacuuacaauuuuaaaacauauuuaauaauagaggaaaauauguaagaauaugagauaaaagcaaaccaaaacaauaaaauuuguaggaccccaauuuuauauuacaaaaaccaguauccauauauagcaucaaaaaacuacuagaaggaagugauuauuaauacugcaguuugucuaugguggaauuauuguugguuuuucuuucuuucuauacuuuucuauaauuuacaaacuuucaguauacuuuuaucagaaaggaaaacaagaaaaaaauuuuuaagaauaggcauauggaaauugggcugauuaaaaugaaauaaauaugcuuuuacuuuucugacauugacuugguccugaaaauucccauaauaaauauuuuugauguuguaguaguaugaaggggcaaaagccuaugggacaguauuaaacacuuucuuuugauuuugguggugaauuuucugugagcagguuaaaaagcaauguaaauauuuuauauugucacagcucaagaaaaacacuaacaauugacauguugcuaauuuucuuuuaaccucauguauaguuucaaauauggaaugcaguucuugaagaggaaguguugcaauccguugucuuuuuacuccuaaaauuauacuaaauauaauaauaaguggauaagcugaaguggaggaucacuugagccugggaguuugaaguuguagugagcuaugauggcaccacugcauuccagccugggcaacuaagugagauccugucucaaaaaaauaaauaaauaaauaaauaagugaaugagacaguuauuaaauguaaguucuauuuacaguucucugaacuacagggaaacaugcaucucuuacuauugaacauauuuagcuuacuaauuuucuguauuuugaauguguaacuuugagucagcuaucauuguuuuuuagggaaaauguguaugauuaauuuaagguuuuuggagaaugcaauauguuagaaacuauuugguuuaugaaauuuuugcauuucuaguacucucuucauuccuuugaucggaaguggggacagauucagaaguggcugguaggccaguauugccuguccugcauguugugaucaauugcugaaauaaugcagucuugaaguaaaacauuaacuaauaguuugcaaaguaggaguguuuggccugugugaaccuaaaggucagagugucuauucugucuauaguggaccagagguauacuuggaguccugccauuuuauguuguagucaguauccucaccuucaucucaugaaugcuccugaucaagaaagagugagaaaaugaauguguguuuucuuuuuauggguuuguucuuuucuuccccccuucucucuccccuuuuuuuuuaaaaaaauaaguccacauggucuucauugaaagaugacccaaguaauucuuuucauuuccucugaaaauuacucuuauuauaucaacuccuucagguccuuuuuaaauucucuaccacuacucucaaauuuguuagcuauaaaaacaaauugugaaucaguaaaauguuagauaaugugaaucauuccuaaauuugaacuuuuuuuuaggcuugguaaguuccccacugucuccuauuacagggcuucuuaacuugguauaugacuaggcuugggagagggauaugaagccuuaaauucuacugcagacuuucaaauguaauuauuuuuaugggaaaugcccacagguauuuuuauugucagauucucaaaguagucuguaauuccuaaaggguuaagaaccacugucugauugcugcuaaacaagcaacuuucuuucuuucuuucuuucuuuuuuuuuuuugagauggaguuucgcgcuuguugcccaggcuggaguucaguggcacaaucucagcucacugcaaccuccgucuccuggguucaagcgauucuccugccucagcaucucaaguagcugggauuacaggcgcccgccaccaugcccagcugauuuuuguauuuuuaguggagacaggguuucaucguguuggccaggcuggucucgaacuacugaccucaggugauccgcccgccucggccucucaaagugcugggauuacaggugugagccaccgcgcccagccaaaucuuuuuuuuuuuuaaaccucugugaaauuuguauaguuuaggcagugaguacgcuagauuuucauugaaaggggugaccuuugggcuagaguuuuaaaauucagguagugacuaauccaagucuugauuuaugggcaggacuuggaccugcagagaaaguggcauuucuuuucagaugggaauaauuaucacuucuaacccguucugacacuugcuuuuacccuguuaaaacugauucuuugggucugggcauaguggcccaugccuguaaucccagcacuuugggaggccgaggcagguggauuaccugaggucaggaguuugagaccagccuggccaacauggugaaaccccgucucuaccaaaaauacaaaaauuagccaggcacgcuggcgggcgccuguaaucccagcuacucagggaggcugaggcaggagaaucgcuugaaccugggagguggagguugcaguaagccaagauugugccacugcacucuagccugggcaacagagugagacugugucucaaacaaacaaacaaacaacaacaacaacaacaaaaaaacugauucuuuggugugaguugguugaagguaaacaaaauaaauaaaaagaaaaagaaaaaaagaaaaaaauuaaacugauucuucugcucauuuaucuuugucucucuggcugcuuuaucugugagcccauaaggagaaguuggcauguaauaguuacaauacaaaauauaaauggcuaauguuuauaguaaaauaaaugaugcauacacacacaauccacaauaggauugucaguuacuagaaggaaggaaauuuuccuauauuuguaauuuccccuaauuauaauaccuuuuuuugggugggagugugauguugggacaugaauagggaaugaaaaggaaggaagcucagaaaugaguccaacuuugagugcauacuguauaucagcacugugcuagggcuuuuuacauagguuuuuauuucacauuauaagacaguauuacugucucaauuuuauagacauguuuauaaagaauuggugaaguaaauaacuugcauagucauuggcagaaccaguauuugaagguaugagagagugccacaccugguaaugugcuggaaggugaaaggaccaggaagaaaaggacccacaccuuccugggccucccauuaguguuaguuuagucaacuuuccaugaacccaaugauucuauuuuuaaacugggugucuuucuuaaucaguggugauucugaaagaguaaaugcaugucuugaagaguaaauacgguuuuugaaguuccuucuaauuugaaacugaaggaaugacuuuggugucaacuuaguaacaaauacuauuuguugacagaaaagauggccagguauauucaugggacugugguuuucuuuuaauagaaccauucauccucccuucaggugaacguuuaaaaacaaagaguauauuucauuuucauuaaauguaucaaaacagcauuuugaacaaauacaugucuuuuuuuuuuuaaggcguuguacuguuuguccagucuuuagugcuuuagugcuaauaaggacuuuugggauaaugacgauguauuauuuuccucacuguggaauagagggauacaccuuguaacuggcaccuaagaacacaguuugcuguaaucuguuaucuuuguccacugguauaauuucuucaagagaaaccuauuggcaauauaaauagugcucuagaaauaccuggcaaaugaagcuuuuuguucuuccagagaaggaagaaucucugaguaaaaaccagaauaccuugccauuuucuuucuuucuuuuuuucuuauguaauugguggaaauuuagccaguauaggauguuaucuuuacaguucaguugucuggugaauaaaaacgucuaaaugcuggucucagcuuuaugaucucauagauucuuacuuaauccuucugugcugcaacuuucuuacugcaaaaugaaggggucagacuagaugaucucuaaggacucuucuagcucuuaaaaauagaauugcuaccagggucacuuuauaucguugcuaccagggucuguuucccucauguuugccacugugcaaaaguauucaagguagaaguaauuaaaaaugacccaaauguuuugccuuucuauaugagagugguccuacuuagcaggcucuuaguagaauauguguuuugaacguuuuugguauaauuaaaauuugccuugagcuugccuuacaguuuuacguaaacacauuugucaaauagguuuagagaagugcugucaaguaugguagccccauguagguaauuaaauuuaaauuuaaauugacuaaaauuaaauaaaauuuaaaauuugguuucucaguugcauuucaagugcucaguagccacguguggcuaguggguacuacauuagcacaaauauagaauauuuccauggucagagaaaguuguauuggacagugcuuauuuaagguauaguuugugacuguggaauaaacuauacucuuuguccaaauuaacugaccuguauggggguuuauauuuuauucuguaguuuucagaagucuuuuuaggccaauuuuucaaauggagcaagaaaagcuguuuaaauauagagguacuauguaucaauacuuaauaagguauuuuaauuuauaauuguuuuuauuaauauaaggggcauaauugaaaguaugacuucaucugucuuugcugcaucuuuaaugggauaugcucuuuaggugagauuuuugaaaaugcucugugugauagauggaauggaaaaaaggcuagaauaaagggaagauuagacauuaaaccguauuuacccuaguaccucaaauaauauuggaagaggcauguugaguuaacucaccuuauaguaaaggcuuuuugaacuaaccaaacuaaguagccuagaacugauuaccacuuacuaagcuguaccugcccuucuaggcuaacacacaugcccccaaaacuuucgugguugauaaagaaagggaagaaauuuucuuggcuucuugcagacuacaugugucuauugcauaauaaaaaauguaaaucaguggccaggcaugguggcucaugccuguaauaccagcacuuuggaaggccgaggcgggcagaucccuugaggucaggaauucgagaccagccuggccaacauggcgaaaccccaucucugcuaaaacaaaaaguagccgggugugguggugggugccuguggucccagcuacuuaguagggggccaaagcacgagaauugcucgaauccaggaggcugagguugccaugaacugaggucgcgccacugcauuccagccuaggcgacagagcgagacuccgucucaaaaaacaacaacaacaacaacaacaacaacaacaaauguaaaucagugacgaauuccuaaagaucagaauaccugauuagaaauugaaucauaguagugcuuauaaacagacuucagcauacauuuggucaagggcaucagucacagcagaugucaaccagggaguuuugaggcauugauucauuuugcaaaaauacagcauugauaagcuaugaacccaguuggucaguaauguauagauuuucagucagcacacauuacuuuaacacuuuggacuugaaauucugaaagaucagaaauuccuuacuguuugagaugauuagguuuuagggacuagccauuuuaucucacaugacucaggccuuaaugcuccauugcuaauagcuaaauguggaaaaguuuagaauuacauuuaauuuagucaacuguuaggcugcaaucauuuuuuuuuaaaaaucugcuuauggcauuauucgagauaacuugaccaacucuaaaauauauauguaauuacuucuagauguaaguaguuuuucauauuaacaacacaaucaggcucuguuucaguuaguucuuagaguggugaaaaaaaaucuuuacaguaagugcaaaauuauaauccaaguauuuuuagaaucauauacugucuuaaaauacaucagugauaauguuaacacuucuuccuaccugcauaaacugaugaucacaaugaaaaaauagauuaaugucuuuuuuuaaugcugaacucaaguucucuuuguuaaguauacuugcacauuuuuaucuugguauauugaacucucuuggucuuauacagaccauuccaaguggucugacauacauacgccugauaaaauaggaacauugccaagauuauuucuacuuucuuuccaaccaaagaaugugaccgccccacacauacacaccauggaauacuaugcaggcauaaaaaaggaugaguucauguccuuuguagggacauggaugaagcuggaaaccaucauucucagcaaacugucgcaaggacaaaaaaccaaacgccgcguguucucacucauaggugggaauugaacaaugagaacacuuggacacaggaaggggaacaucacacauagggcuuguugugggguggggggaggggggagggauagcauuaggagauauaccuaauguaaauaaugaguuaaugggugcagcacaccaacauggcacauguauacauauguuacaaaccugcacguugugcacauguaccauagaacuuaaaguauaauuaaaaaaaaaaagaaagaaaacuaguacugcuauauugaaacuuacacacacacacacacacacacacacacacacacacacacacacacgaauguggcugccccuaagauaaguuauccaaaccugccugcucucaggaguuguugcugugcuguuaacugacugcucuuugcucaguuguucugauaaacaacugucuauucagugauuaacucuccauguacuuucuccuuucccaggaagauucggaaagggccagguauucccaccgguccagucaccaucguccuuaucugguuuguaauaaccuauacacuugccucuaauacuuuuccucauuagcuuaauguaaucacucacaaacuuuuacuguguuuauuuucauuuuuaucagggaguugaggaugcauuguccauucgaaguguuggcagucacaggguugguauuuuaacuugucuacacaauacaaagcuuacgugugagcuuucuucaauaauguugccuaaacaaucugacaauguuccuguauuucuuugcguuuuuaaaagaaguauaaaauauuggcaaagaccuuucauuggaaaaugaugcuuucuuucaaauuauugucauaaguaaaucaacucuaaaaucaugaauacuuuaaucuauuaacauggguccaaucucuuuuucuauagaaggaccuuugauuuuggaaaaguaucacaaaauaauuaagauugaucuuguagaauaacauuuguuugguucuaacuuucagacuuucccuacuuucauaucuuaaaaaaugacaauuaaaugcaaaauagcuuuggggcuuggaugauuaauuguaauuuuauuauguggaaaauuugaacaacugauuugaaaaguucucugaauauguauaggaauuaucaugcuuugacauuuugauuaacauuuuauagaaugccccagguuguuuuuugcauggauuguuauaagucaggaggaaggagaaguugcuccuuaaaaacccuuguauuaugccaagacccuaauuucugucuuaaaaaaguaugcuuuacaccuuaaagcagcacuuuuauuuugcacauugauaaugcuguauguauacuuucuuuuuuuccauuuuauuuuauuuaaaauuuuuuuuauuuuaauagcuuuuaggguacaauugcauuuugguuacaaugcuguauguauacuuccauguaguuuucuuaaucaguaaaaugaucuuucauguuaaagucucuauuuguuaguuuucccugacuguaauuuucuuucuaccuuguauaaaugauaaaaauagacucuaauaaacugagugugcucuggcauacuaguuauugacauguuuauauucacaaauauaaacuccaggcuggcuguuuuucuuggugaauguucuccaggcugguuauuuuucuuggugaauguaauguacugucuuuuuagaguaaguuacuaagcugguuacuaaaucaggaauauuuuaguuauaaaacuuuagauuuuuaagaauauuggccaggcacgguggcucacaccuguaaucccagcacguugggaggccaaggcggguggaucaccugagaucgggaguucaagaccagccuggcuaacauggugaaaccugucucuacugaaaauacaaaauuagccgggugugguggcgcaugccuguaaucccaguuacuugggaggcugaaacaggagaauugcuugaaccuggaaggcggagguugccgugagccaagauucgccauugcacuccagccuaggcaacaagagcaaaacuccaucucaaaaaaaaaaaaaaaaaaagaauauuaacagaucuuuacagaaaucuaagauaauuggcagcuuauaaaugauuuuacaguagaaaaauuuuaauagugaauucaucauacuucucccuggagauauaguacuuuguuuuuuucucuuuaaauauuuugaaaaggccgggagcgguggcucacaucuguaaucccagcacuuugggacacugaggcgagcagaucaccugagguucagaguuccagaccaaccuggccaacauggcaaaaaccccugucucuacuaaaaauacaaaaauuagccagguguaguggcucacgccuguaaucccagcuacuugggaggcugaggcaugagaaucaguuggauccgugggcggagguugcagugagcugagaucgugccaccgcacuccagccugggugacagagugauacucugucucaaaauaaaaauuaaaauaaauauuuuguaaagaaucaugcagggagucagucaauaaaagcuuuaaaguuaagucucaaaggcugugaaaauaauccucuucuuguauuuauggcuuuuucauuugcuuuucauuauaauguucgcaguguguauuuucacacaguuguuauuaagccgguuauuuauaaauuuguauguggccuuaggaaauuugauuauauauuuguuuaacuuaaagguagaaccagcaaaauuugaacauuugggggccuuuaaaacaaaucugcaaacaaaaaaggaaucugcaguuaaaccgauaauaacuauauaccagaauguauauaaucaggaugauuuuauuuuuauggcauuuguaucauuaaacaaauuuaagauauaacuccaguauuuaauuucauuauguugauuuugaaaauuuguuacuaugggauagaauaaaacucccaguauuuaaaaacgucaauguauaaauguaaaaauuaauaaaaguuuuacauccuagaggagauucuaguacauuacucucugugagugcacaucuaacacaguuuaaauguuuagacuuuccuggaaacaagucugaaggcucacuacuaauuucauuuaaaagaaauauaauugagauaaaacuuuuucuguuuuacccaaauaauauugugaguucuaaguuuucaucaaauuauuugcuuuuaaaauaauuuuuccauuaagcugaauuguuagacaacuuuuguccucuguagauggccuaaacacugaccuaaauuuccuugugguuugcuauauaauuuuggaguuaugcauuucucagccaguuauuuuuaaaaacuuaaggccguguacuaagaggucuaauacuuuuugaacguaguauuugauguuugaacauuagcaguaccugaaugugagguggauauauuuauggucuuaugcugcauucuuaggacuuuagguuucuccuuuuguccaauuaacuuucauauacuaucuuuuugaaagguggcuuaccagaagcuauaugggcuggaaauguuggugucagugcuauagacauuauguauaaaaauaaaaacagcaaagguaguucaagacugugaaugguaggauugggggagggaagauuaaaucaaaguuaggaauuuagaauugaaacaaucugugucuauuaguuuuguauaaugauuggauuauuaauagugcagaacauuaguagcugcuuggucauugcuuuauacauugaaauacaagaagacaguaagguaaagauccaaaauuagaaaaugaagugaucuuggccaggcacgguggcucacgccuuucaucccagcacuuugggaggcugaugcagcagaaucacccaggaguuugagaucagccugggcaaaguagugagaccuuguaucuacuaaaaauaaauaaauacaaauaaaauaaauuagcuggguguggugcugcaugccuguggucucagccaguugggaggcugaggugggagcuguccgggaagucgaggcugcagugagcguugauugugccacagcauaaaaacgaagaaaaagugaucuugauugaaucagagcaguagggauacauugccuuuucucauugguggagauuuuuacuguugcauguauuuaguuacuauuuauauaccaguagccuugguauaauuuuaaugaauuuaauuuuuaaaauauacuuacaauuuuguguuuuauuauuuacuauuacacuguuuaauucuauugaagaacccaucaaaggauauaacugggacacuuuggaguagagccaguacacccaaaaggaaagacacuaugguguguagcccaggaaaaugugugguauuaguguuaugcauucacuuuugacuuucaguguccuugauauuugaguaauagguacauucuaauagagauugacacuugcugaacuuuguucacuguauguacuuucuuucuaguuuguuuccuaaugaaaacuuucaggcaaguuugacaguuaaaauuucuuuaaaagauuacaauagcaaauuuuggauuuuuuuuuaacuuuuaaaguuaaaaaaaauuuucuuuuuucucuaugguuauagcaucaaaaauuuggaaaugagcccuuacuauuuucacuuuuaccuccuuugaugaaucuuucuuuucuuuacaacaauauaaaggccaacuuuuacuuauuggggugacuuuuuuuguuugcccauuguucuaguagaaauugguaugcccaaauuauggauuuuccuaccagauagauucaacauuuuuuuuuaaaccagcugaauucuacauuauauuuuggaaaaggaaaauugaaacagguuauuuccaguuuggcuuguuaaauccuaugccuguguaaaaugccacuggugcuauagagaggaugauaagaggaaagacagcuacucuuuuccaugaacuuaccuuauuuggaggauggaauagcuuaucugcuagaaugugugacuugaguaauauguuuuggucauggagguuuuuuuuuuuuuuuuaaacaaaaggguuagauuuuuuuuaauuuagaaauuucuauagagaagcaacuuuauuuuuggggaagugucucuccaugguaagugacauuuuacuacuacacaguuuaaaugcauacuauuacgcauuuuagaaaauuuuguaacaagauuuuguuacacaugcaauaauaauauuuuuuauuguguuuucuguuaguuucaggauaauauaagaaaagcaugcgguacagauauuuugcuccaauaaaauugguauuuauuacaauaacauuuucaaugaauuuauaccagugguaaaaugguaccacuuagucugauacuuauggaauuuauuuuuugagguuucugcaauguuuuuuguaaaugaccauuucauuaggcaugaauggaagggcuuuauucugacugaacuauuauuuuaaugucuuauuagaacuagauuauauacuuugauuuucuaauauauuuuaagcuuuuuaaaaauugugaucucuacaacaagaaauacauuuuacaccauaagucaguauacacaugaagauucaugcauguggauuuguauauauguaaaaguauagaaaauacauuauugaaacaaaaguuucacaaaauaauauuugcacuuacuuugcacaacacccucuaauauuuucucuucuaguuuaguuuuuaaaaugcugguugagggcaggguacgguggccucugccuguaaucccagcccuuuggaaggcugagguaggagaauugcuugagcccaggaguucaagaccaaccugggcaacauagcaagaccccaucuccuaaaauuaaaaaaaaaaaaauuagguaaguaugguggcauguuccuguaguucuguaguuccagguacuugggagccugaagugggaggaucacuugaacccaggaguucgauguugcggugaacuaugaucaagcuauuguacuccaaccugggcaaaagagugaaacccugucucaaaaaaagcugguugacccuacuaaguugauuuuaugaacuacugaugaauugcaaccuauccuuaugaaaacguuacuuuagauuggguuuuugaauaguauugcuuaaaauuuuaaaugaauauaagaguuggaaaagaaagauauuuuuaucaaacaauuaguauuuaaacuaccugaggaacuuguucauugcuuuuauuuguuuuguauaugacuuucuggguagacagcuuaaaaauauaaacuagaaugcuuaagaaacgaugugugaaaaccauaaaucuauguaguuacuauuuaguuuuucuucccuggauuugaaaugugguauuacauaucuuacuuuuaaaaaggauccuacaugaaauguggguguucuggucuuacgaguuuuguauauuuuucuuugauuuauauucagugucacaccuguauguauacugugcaguucacacauugaccagauuucucaaaaugagaaaucggcauuuucuugaggaaggacauucuuagguguuuguucacaagcagauccaagggaauguuccccaucuuggugcugcaauuguucuuuuguaagcuugaccaugcuuguuaugucagcuugccucauugccuguucauccuuugcuuuugccauuuuucaaacaauaggaaaugauguuaaaagugauaauaauuuucuuaaaaagcauuuuugacuuuagaaugcuuaauucuuguauuuaaaggcucccuuaggauguuuugugcuauaguguacugagauugaaucauaucacuauuacugauuaugaauuuuguuguuuaaaagaaaaauaaacauacaguuuugaauauacauacaguuuagcaauacuuuauacuaggaaaaaguaggaggaagaauauuuuuuaauucaacuggauuagcuuucauguuuaauaauuuuuuauuuuaaaauagugcuggauuuuuaaaauaaccucaaauauuacuucuucucuucuuuauauuucugaauuuggaaacaaaccaacuuucauguuuugcugaaacccaguaugauauguucaaggauagaucaucaagacuuucaucauuaguauguagcacaugacuuuguguuauauguggaauuuuacuuuauaaacaucuguugaugcuaauuauagaauaugacuaacuuucauggcuuuguuaugaacuuuuggggaaaaugugugacuaacaaagcaaaaagcuaauguuuugugguuguggcaugaauaguaauuuuuuucuuuaggauuucagaauuagacacaaguuauucuuaucuauugaggacuaggauugguaguaauaucuuuuuuuuuuuuuuaauuuuaaagauggggucccucucugucaaccaggcuggagugcaguggugcaaucauagcuuacugacugcaaccuugaacuccuggauucaagggauccucccaccucagccuucugaguagcgaguacuauaaacaugugccaccaugcccagcuaauuguuuuauuuuuuuuguagagaugggguuuugcuaugcuguccaggcuggucucgaacuuuuggucucaagugauccucccaccuuggccucccaaagugaugggauuacauaugugagccaucaugcccagcugguaguaauauaucuuuucuuaaaaugaugagccacccaccuaacauauacucauugucauucuaacacuguuagaaacuugucuucauguugagcacaagcccaaauuguguuuuaugucauaugucacaaagcuggcaggugugaaguugcuagauagaaaacauccaguaguguuagaggacaccuaagacaucaguuauguccaaacauuuugguuugauuugguuaguuuuuuaugguaugucauuaaccaaggaauuuaaguuauagcuuguuuuucuuggguuaauauuuugucaauagguugccugaguuucuaaauuacauagacaucucuuaaaauauucagaguaauguauaaaaagaugcauauucaaaaaaaaaaaaguaaaaugaguuuuuaaucauugauugggaauacagcuauauauaugugagaugguuuaccuagagcagucuguugccuuuggcucuugauagguagggcacuucuagccacacucucuuauuucaggcaaguaguacguaccuagauuagauuucuuaucuaccaauuuaccuauuuaguaguauugcuagccuuaauuuccccauauguacuuggcuguguacuccuaggaaaaguuagguauugagacaauccugucuucaagggacccuuuuauaaggugaccauuuaugguaugcugggcaauccauaccauguugguuguuuuccuccugagcauuacauacuguggauucacuaauuuggguuaagaguacugucugggacaguuuaaugucauguucuuuguucucucaguccuguuuuaauuguuccaaaagauugcuuuuugaccuuuagguaaggaagacuauagaaggaaaugaauuaucuuguuaccuauacccuuagccaggaguggugucucaugccuguaaucccagcauuucaggagguugaggcaggaggaucacuugaggccaagaguucaagaccauccuggacaacauagcaagacauugucucuaccuguucccccaaccccaaauuagcuggguguagugguacaugccugugguccuaccuacucaggagacuguggcaggaguccaggaguucuaggcugcagugagccaugauuguaccacuauaccccugucugggugacagagugagacccuguuucuauugaaaaagaaaaaaaagaagucagagggacucaaguguggugugaaggucuccacaaauauucugccugguucuuaguucuaaucaaguuuucuuuagcuggccagacacacagaugcuuggcacagagggaggugagggaggaaugcagauguguagagaggccagguagacuagcuaguaaagugcagugaauuguuuacuaaccuuugggaaauaaauugcauguaaacuauuguguaucucauauagaccuuuguguauauaauuugaagaugaauuuuauuauuuucauaacuucgcuaugcaaucauugaaguuaacuuggaauauuuacuuccagaaucauucuuacagucacucucauggaaugaagaagaggucuucugauucucauaaagaccuacugguuaguucuguugucucucauaucacaauucacgaaguacuguuaggaacuuaaggauuaugauugcuuuggugugcuacuaggacauuauugaaacuugauaaucugcugaaacaugauuuaucagaaauuuaaaaauaauuuuguuuucauuugcaaguuuuaguauuaacauaugcaaacccuagcagccagaguuaguacuauaucacaagaagcucauuaacaaguauuuucauuuauuaauuguccuuuggaauauaccucaagaauagguuuaguaagauucucauccuuauuuuaggaauuugaauugauuuaguugugguauuaugggccguaacuaaacucacaaauagguuucauucuaaaaguuuguguuuugggaacuuggaaugcauuuucuaguuucuucaauaaauauguaauggcaaaguuuccauacuagcuugcugaaaacucuuuaaccuauaauguaauuaaacugcagaauuaauauacucuuuauucuagucacuuugugaaacaacacuucuuuuuucuuuuucuuuuuuucuuuucuuuuuuuuuuucuuuuuuugagauggagucucgcucugucucccaggcuggagugcauggcgcgaucucggcucacugcaaccuccaccucccagguucaagcgauucuccugccucagccucccaaguagcugggauuacaggcaugugccacucuuccuggcuaauuuuuguauuuuuguagagaugggguuuugccaggugaucugcccgccucugccucccgaaguucugggauuacaggcaugagccacagugcccggcugcuaaacaaauuucugugaggaaaauaaugucuccagaaugcccacuugguacauuggaaacacccauuuccuguuaggcugcaacaguacuggcaaaggaagugcagucccaacuccuugcuaauucaggguucccauggguugaacggggagaggguuggaaggcuuugguugguacaagggaggagagaagggagaauguaauggggaggaaauuaacgagaggcccuggaagguagggucuugggaucucuggggagaggugagccuuaggugccuaguugagggugugaguggggagugaggagcggugugggaaggcagggcuaggggugguagggauggggugggaguagggauguccucaacuccacugucaacacugauggagucuuuaagucagagauugccuaaauuugcuuaaccuugaguaaaaaaguuggcuagagaaguugggaagggaauuuuauagaugguuuucucucccucaauuagcuauaauguguacuauuguuuauuuuguacauuguauaaaugaaccugccguaaguguuuuagaucaaaccauauuuaucguacucucucuuucauuuugguaacuuaauuugucaguuuauuuugacaaguaaugggacuaggaaauguuuggaaccaaauacauagcucuuuaauaacuucuguggcuuugccagauggauuguaaaacugguaauuauucaguuguccaggaguguucaaggacuuucuuaaguauggcaugagaauaaauuguuuucauuccauuuucucugaggguuuauugucuuguuuuuaaauuuaaaaauuuaguaaugucuuuguuuuaggggcuugaaauaauugucacuuugacuuaaugugauaugaugauuuaaaaacauuuuggagaagaagggauuuggcaauaucauauuuugccuuuuuguguucaguuuugccuuuguguguuguuagguuauuaacauuuagccuaagaaaaauguguuuaauuuugcuuuuugcagaguggccucuacuuugaccagagaaacuauagcagucuuagacauagcaaacccaccucugccuacuacacucggguuugucuaaacuuuuuuggcuuuauguguuugauucacuuuuaacauauuucuaaucuccccauuuugcauuuugacuagcuguaacuaaucuguaaauggcuacguauauacuaguuuuugguaacugaauuuauauagucugugggagucucuuuaaacaacgggaacuauucagucaucauguuuauaaaucaguaccauuaaagacauuuuuaaauaaagauguuuaaauguacaaaaaaaguucaaggaauaauacagugaacaucacauaccuaucauuuagauuauauaauucauuauauuuccuuuaucacauaauuaucuauuugacccucuaaccaucaauucaucuuaguuuuugauacauuucaaaauaaguuguaagcauccauauacuucagaguggguacccuuuuaaaaaagcuuacauauaaaaauguaaacacguggcaugagaagaauguaauuauuuaauguuagaaucucuuguuuuuuuaaaggcauuugacacaucauacauuuaagacacauuaaguguauggcacacaguacauuuaaaauaauuuuguuuaaaaaaccugcacacgcaacuuaaguacucuuauuuuucaucucugauuggguuuggugaaaacuugaaaaguauguccucagaugacaucaggaaaagcaagauuuaauuccuuuaaaaacaugcuguguucuuuuagugcauggauucauugacuaguacaauuuaucuaauucaacuaaggcacuuuguccauggcuuguuuugaagaacagguuuucuaaucuauuuggaaaagaguguuuguagagauaacuuggagcuuauuuaucugguucuccaaaaaucagucuaagccaauuaggaguuggucauaaaaucacugaaaauaucauaagaacugggugagugggauguggccacuguuuuccacacucccgguaccaugacccucuuucccucaguguuuucuuacuugccauuccauauccuaacaauaaugcucgaagaccaaugggacauaaacauauuuauaauucauagaaaacuguuccagcuguuucuuaucccuuacaauuaauauucaaaacaauuucuaauuacuuaaguuuuucuuauuucuuguguuucuuaacuaccuuaagcacucaggaauugcuaaugaauuauggaguauaaaaucauaaacuuaaguccucugcauucaugauggugagaccaauucaucuuuguuuuuguuuuugcuuauuuauuuuguuuuugucucuuagcagucuucuucccuguacagugacccucuggcaacauauaagagugacaggguuaguacuuucugaggaauguucugccuuuagagcuaccaguugcuuuuuuugggguuuaauaauacacuuuuuucuuaggccucuccuacugcaaauucuggucugcugagaagugccagucugguuuguauuuuccucuuccagugugugcagugcugguggggucaaugucauggugcuaacucuauggcuugacagcuuuucuccaaaauaguuaaggacacaugauuuuagugucauguauacugcagaaugugcugccugugcuuaaaauauacaacuuuaggguauuaaaaaugaacauauuccuuucacagagggcuguugguagcccuugcuuagaaucaguuuuuuuuuaucuagagaagauagauuugcuugaguccuaccacacucacauacuuuugugagauggcugcuuauggaaaggauauuguuuuucuuugggacaguuaugaucuuggccucugauacuaggaucuaauaaagcaagcugacuagaaaaguaaaagcaguagcucuguguaaugugugagcugugaauuuguugcuuucaagcuguuuguuguguuguggccuguucuaguggacugggauccugagguuuuauaacuuaauuuuauuguaguaguaggcaaaaugcucuuuguaccucaguuuccuuuccugcucuguuuccucuuuugagaagauaaauguguacacguuaauucucccaguuucauaacaugauggugaaagaaaauacuguaaccagggguguuuuuuaaaaaaugaagugcaagguugauagcaauuuuugcauauaaaugaguauuaccgccuucaggguuuucauucugggaggcuauacacuuauaucauucuccaaaacuuuuuugguacugaguauugugaaaacauuaagucauuuucaaaacaaccuugaagcuaaauagcuaagugauauuuccuuuguuccuuaggcaucauuguacaaugguggauuauauaacccuuaugguccucgaacuguaagucuaaauaggggaagguggugaagaggagggaaaugugggugggcacaguuuacuuucaaagaaaaagucaaaaauuaauaaaaaagaaaaauauacaaagaaaaagucauuuaaucugaccuggaauuacucucuaagcugugaucaagucauugagcuagccaguugugacucucacccaagcugugauaaaaugccugcuggaaaucaugauuucaaguauuagggaaaugcauagaaaaaccacuuuucuuguucauuaguuccuccugaagaaguucugagcagcacuucucagggcauccccuuccucuucgcucccucuagccaagggcugguggaucuugaggguggggaugagguagaguucuacaccacugaauaacaguuaccuuuaucuugagaaccaggggcaaguuagguaaauggucccuaauguauucucauuagaauaaugaggugaucauuguuguaaaaccuuucuucuuggaaacuuuauagccaucugaaugcaguuauuauucaucaagaauaaguucagcccgaagcaguccaggggugagcugucuagucucugcaugcuuuguagaaauuuuugauuguugcguuaaucuguacucacuguuuagaauauugaggauauggugugauucacuuuguugugcauggauuagguguucccuuaguacauaaacucaagcacuaauuuguccuaauaauuggugauuucucuauaaaugugacuuagcauguaauuucuuaaaugagucucuaaccagugccauuagaauuuuuaaaguuuuuauauuuaauuuucauuuguguagaacuucuugucuuucaguggugauaauucauuguauagguugacuauccuguguuucuccuuucuaucuuuacauucugcacauugagccauuucaccugcuugccagcgcuucuaucagugcagugaaaggagaagaaauaaaacaagcugauuaaaaaaaauuguuauacgaaagacaaaacugggacaauuauaauuaccuaaucuuucuagaguauuuuuaaaaguuuauaaaaauaauauuaguuaaggaaaauucaaaguaaaauuccccauuuuccuuccccaaauguaaucucuguucuucaauaaccuuucagagauauuuuaugcacguaugagugcucuuuauuuugagugcaaaugggucauauuacauacugcuccucaauauauuuucuuuauuuaaaguagcuuucuguaucagcaccuauaaauuuauuucauucuuucuuuuuuugauaaaaauuuuaaacaaguaagcugugucccuuaguuuuuccacuucaugucucuuagagguaguuucauauuagcacauucuuuuuaauggcaauauauucuguuagugcguaaguauacauuuuaaaagucauuuccuguccgggcaugguggcucacgccuguaaucccagcacuuugggaggccgagggcacauuaccugagaucgggaguuugagacuagccugaccgacauggugaaaccccaccucuacuaaaaauacacaauuagccuggcgugguggcacaugccuguaaucccagcuacucgggaggcugaggcaggagaauugcuugaacccgggagguggaggcugcggugagccaagaucacgccauugcacuccagccugggcaacaagagcaaaacuccaucucaaaaaaaaaaaaaaauagucauuucccugugauggacauuagauugucauauuuuugcuacuauagacacuuauacaaugaccauucuuauccaaguauauuuuuguguacuuacauggguaaaucugcaagguaaauugugaaucaugaaacuugugaccucaggugguccacccaccucaaacuugugaccucaggugguccacccaccucggccucccaaagugcugggauuacaggcgugaaccacugugccuggccuaauuuuaauuuuuauuuagagaggguagcuuucuauguggccccugcuagauuugaacucuugggcucaaguaauccuccugccucagccuccugaguagcugggacugcagguguguauuacuguacccagcuuauauuuucagucaaauguaggaucuuguccuuauaggcuggcuagaucguauuucauuugcagguugggguuagaauaacuauuuuagugaugccagaaugguuucuuagugauguuagaauggagauaaacuacacauaucgaagaugagucuuuggcugguaaagcaagaagaugacagagccauguagggugauguuagcaacaucuccacuagcugcauaggaaugaauaaaggaaauaagaaccaucacuucguuguccuuguuguaggaauuucugucauugacuuacauuguuuugcuuuaaaauauucuuuuauuuucucucucaaacaaaaacauuaaguauauuuguugaccccugaugggaucccaaagggcccagagguuuaaaaaguaugaaaucccuagcugguuuugguuggcuuacuuaugcaccuccccuucuuuaauuuuuugagguggugucuugcucugccacccagacuggagugcaauggcacgaucuuggcucacugcaaccuccgccuccuggguuccagcaauucuccugccucggccucccgaguagcugguauuacaggcacccgccaccauacccggcuaauuuuuguauuuuuaguagagacgggguuucaccauguuggucagguucaucuugaacuccugaccucaagcaauccacccaccuuggccucccaaagugcugggauuacaggcaugagccaccgcuccuggcuuucuuuaauguaacuuaaauaaaauauaagguuuuacuuuauuugugcuuuuuggaaaugucuccugauuuuuaauaacaguuuauuaugccuuguaccagcuuuuuuauuaauauauaaggugcccacuauauuauaccaauuaugcugcuuauauaguuauucauaugcaucucaaaaccuuccuuaauguacuuauaaugagguaacaccauagcaaaauugcaucuuuuucauuaucugcauuuaauaucuauaguuuaccaacgaugacacugcaagcauugugucuucugaucgugccagucguggacgaagggagaguguggugagcaugauuugcaugcaaagaaauaagaugaguuuuaaaugacagcaaugcaugaucacaugaagucuguuggaaagugaaguuugcauuugacaaaaagagcauuuuccucaaauuuaguuauauaaauauuuugccuuauaaaacauguugagaacacauauucucugugggcugugcaagcuuucauuaauaauuugccuuuuuacaucucuuaggagugaaucauuauuugaaaaguuuuuacuuuuucuucuuuguugcuguuuuaugcacauacaugugugugcaguucaccaaagacaaauuucuucagcaaaauuaauguuuccauauuguauaaaacucauaacuauggauuacaaaucauguuaccauuaauugcuuucuauauuguuguauuuagauuuaaccaguguuuauccaccuguuaagaccuguaauccagucaggguggcucaugccuauaaucccagcuacuugggagacugaggugggaggauugcuugagcccaggaguuugaggcugcagugagcuaugauugcaucacugcacuccaguguggguagcaaagugagacugugccucucaaaagaaaaaaaaaaaaagacuugugaacuuaagaauugcuaaugacaaaauuuaaaaauucuagucuuagacauucaauuggauaauaauuguagaggcaacaaauagcuauguuagaauacaaauaauauaauuucagguuauucuuuaaugaagcuuuaaauuuuacagaaaacugaugacauuuuuguuauauuuaagaaauugauuuggaaaauacauuguuccggaugguaugucagcuuagagcuagaauaaagagcauaagaggcuguaauuccuuuaagaaaaauaggccauuuaacaugaguuaugugaaagauuauaaacccgaguuuucauagagaaggggaacauuaaauguuggagagauuuguuaccauacauucauuuauuuaauuaaagccguuuuaguuccuuagcaaagcaacuaaugcucacgcucacaacugaaggagaaauaauaugccacaacaccuaaaaacaccuuggaacgcaguggaguggaaagggcagggacuuuaaauaaugaugcuugggcuuguauccacuucuacuaccuguuaguguguaaauggcagugucuuuauuuguacauuggggauguuaauacuaucuuuguagguagguuuaauauauggauuaaauggaauacuauauagaaaaugccuaucaaaauucucaaauaggugccaauaaauauuaauaucuauaaaugcaaucauuauuauuauuauugugaauaaaaauaccauugcuugauuuuaucaguccuuagcaaaacuucauacuuguaagccuguuuuaucucuguggaugggcuucugaauucccuuccuugagaaguauuuuaaagcaaggcaaacagucagcugaaguaaggaauagaugaugaaugagguuaaaaaaaaaucacuuauuuuaaaauuaaauaaauguuuguggaguaccuguuguauucaaagcccuguguuaagugcuaggaauacuauuuuaagccagucagacuagauuucugacuuuauggaauuuauauccucgugaaagagauggaaaauaagcuaguaaagaaacaaaaagaaagaaaugucagggacugugaagagaacagauaaugugauagggaaccuggaggggucuauguguguggguuacccuuuggauggggugauuagagaugcuucucugagaaacugaccuuugagcugagaccugaaaugugaggagccaguugcuugaagagcugggaggggagcguucuaggccagugccaaggccuaaggugagggagaacugguguguuuggggaacuaaaaagaggccgguauaguuuauuuccuucauuauuuugucuuacauuuccuggucuuugggaauauaaaaaaaggggaacuguguaaacugagaaaaggugcaguaaacacccugcaaauaauucugcauucagcauauauauucuuaacagaguugauagcuauaaugaauuauaaauuuugagaauuauaguagagguauauacugaccuagaaaugccucuguucagggugauaaauaucuuaaacaugagagauuugcugguccucaggaaguaaauguucucuguagcauaggacucuaguuaagaugaguaaaaaagcugauuguagagcugugauuucauuuaggaaccccuuuucuuuuuuauuuuuuugaguagguuaauugcagcaguuuccucauuuuauuucuugguacuuuaucacccaucaaaauuuuaaaaaacuuuucccuaauuggccaauguucuuauuuuuuucuuucuuuuuucuuaaccuugaaagcaucuuguuuuuuuucugaccgaaagguaucugccgcugauuauuucagucgcuccaaucguaggggaaguguugucucugagguggaugauaucaguaucccagauuuguccagcgugaguguauugcauggggugguugguuauguugucccaggcuugugacuaacagcuaauauguuagcuauuuuauaauaaaagugggaacuugauuuauugucuuaagaaauauuuguuugggccgggcaugguggcucacacuuguaaucccagcacuuugagagaccagaacaggcagaucaccugaggucaggaguucgagaccagccuggccaacguggugaaacucugucucuauuaaaaauacaaaaaaaauuagcugggugugggggcgcacaccuguaaucccagcuacucuggaggcugaggcaggaauaucgcuugaaccuaggagguggagguugcagugagccgagaccacaccacugcacuguauccugggcaacagagugagacuccaucucaaaaaaaaaaaaaaaaaagaauuguuugaacauguuaaaaucaaacacauuugcucuguuuuggaauguauuuauuaauauguucuuuuuuaaaaaaaaacuuuuucccccucuguggaaaaaucuccgcauagaacccaucagcaucugcaacaauuaucaauauuuugccaauuuuguuucauugauuucuucccccuucccuccuuuuuuucccugaguuauucuaaagcaaaucccaugucaugucauuucccaauaaauaguucaauauguaucuguaacugaacauuuuuucagaucucuuauaucauuaucaucacuaaugaaauaaguaauuccuuaguaucaucuaauaccuagcccuuauucagacauuccuuauugguuaaaaaaaguauuuuccuuuuugauuuuagugaaucuauaaagugauagguagacuuagaaaguugaauaaugaaauauagcacuuaguaaagugucacuaauuuguacuaaccaggaacaaucugaauauauuuuaaauauuuggauuauggcauuguucugaagaagugugccuauccauugcucccacauucaucaggaacugaauuuaggaaaggauuguccuuggggcauuugucuuaaugaaugaacuccagccaacaacuuaggaucuaccugcucaucucaaaauaacagccugauuaucucucugacgcuucuccucucuugcuggcauuaguguuguuuugcccauggaccaaggcuauacugauuguacugauugucaagcacuuuggagggggugagagguggcauuuuucuuucuuucuucuucuucuucuuuuuuuuuuuuuuuucuuggugacaggguugagaccuaucguccaggucggagugcagcagugcgaucacagcucacugcaacuucaaccuccugggcucaagugauccucccaccucaaccucccaaguagcugggacuacaagcgugugucaucacgcccagcuaauuuuuguauuuuuuguagagcuaggguuuugcugucuuguccaggcuggucucgaauuccugaccucaaucaaucuaccugccucagccucccaaaguguugggauuacaggcaugagccaucacuucuggccaacauuucuuucuuuuuuuuuuuuuugagacggagucucacucugucaccuaggcuggcaugcaguggcacgaucuuggcuuacugcaacccccacccuccgaguucaagugauucuccugccucagccucccgaguagcugggauuacaggcgucugccaccacgccuggcuaauuuuuuuuauuuuuaguagagacgggguuucaccaucuuggccagguuggucuugaacuccugaccucaugguccacccaccucagccucccaaagugcugagauuacauacaugagccaccgcgcccagccaacauuucuuaauagaaacguuagacaguaguuuuaaaugaagaaauaauuauuuauaauuagcauuucacugaucguauuuaaauaacuauuucugaacuguuuuaauucuagaagauaauuuuaugugugguucuuaagcauuccagaucauugguucucaaaucuggcuaugcaacaguaucaucuuggugugggucuaaucaauaacucucucugcauacaaaguuagaagacugguuuccaagucauuccccugaaauauugcccuuuauauuaaauugccuagcaauccccguuuuucccccauaaguauggacaauuaaacuuacuguuuacaucuguucucuuaaaaacugaauucugucagccucuuaauuuauaauaucugaauuaauaguuaugucuuccuuauauuuauuuugugaugauuuacuuuaguacuuacauauaagugaaagugcugacaguuuaaaaaaucucccccugccccuacuaguuaacuguaacucuuuaacauaaggaaaaaguucucuagaacagggauuuacaaaucuggcuaaccccuguuauuuuauagucugcaagcuacugguuuauuuauauguauuuguguauacacacacagacacacacauguguauacauauauguauguauauguauauauacauacacauguauguauguauguauacauguauguauguauguguauauauauacgcauacauacauauauuuuuuuaaagagacagggucucgcucugucucgcaggcuggagugcuguggagccaucauagcucacugcagccucaaacucuugggcucaacugaucuuccugccucagucucucaaagcgcugggauuacaggugauuuguguauuuuuaaaugguuacauaucaguaccuuauccuuaauuuugccuccuggaaaagccuacaguauuuucugggccucucucuggagcaaauaacuuucucuaguaguauuucuuuuuaaggguaugcuguaguccaacucaucuuguagaggaauacaaaggggacuugauguugauagaccucccuccccucccacuuucaaaaaacggugaccuggaaauauuucaacaugaaauauuaugauuuuuaaaugcuggcaacgaauucagaauuuuaaaagacauuuucugguuaccucguuguguacuaaauauguuuguaggcuaauaguuuauaacuucugagcuaggaggugcugagaaagggugccaggucauguuucugcaagccuauauaauauuuuuggggguucuagccucuuauuuucuucuacauuggcuuuauuucuguuuuguaagucaggcuacaauaaagcaaacaaauguaaauguuuuuuaagcaaaacugaaauuuugcugauuguuaauaauuaaacccauuucuaaauggaauccuuagccaguuuugcuuuaggaaauuguuaaaauugauugaugucuucccuucugugguuguggaaaucagauauuuuuucaaacaauuuuugaguagcauuaucaaguuaguauauauauaaauuagaaauuaacaaaagaucaagauccaaugacugcauugaagaaacuacacuguaaauacuuuauuaaacuacaguuuuacagcuuaauauauuaaauaugauuaaauuuuauucuguuuaaaaagcuuuuuucuggaucuggcagacucuggaucaucauuaugaacauuagcuuguuauugcauugcagccauguagaacucuuggcuguuggauccuauugggcuuuuagaauaccaaguuucagcuagguuuuugucuaaauggaagauagcacacaagauaguacaagucuaagaagugagaacuugccaaguuaguguagccaaaauaagagaacuauggcaugguugcuuuggguaauuuuugcuggcuugacaaucuccgagguuuggugcaugaucaguuuggguugcgacaauugggaucucucagaagauggugaaagcaauagagucaacauugugauggauuaguucagugaugcaaccucugaaauauaagauuauuccauggacagucuauuaaaaacuggaugauuuuggaggucauuuuugugagaaguggguaugaggaaggauuucaaauaagcuuagaagacuuuuaauuuugaaugcugugugcuuuucucuuuaacacauuagcagaaaagaguuggaaaauacucaggaagauaaggcaguuuauucaaauauaauauuucuuucaucuugaagaauaauacauuaaauauugggcaaugcaguauagauguguaaaaggauuauuccuuuuuauggcaauaauuggcaauauaguauuuaaaaacaaauuucaggccaggcaugguggcucaugccuguaaucccagcacuuugggaggcugaggugggcggaucacuugaggucaggaguucgagaccagccuggccaacauguugaaaccccaucucuucuaaaaauacaaaaaaaaauuagccgggcgugauggcgggugccuguaaucccaguuacuuaggaggcugaggcaaggagacuagcuugaaccugggaggcagagggugcagugagccaagaucgcaccauugcacuccagccugggugacagagugagacccugucucaaaaaaaagaaaaaaaagaaaaaaaauuaaaguuaaaaaaagcagcauggcacauguauacauauguaacaaaccugcacguuguacacauguacccuagaacuuaaaguauaguaaaaaaaaaaacauuucaaucgcugucauuaccugcuuugaaacauuuauauguuguuuuaaaaauuaaaaugaacuaaaauuaguuucuuuuucagaguuuuuacagcaagaaguaacaaagaguuaaaugucuaaaaauaguguuuauauuacugauguaauacuaucaucauaauaaagaauauuuauaaacauaaguguggguaauaaaaagaacacuaaaaacuuucagauauguggaaguuagggugaaguguucugaguagagccagaaaugauguuucauguuuuaauaauuaacugagaagguuuucagaucucuucucuagauugggucuagaagguuuguguaggaguuggaguuauuuucauuuaguuacaucccuaugugccuuuuuucuccuggugauaauuggaauaacauauauauucagguaaacaauaugaacacugaauugaaaauuuacaaaacuaaggguuggauucagcucugcaaccuucagcaaaaucugucaccucugaauuucuuuuuccuuagcuauaaaacucaggguuuggacuagacuuuuaagguaccucccuucuugaaauacugucugaaacaaccuuaaggccuaucuacagaagauagguuaauuuaauuguggcaaguugagauaacaggcuacuaugaagcuguuuaaaauaaaugagggaagucuauuaguauagaugggguaugauuuauucauucauccaacaaauuuugagcccuucucuaugccagacacuauucuugauacuaggaguacagaaaagaacauacugauauagagcuuacauuauagaaagagagcagacaauaaauaaauggauaaauaccguagugucagggagugauaaaugcuaugaagaaagaugaaguaauuucucaaaucucugagacuugguaaggggaaaaagaagauguagaacauauaugggacacuuacuagaauuuuuuuaaagacuuugugguugguugcuauuagagacugguggucaggguauggcaugguagggagagagcccuacucauacucuuuugugcuguuugauuuuuuuuuuuuuuuuggucaugugcauguauuacugagaaaacaaaaaauccuugaugugggggaaaauauuuuggugacauauuuaacaugcuuuaaucuaaucugaacuuuuuuggcugaguguacuagucuuuaucuguguguccuguguccuaauaauguuuagaaauaaaaguuuuucgcuuuugguuuuaucagacuuuucuuuuugauauguacaagcuuuuuuuguauuaacauuugcagugcuaaaacuuuauauguagccuucuuuaauguguuuuaaauaccuuaaacagaaaauuuacccaaaaguucuaaacuuuugaguaaacauagauugcuuacucagugucucccuuaggauaaaaauuaaaguugcugacauuuuaucuuauguuaaacuggaauuuuaauuucauuuuuaauauguuuauuuuuaggcuucaaacaucauugaacuuggaaaacucaagaucacuuuuuuccucccaaaaaaagucaacuugcuaagcaucuuuacugauuuuuaucuuuguucuuuucuaguuggaugaaaaaucugacaaacaguaugcugaaaauuauacaagagugaguauguaaauuccuaagggaaauucucaaggucaauuaaacuugcuaucuguaacuuguucauuauuuauuuuacaacaauuggucugauguagcugcucuuccucccuucaucuauuuccuguccuugacccuccaaaauuccuucggaguuaaaucaugugaggcccugggaagagaagaggcacugcauuuuauuuccuugaaugucaccucuuuagcuuuuggcugcucuuuugauuuucauuccucuagaaauugauccugagaagaagccaguaaacacugaaaaugaaguuucuuuaggaaugguggugacaaacucugagauauuuuuuccuuuuauauauauaaauuguuucuugaaguaaaauaacuccuuucuagaauuugcuuuguguuaaagucucuuucuucugaaaguauuauuagaaagucagggagaugauuuaucaagauuaauuuuaugcuauacccaagaaagauaaauuaacucuguccaguagaaauguaaugcgagccacaaaugcgaacuuauauguaaguuuaaauuuucugguagccacauuuaaaaaguaaaaagcagguaaaauuaauuuaggugauauauuuuauuuaauccaaauauccaaacuauuucaacauauaaccaauauaaaauuacuaggccagacuagguagcucaugccuguaaucccaacacuuugggaggccaaggcagguggaucacuugaggucaggaguucgagaccagucugaccaacacgguaaaacccugucucugcuaaaaaugcaaaaaaaauauuagccagucaugguuuugcgugccuguugucccagcuacuccucagucugggaggcugaggcauuaaaauugccugaacccaggagguagagguugcagugagccaagauugugccacugcacuccagccugggcaacagcgagacuccaccucaaaaaaaauaauaaaaauaauaaauauaaaauuauuaaugagauauauuucauucuuuuuucuacacuaagccuucaaaaucugguauguauccuauaugcaacucucaauuuggacuaaccacauuucaagugcucaguagcugcauguggcuaaucgcaaguauauuggacagcacagauucaugcaguuuauuaaucaauagcauaaucucacguuuaaaugaauuuugggaagaacagucuacauucauagugauauccaguguugcuacucucugcugcaaauaguaucuucaccuuuaucaacucaacagaguauuagagaaagaagagauugauaagcaguucagaaauuaaaaaggggaagugcugauuagcauaucaguuauaaaauucuaaaacugcuuuaaguuaaucugaugugcucacuuaaguauuguuuacaggauagcaaagauaaacuuagaaaauaacccucauaaaaacgauuuucuuuuugguuauuacgaauuauagauuuugauaagguauuugugucaugaaauuuugcuuaguaugcuugggcccuucucuguauaccuggauaccugcaaagccaaucuaaauugaccauugauuacacaugguaacuucuucaucugaaacccacaucuucccccaaccacccugcccuguuuuuaguuuccacagcaaacauauuuuuaaagaaaugagacuuagaagggucauauuucucuuucuagccuucaucucgaaauucugccucagcaacaaccccucuaaguggaaacucauccagacgaggaaguggggacaccagcagcuuaauagauccagacacuucauuaagugaauugcggguaaacugaaguuuuugguuuucuuuuuaaaagcaguuuuuugacuugguaauauacuggaacuuuuaaccuuuaaugugacuuaguagaaagaaggaauaugauuucuuuuuaaaaaauaaguacuguacaaaagugugacucaaguguuucagagcuugaaaggaaggagauuagauaguucuuuuuucuguccucuuuccuguaaauuuaaugguguuggaauuucugcuaauuuacaaaugccaaaaaaaacccacuuuguaauguauguaaaaguaauucucucagaaacaacuggccauguuuuaaauggaaaauaugugaguguacaaagaacuagauugugggaauuauuagucuuuugagccuugaugguauucagcugcuugaauauaguuaucucucaguuuuucauaguaauagaaguguaauaauauuuggguaacagaaauaccugagauaaugaaaagcuuauuugacucauuaagucuccauccuuauuaaccccuuuacuuggaaaaagagaacuuuaaaaaauauauauuuuauuugcugaaccugcuguuugugaggcaggggauagugagagaaauugcauacauuuguucauucaagauuuauugagcacuuggccuuggagauuuaagaggcaaaauauguucuggccuucaggauuucccuuuuucauagggaagacaaacugauacaaaccaauaaaaccaggugguguuauacaaugguaguagcaagaauggggcuguuaagguaauucaagaaagcaucauuuaaauuggacuaggagaagagguaacaaaaggcuuuucagaaaagacaaacucugagcuaaaguuugaaggaaaaauaaaaauuaaccaaggaaaguaauugaagggggaaggcuuccucaaagagaugcauucagacaacccagaaagcuaccuguauagcaaaguugccagaggguggcaugagaagugaagaauaguagcguguaagagagaaggcuggaaaaguagugaggggccaaaucacaaagcaucuuguaugcuagccugaaaggaauucaguuuuacccugacaacugugggauauuaaauaggagagcaauacuaucugcuuugcauucuuaaaaaauaacuuugaucacagucagaggaagcauugcaggccagaaguucaguaacccugugguucaacagugaggaugaggugagcaagucaaaacugcaaggggagaaaauaugagaaacuugcucuggagugaauacgagagacugggaauugguugggcaauugguagggagagagaaauuuaagaaaagguuuuuagcuuucuuuuaaaggugagagugauuauuauuuucuuugguuggguugaaccaguagagagaggaggaagguugaggaaggagagagggguaacugacagaucaaaauaccugcgugggugagaggagaguccaggacucagauggaugagcuugccuggacuggagguccccucuucacuggaggggagguagaggacaggcggugacuaagauuguagguaggggcuagucugagugcaguaauguuuacaaguaauugaucacaagcgguuacagauuuauuuguuccuucuccaccuucauugcuucacuugacuagccuuaaaaaaaaauuugucacccauguaaucccaggacuuugggaggccaaggcagguggaucacgaggucaggaguuugagaccagccuggccaacauagugaaaccccgucucuacuaaaaauacaaaaaauuagcugggcauggugguagccaccuguaaucacagcuacuugggaggcugaggcaggagaauugcuugaacccgggaggcagagguugcagugagccgagaucgugccucugcacuccagccugggcaacagugcgagaauccaucucaaaaaaaaaaauaaauugucgguaggguuggaaaaggagucuuacuugugaaaauggguugggggguuaggggaggauagagaggcuugcaacagcggcagagaaggagagcaccuaggccagcauggccauugguuugaaggugacaguauuaauugagcucuuaccagcucuuacuauguaccagacauaaaugccaggguggaaaguugaauaagauaaacucuugccuuuagcuacugcauucuaaugggacaaaaggauaugagaggacaaggccuuccagccuuagacuuagcuuucuuuugucauacuacuuguugcuuguuuuuucuuccuugagagaaugaccuucuugaaggaaguguuauuuuuguauccuaccaucugccuccuaaauagguccuucauaaauguguauugaaugaaucgauaaguaaaagacagucaaaccuacuggagaggcaaugaaggaggcagggaaaauauaauaccaaaaauguguauaaucagccuuuaauaauugauccugcuuguaauugcagaauuguauuuagggcccugugcaguuauuucggacauaaaucgagcauucagaauagaccuuauauaacaaggucagacacagggaaacaguauuuuccauuuaaaauuugaccuguuucacuuuucuuauaaggauuauaguaacauuuggagcaagugcuuuucucaucauuuaaaugguauccucaggauagaauaucucauuugacauucuguucaaaauguuuaacuucccucccuuuacucccuuucucucaaguuaauuguggccaguaaccaagucauugaaagaaaacuuuguucauauucauuuauuauauuuuuaaaaaacuuuugcaugaaucauuaaaauuugccaccucuuauuaauuuacuguauauuuuacuaguucuaggugaagcauugugcuaaaaaaauuuuaagugauuuauaaaauauuaaaaguuguaugauuuuaaauauuauaauuuauauagcuuuuuccuccauauauagcccuguccccauuugcuacacuguuauuaacagaauuuaaugccaagaaaauauuuaacauuagauugauuacucuagaccuucccccagucccacuauccccugaccuauuugcccuuuucagugguugggagugggaguuauguuuuuguacuuugauuucucugcuuuuagucuggaauauacaaaagugagucacauuucaucugaauccuuugcgauuuaagauacguuugugcaugguuuuaugcaaugguucauuccuauguccugcaggauaucuaugaccuuaaggaccagauacaggauguagaagggagauacaugcaggggcuuaaagaacuaaagguaucagggcccauucugcagcccaagcaugcucuguaugcagaaguguuggcaaugguggcuuugcaaguucuguuaaccaacugcacauagcuuuacuaacaguguuugucuuucaagcaugugcuuaaccugcagugcauaggaauggugaacuuucaaucucugcuuauguuuaaauguguaguacaguuuuugaauauuccgcagaagauaucauuuacaguuuuuuuuuuuucuuuuuuauuuuucuuguacagacaggaucuuacuguguugcccaggcuggucucaaauuccugggcucaagccauccuccugccuuggccucucaaagugcugggauuacaggcaugagccaccucgcccagccuccuuuacaguuuuaaaaccuuguaaaauacaugcauauccguggugucuuagccauacaaaauuaaauuggucaaacaccuaaaaaaauacuaagaauauuuuuauugagaauuagaccucaaaauuucuuccacgcuaaaugaaaaaguguugcauauuucuguuaccaaacucagucaguauuaaaugugagaggaaguagcaacugagacaccauuauuauaaauauccccccuggaggaaggaacaugaaggcaugaggccuauauuuucuuuuggcuuggauuuuuuuaaccuauaggucaaaaaagaugacacagaucuagugccuuaaagaauuuggagguaaauguaaauggucuuuaucuuuucccagaaaggaucacugacauuuuucaauauaaaugugugaggcagacaguuugguuguacauagcauuugguuaucaugcucuucuuuuccucacaugucauucugaaguucaagccuccuguuaugaagaaaccagaaguuuauuugaacacauguauguccugauuugaaaucaaaauacacacuacagggcaggcacaguggcucaugccuguaaucccagcacuuugggaggccgaggugggcggaugaccugaggucaggaguuugagaccagccuggcuaacauggugaaacccugucucuacuaaaaauacaaaaaauucaccaggcaugguggcaggcgccuguaauccaagcuacuugggaggcugaggcaggagaauugcuugaaccuggaagguggagguugcagugagcugagauggugccauuucacuccagccugggugacggagcgagacucugucucaaaacaaacaaacaaacaaacaaacaaaaaaaguaaaauacacacuacaccucuaaaaaagcaaaaagcaagacauuuagaagggugacucaggauauauccaaaggacaaagcauagauuucaugggcaaggguuuugucaucuucccuggcaugauuugaaguagcgccacuaucagccaaacucuucaugcaagugauaugguccaugagaaacagaguaagacucaggacccaaaaaggugagaaguccaaugggaagugcccaugagggaagccugcaaguugcugauagggcagcaugaguuugucaguaaauaucagaagaauuacggaaauaguugauguucucauuuaaucuuacuccuuuaaucuucaggauuuaaucucucuuuuaagguuuuagagauacgacuuuugaaauuaucuuggaucaaacaaaucgguacauuaaauaaauauauuaaagucacauguguaacaguguaucaggaaagcaaucaugugauucaggggcauucuuacuggcauuuuauuuaaaacguuuuuuccuuucauguuagaucuaccauuuauugcauucuuugaagaauacaaaagaacagauuagauuugagauuugaacagaugagaucccuuguccuaauucaugccagaauauaauugaacuugacuucagauuacguuuauccuugacacuugaaguggaaaaaaacccauaaaaauaaagaaaagauugucugauuggugaccaagcauggugguaugauguauccuauugaaaaaggauguuggcucauugcuugugacauuacuguuauuauguuugccuuugggaugcucucaaccacucuccccuccauccuuuuaucaggaaaguuuauuauuacuaauacagcauuugcccaugcuguacuaguauauauguguauauauguguauauauauucauguguacuauuacccagaaaaugcaguaaaauauuaauuguaaaauuuaggugaucuauuucaugaaagauuaacgauuuuguaagucaaaggacuaaacccauuaacccauuuuaaaaacuauuaaaauuaauacuuuauuaaauuuaaguacagaguuauagcaauaaauaacaauaguaaaucuauagugacugaaaacuuuccaagauguauugaaaaaaggcaagcuauagaacaaaauguagaguauauaauuuguauuaaaaauauauaugaagucaaggguauauauuuuauacuguaaacaaauaggaaauggccugaaagauaaucuaccaaaccaauagcacuugugccucuggagggcgcguggucaaggaagacuuuugcuuuaucuguauuauuuauuuuuaccuccaaugaaaaucuuauguuuuacuuagguacuuuuuuuaaaauuaaaauuuuauuuuuuuauuuaaaauuuuuuuuuagagacaaggucucuugcucugucacucaagcuggaguguagugacacaaucguagcucauugccaccuugaacuccuggacucaagcgauccuaagccugcugggacuauaggggugcaccaccaugccuggcugauguuuuaauuuuuuauagauacggagucuugcuaugcugcccaggauggucuugaacuccugggcucaagcaguucucccgcuuggccucucaaagcauugggaugacagacauuagccaccaugcuugaccccuucgcuuuuuuuuuuuuuuaaaugcagucucaccauguugcucaggcucaucuacaacuccugggcucaagcaauccucccaccucugccucccaaagugcugggauuacaggugugagccaccaugccuggccaauguucuuuuuaaauauugcccaugccuuuaauucuuagaaggacaguaagaauaaggagagaaauagcuuuaacuucaguaaucccagaaagaacugucaagaguuaauagacuguagggguaagucuugccaucagcuguaaauugacugauguaugaagugacugagaauaaaacaaugaagguaucaugucccugaauucagauagcucacaaucugguugacaauuuuggucauaggguugugaaggcuuguucuagaaguauaugggcauagguaaucaaugcuuaaacauuaacacaguggcuucagcacuuuggugugugucauaaucaccuggagcuuuuaauaaauacagauugcuagacuuuacccucagauuuucuauucauugggucugggauggcauuggaaauuugcauuuuuacccaguucccaggagaugcuguugcugcugaucuggaacccacacuuugaaaaucggugacuuagaagcauucaaggcugggcacgguggcuuacgccuauaaucacagcacuauggggaggcugagguggguggaucaccugaggucaggaggucaagaccagccuggccaacauggugaaacccuguuucuacuaaaaauacaaaaacuagccaggcaugguggcgggagccuauaaucccaacuucucaggaggcugaggcaggagaaucacuugaacccgggaggcugagguugcagugagcugagauugugccauugcacuccagguugggugacacagugagacuccgucucaaaaaaaaaaaaaagaagcauuuaaguaaaaccaauuccaaauggguaucacuaugugagugagauuaagaucacuaaaauaccugacacuucuguuuaaaacagucuuuuguggucuaguguuuaaaggaagauuacauuggauacauuuaugucuuauuuauuguauuauauauuuugugcaugcaucuaguacuugagcuaucuuaaauucugguguucaugugguuuuauauggcacugaguugugaugacuuuuuuccugcuauuagccucucagauggaugagaauuauuuaaagucugcaguauaguaagauacauuuagauacauuuagagcacuguauaauugacuuugcuuauauucuuuguuuugguuaaauuuguuucuaaucguaguuuaaaucuucccugacaacuuaauucugguuuaugaagcauuauuaaaaguguguguggccaggcguggugacucauaccuucaauccaguuuuggaggccaagguggguggaucacuugagcccaggaguuugagaucaacccgggcaacauggugaaaccuugucucuacaaaaaauuagccaggugugguaguacgugccuguggucccaguuacucgggaggcugacaugggaggaucaccugagucuggggaggucgaagcugcaguuagcugagauugugccacaguggucuagccugggugacagagugagacccugucuccaagaaaaaaaaaaaaaaguguguguauguauguauguauuuuuauuuagauauaauucacauuccauaagaauuuacccauuuaaaauauauaauucaguaguuuuuagcauacucacagaguugugcaacuagcaccacaacccaucuuuagaacauuuucaucagccagaaaagaaaccccaaucacuaacuuucugucucuguagauucgccuauucuggagauuuuauacaaauggaaucauacaauauguggucuuuugugauuggcuuucauuuagcauaauauauucaauauucacccaugucauguuaucugucagucuuuuuuuaauggcuagauaguauucuacuguauggauuugcugcauuuuguuaauccauuugucaguugauaggcauuuggguuguuuauacuuuucugucuauuaugaauaaugcugcugugaacauuugugugcaaguuuuuguguagacauaucuuuucaauucucuuugguagauugcuaggaauagaauugcuggcucaugugguaacacuauauuuaacauuuugaggaauugucaaacuguuuuccaaaguagcugcaccauuuuauguuccuaccagcaauauaugggaaauguaguuucuccacauccuuacuaacacuugucuucuguauuuuugauuauagauuauagccauccuagugaguguggugguaucuuauugugguuucgaugugcauuuuccuaaugacuaaugauguugagcguguuuucaugugcuuauuugccauuugcauauccucuuuggagaaauauccagguccuugcccauuuuuaaauugauuuguguguccuuuauuguugaguuguaagaguuguuuauauauuauucugcauauaagucccuuaucagauauaagauuuauaaauauuuucucccauucuguggguugucuuuuuacuuucuugaucauaucauuugcagcauaaagguuuuacauuugggccaggcgcaguggcucauaccuguaaucccagcacuuugggaggcggaggugggcagaucaugaggucaggaguucgagaccagucuggccaacauagugaaaccccaucucuacuaaaaaauacaaaaaauuagccgggaguggugaugugugccuguaauuccagcuacgcgggaggcugaggcaggagaaucgcgugaacccgggagguggagguugcagugagccaagaucgcgccauugcacuccagcccgggcaauaaugugagacuccaucucgaaaaaaaaaaaaaguuuuauauuugagugaagucuuuuuuuuugguuuauaaugcuuuuuguuuguuuguuuguuuuugagacauggucucacucuguuacccaggcugggguacaguggcaugaucuuggcucacugcaaccucugccuccuggguucaagcaauucuccugccucagccuccugaguagcugggauuacaggcacccaccaccaugcccggcuaauuuuuguauuuuugguacaagagauaggguuuuaggguuuuaccauguuggucaagcuggucuugaacuccugaccucaagugauccaccugccucagccucccaaaguaccaggauuacaggcaugaggcaccgcacccggcugguuuauagugcuuuugguguaucugaaaaaccauugccuaucccaacuucaugaagauuuguccauauuuucuuugaagcguuuuauuguuuuagcucuuacauuuacaucuauggcuuaugcugaguuaauuuuuguguauggugugaggugggaguccaacuucauucuuuuguuuguggguauccacuugucccaauaccauuuauucuuuucccauugaguuacauggaccccuuuguccaaauuaacugauuguaaauguaaguucugggcuguuaguuccauuucauugauaaacauuugugcuaguauuuuuuaaauuuauuuccauaaaugauuacuuuuccugugugaaacauuuuuuuuagcuuuaaaaaagucauuaggcaguaguaauuaccaaaguagauauaguuacacacaaaaaaacauguaagcuauuuuaggcagaaaauuuugagauauguaacguuccaggcauuuugugguaccuuuuuuuuuuacuucaaaacugugacacuagaucagacucucuuauuuuguuuuguuuuauugauagagauagggucucgcucugucacccaggcuggagugcgguggcacaaucucugcuuacuguagccuugaccuccugggcucaaucgguccucccaccuagcaucccaaguagcugggacuacaggugugcgccacugugucuggcuaauuuuuguacuuuuuuuuuuacagagacagguuuuugucauguugcccaggcuugucuugagcuccugggcucaagcagucuacccccuuggccucccaaagugcugggauuacagagaugagccacugugccuggccaagcucuuuuuuuaauauucauuuuuguguugcuuauuuaaacaugauugaaauuuggauaauugcuagaaaaaauauuuaccuuuauguuggcauuuuuaugcagaacaggaaaguacuaaaaacaacugucuagaaaguggcaaaauucaaaugcguaugaaguucaccuguguaaagagaggcuguauucugugguaucacugcguucugaacaccagucuguuauuaaaauuauaagaguaaaauuucugaaaauauugaugauucuucauuuuaugacccuuacagauauauguuguugcaauucuuuucaucuuucagaggcuauguugcugcuuaauuuuguuuucuuggggaacagagagcacauauuguucuuauaaaggcauuaucggcuuauuauugucuuccuguuucacaugcauguuacuaaacaaggaguuccccaaaccgcuuguauuuuaugaaaaugcaucuuuauguguuuguggcagugcuauaauuuccuguuauauugcauguauucaauuaacauuuuagauaucagacugaugacuuaacucucauuuaggaaucuuugucugaaguggaagaaaaauacaagaaagccaugguuuccaaugcacaguuagacaaugagaagaacaauuugaucuaccaaguagacacacucaaggauguuauugaagagcaggaggaacagauggcagaauuuuauagagaaaaugaagaaaaaucaaagguaaugcuuaucuuguauuuucucuuggggcagaaaauaaaagccugccacuuacaaagugauggaagauugcagcauacuuauuuaggaaugauguuucagucaaaacugaauggcccaaggaaauugacagaacaccaugagauaucaggcccuggaugacucuuuuuuuauuuaaaaaaauauuuucuugaggaaaagcuuaugucuucuguuaaguuucugaaaauagaauacaacucaaguuuuagcuucauuuucuaucucuuaauugggacuguaauuacaguguuacuuauuucuucugguuacaagugacuggaacucccgcaaagcuccaaagacucucaauaggaugauucauuuuuuuucuaugaacuucugaacgguucaagagaauccauuuucuaaauaauuggauagaagucuuuaaucaguuauuuaaaaucagcaauuuggagaugugggucagaaauugaaagauguuuucuuuagagguuuauaaguuguaauguuaaaauguacagauggagaauauaacgcauuguccaaggcccagauuugcucucugacaacugcagaaaacaaauuggauucuuuuaaaagcauauguuuuagacuuuuugaaggguugaugucaguucaagcagaggucaaauggguauuauugccagaaauggauugcuacuacauugccaauauaaaaaauccagaaaauaauuuaggaagugcauauugauaaauuguuagaaacagcaaucugaauuugcacauaauaaagggagagaagcuguuuauauaaccuguaggagaccaacauuauuacuguagucuuuauaggaauuucuuuccuugaggacuagaaaugcccauuccagccuguuuuggucacauucaaaaaguguuagaaaguguuugccaggcguuuggaggagagggaugaauagaccagagcacagaggauuuuuagggcagugauacuauucuguaucauauuauaaugguggauacauguuauuauggauacauguauggauacauuuguccaaaaccauagaauguacaccaccaagagugaacccuaauguaaacucuggacuuugggugauagugaucugucaauguugguucagugauagaacgaaauguaccacucuauuguggguuguuuauaauaggguagacugugcguguguggggacagggaguauaugaaaacucucuguacuuuaaacauaauuuuacugugaaucuuaaacugcucuaaaauuguuuauuuaggauugguauuuagauggugaaaaagaggcuucuaguuguuuucauauuggacugacaguggcccauugaagagcauuauauaugcuagauauguauaucuuugauucuucuuauauaucccauaggccauuuuuggagauucugagccaucaugcuuuuccuagagccucuggacuccuuuuuuugcugucccacacauuuuuucuuaucugucuuuggcucuuugcuucuagcagacuagaguaaaaaucucaugcuaaguauuuaagggucauuacuaaaaugaauuaucuuuccaucgucucaaauauccuucagcauuuuuaaaaauaaagaaaacccuuauaauuagcuauuuuaaccaacuuaguuuuucccuccaucauuuuagaagguaauagaguuauuuuaguaugcauagaguuguuuucuuaaucuuguccuuuuuuuuuuuuuuuuuuucuuuuggagacaaggucucacucuguagcccaggcuggaguggaguagcgcaaguauagcucacugcagccucugucuccaggcucaagugauccucccaccucagccuccugaguagcugggacuacaggcacguaccaccacgccuggcuaauuaaagacaaauuuuuuuuuauagaaacgguuucaccauguugcccaggcuggucucgaacuccugggcucaagcaauccacccaccucagcuucccacagugcugagauuacaguugugagccaccguggcaggucuuguacuuuucaaaccuaaaauguauuguuuuuuuuaauacccuggaaauuugcuucacguacugugaugcagaacacuuugugacaguaucucuuucuaacauaccuuuacuccgagcucucuuguucuaaacaacuauugcuuuauaaaguagaauguuuauauucagagauacacaaagaggucaggcauucugguguauuucauuacagaagcagguagugagaguagagaaggaccauuccauaauaauuauacaguauuaauaaaaauuuucaaaaugucuuuggugccuccuccuggaauuacaauaacuauuuuguuuuauauuuuaauuuaauuuaauuuuauuguuuuuacagacagggucuugcucugcuccccaggcuggagugcaguggcacgaucauagcccacuguaacuuugaucuccuacgcuuaaguaaucuggaguagcuagaacuguaggcacaugcuaccaugccuggcuguuuuuuaaaaaucuuuuuguggagauggggccuugcuguauugcccaauccuccuucuuugaccucccaaaguguugggauuacaggcaugagccacuuugcccagcccauuguuucucuuuuaaagcauaaucaaaagaccauuucacaccuguaaaauuaacaauaauucauauuauauaucuaaucaauguuaaaauuucaguaguuucaaaaugucauaaaugauuuuucuuuuuuacacuuaaaaaaaucgggauccagguaaguuucacaccuuagaaugaguugauaaaucuuuuaagucucuuuucauguauagguccucuuucauguuuuuucuccuuauaauauauauguugaagaaacuggguugcuuaauauuucccagucuuacaaguuuuuccguuuucguccccauaguaucuuuaccauguuucccuuuccucuguauucucuguaaauagguaguuaggcacagaggcuuaaucaaauauaacuucaguuuuuuuugaaagucugcuucauagaugaugcaguugucuuccuucaggaggcccagauguguggcugacuguuaggcuguaugugugugcuuagauccuuuaauugacuaggggcugcaaaaugggauguucugauuuuaucauuaccaauuuauuuuauuuuauguuauuuuauuuauuuuuuuaaauuuuauuuauuuuauuuuuuuagacgaguuuugcucuuguugcccaggguggagugcaauggcgcaaucucggcucacugcaaccucugccucccggguucaagugauucuccugccucagccuucugaguagcugggauuacaggcauggaccaccacgccuggcuaauuuuguauuuuuaguagagaugggguuucacuuuguuggucaggcuggucccgaacugaccucaggugauccacccaccucggccucccaaagugcugggauuacaggugugagccacugcgccuggccuauuuaauguuauuuuuaagcagcuuuauugagauauaauucaaauaacauacaaaucauccauuuaaaguguacaauucagugguuuuuaguauauucacauauauguguaaccuucaucacaguuacuuuuaguauguuuucauuaccucagaaagaaaccauauacccuuuaguaucaucuuccuuucccccaaaccccucagucuuaaguaaccacugaucuacuuucuaucuauagaguucccuauucuagacucauaugaaaggagucauauaauacauggucuuuugugacuggcuucuuucgcuuagcgugauguuuucaagguucauccauguuauaccauguaucaauacuuaauuccuuuuuauagccuauuaauauuccauuuuuuuggguaugcuacauuuuguuuacccauuugugcauugauugacauuuggguuguuuauacuuuuuccuguuaagaauaaugcuuccauaaacauuuguauacagguuguuuuuuggacguaaguuuucuuuuucuuuuuuauucuaagagauggggccuugcuauguugcccaggcugguaacuccuggccucaagcaaucuuccugccuuggccucccaaaguguuggaauuacaggcaugagccacugcucauggucuggauauaugcuuuccuuuuucuuaaguauauacuugggaguggaauugcugauucauacgauaaaucuguguuuaaccauuugaacagugccagacuguuuuccgaaguggcugcaccauuuuauauucucacaccagcaauguaugcagguuuugauuuccccacauccucaccaacacuuguuaucuguccuuuuuauucuagccauccuaauaggugugguuuugaugugcaucucccuggugacuaaugauuuugaacauauuuucaugggcuuauuggcuauuugcauaucuuccuuggcaaaaugucuauucagauccuuuguccauuuuaaaauuggauuuugccuuauuauuauugacuuguaagguuuauauauucuagauauaagaauuuuaucagauauauuauucgcaaauauuuucucccuuuaugaguuuucaaaaaaaggaauugguugugaccaauuacuuuucucuuaaaauaucaauaugaagucauaaauucaagcauuugauaucuucaguugcauugcagcuuuuauucuuuuugaugauaaaauugucccaucuuuggcuaaugugaaccucuugagguugauucucaaguacuucuggugagucuaauuguuuuugauagcuucuuugcuuucuggcagaagaugucccagucucaucuuguacauuuucugccccagaccuggaaucagccauuuguccaaggagcccuaguucuguuuuaguaugagugcuagagaugcucauugccaccaaguaggucaguguuuaugggucuuuucaguggauaaauuugggaaauaugugugugaaguuuuuuuuuguuuuuaacaacaaaauacauuaugaguucuugcugauaguuccaguucacaugcaggacucuaggguuauuuaaccucuucugucuuacaucuguaucuuuguuuguuuccccuacacuacaauuccuaguucucaaaguuucuagggaugauaguaauuauguuacguucuguucucuuugcuuuauccgaaguugccuagaauagcaauaccaacauuaacaccaacaauuuaauuacugaaaauaguuaaaagauuuuuauuuuguuuguuuugcuuggcuguuauuuuugccacuagucuguguguggccaaacuauuguuuuuagaaguuacuugaaauaguuucuuucugcgcuucuaacuggauguauaguuagguucacugcauuuuauuuucaauauuuggaauuacuuuuaaaauuauuuuuauuuuaaaaaauuuaauuaucauuaaaaaacaugauaaauuuauuaucuuaaccauuuuaaaguguagaguucaguagugugaagcauauucacauuaguguacaucagaucuccagaaauuuuuuaucuuucaaaacuagaacucuguacccauuaaacaauuacccauuucucccuaccaccagcccuuggcaacuaccauccuacuuucugucucugugaguuuggcuacucuguguaccaaacucauaaguaaguagaaucauauaauaauauaucuuuucuugacugguuuacuucauuuagcauaauguccuaaggcucauccauguuguagcgugugacaagaguuucuuuuuuaaagcugaauaauauuccacuguauauauaccacauuuugcuuaugcauucaucuaucaauggccacuugaauuguuuccacuaggaauugcuuuuuaaauuuaauuuuguuuuacaauuuuguaacuaucuagaauaguuacauagaucuggagucacguuaacaaagaauauaucugaagaaguuaaucuucuaucccugucucugucucuauuuucuccuuccuuuagggaauuuuaaauuuuaaugguuuaucuuuccauguuuuaaauccaagaagauaaauuagguagccauuuuuaaucuaaaaagauauauauguauauauaaucauucaaaauauauguacaaauauauguauuucuuacucuucuuagaaaauaguagcauauuguuaauauaaaugcugucgugcauguagauuuuaucaccuuaugaauguuguauagagauaucuugcucauucuuuuucaccacugcauaauuauuccacaguauggauguaccacacuuuauucuaccaguucccuauauuaauagacauucaaguuugucauguuuugcuguuaaaaauaguccuguagaaauaacauacugcauaggucuuuuuguauuuuugccaauguaucuaugaugaagagugagauugcugggucgaaagguauguaguuuugcagauacugcuguagucuccuuuguaagcauuauaccauuugcauucucaccaaaauguaugagggccuauuucuuuccccauaguucuguucuggaauauguugucaaguuuuugaacuuuugcuaguauuuuguuuguuuccguuucucuuaguaugaguaucuuuucauauucagagcuauuucuauuucuuuuucuguaaacuguccguuuccguagcuuauuauucuaugcaguuaguguuuucuuucuuucuaguuuuuguuuguuuguuuuuuaagacagaguuucgcuccuguugcccaggcuggagugcaauggcgcaaucucggcucaccacaaucuccgccucccagguucaagcaauucuccugccucagccucccgaguagcugggauuacaggcaugcaccaccacgccugacuaauuuuguauuuuuaguagagacaggguuucucuauguuggucaggcuggucucgaacucccgaccucaggugauccgcccaccucggccucccaaagugcugggauuacaggcgugagccaccgugccuggccuaguuuuagagauucucugccauucaaaaguuuuauuuauuuauguauuuauuuuuuggagacagagucucacuccgucgucaggcuggagugcaauggcaccaucauggcucacuauagccuugaccuccccaggcucaggugguccucccaccucagccuccagaguaccugggacuacaggcacacgccaccaacccuggcuaauuuuugaauuuuuuuuauagagaugggguuuugccauguugcccaggcagggucuugaauucuucggcucaagggaucugccugcuucagccucccagagugcugggauuacaggcaugagcuaccaugcccagcccaaaauuuuuauuuuuauguagucuaauuuauuguaccauuaccucauugcuuguggauuuuugagucauuuuuucaguaaagauugccccacuccuugguuacuuuuauuccuguacaguuuguucucccuucccuucccucuucccccauucacucccuggcuuucuuuccuuauguaaaucucugauugauuuggaauuuguccuggugugugguaugagguauaguuccaauuuuaucuuuuuccaaauggauauccaguuaucccaacauuacuaauuuaaaagucuuuccuucucauugauuugagaugcucuuauuuuuauuguuuuuaaauauauuuguauauuuaaguggguuuuuccugaauucucuauucugcucccuuggucuauauucaugugccauaacaacauuguuuuaauuauagaagcuuuauaauauguuuuaauaccuaauaaggccggcuuucuucuuuuucaguauguauuuuucuggcuacuuuuucuuguguuuuucuuucaaaucaacuugcucugaugaugauaaaagaaaaaccugaugguauuuuuauuuguacuacauuaaauguauagauuaauuuagggagaacuggcauuuuuauaauguugugagacuuuuaauccaagaagacgguaugccuuuccauuuauucaauccuauuucucugucuuuugggaaugcuuuauauaauuuuccucauauagguuuuugauauauuuuguaaguuuacauguauguuuuuuauuuaauauugauuuuauuuugauauugcauuuauuauuccuucuuugaauuuuauuuguauaugaaugucauugaauuguauauguucauuuuauaaccuguuacuuuacuaaauuaucuuuuguuuuuaauaauuuugccauugauuaguucagguuuuccugauaauuauacaagauggaauuuuaaaauuuucuuaacuuuucuauagaauacacaauuuuucuaaguuacuaugaaucaggaguuugggcauguuucuggaggucauacuuaaccucuguguuguauuguguauguucaaauuucuugugugccaugaccuguguaaaugauauuauuuguuuaauaacaggaguuagaaaggcagaaacauauguguagugugcugcagcauaagauggaagaacuuaaagaaggccugcggcaaagagaugagcuuauugagguauguacaugaacugugggaauacuuaauuuugaaaaaaaaugaguugaaugggaugaggauguguugggagggaaggagaguuaagaugcaucagaguuugucucuuuauauuugacuguacacuacaaauuuucaaacauaaaccagauuaugcuuaaaaauuaauacuauaaauccuauaaacauuaccccacuuugguagcagaaauuuuugugucuuuuauuccuaagcacacuguuuccuacagauaucuuaggaaaugggcaaaaggaaaaauuauagaauaacauuauucuuuggaauuagugaaugccaucuuuugggacaugauucuuggggaauaaguuugauuuucacucagguaaauacauuucucagguggcuaaaugaaaaaagaagaaacaucaagauacguucuguacaaaaagguaaagaaugguuagucugaagguucagguuucugcaagcgaagggacucugccacauugcuggcaacaucuuaggaauggaaugaagcauagucuaccaagaacucuuugaaaacauuagucauccuugcaggccugcuacauugcaugcaucuuuuuucuuuaaaugugguuuucccuccugagacgauguuuuuagauaaauauggaaauaaguuugaagggggauccugcccacuaucuagguguggcuaucaaaggcaucuaauguuaaguuaguguugacacgccagagaugucaggaagcauagauuguuaaugaucccaggagagagaucucacaaccacacuuguccacauuccuggcuacucagaccuuagccuuucuuuuucucucccucuuucucucuuuccccucggaccuaccucuuaauaugucucucuacaaaugauuuuuaaaaaccauuuaauagagaaaaagaaaugacuuuaaauuugaagacguguuaauuuuugucaucauuaagaauaauugaacauacucagaauuuguggauuucaagugcagauacagauaaccuuuuggaucuaucagauuacaugugaaguuaauuuucuugguuuuucuccauauaagguaggaagcauauuuuccagaaucuguauccugcugguauuuuaaaauaaugugaaauucuuucccuuuuuguucuuuuaucuuuuugugccaaaaugccaaccacauaaaauaauaaaccugcuuugggggcugcuucucaaauucaauagcuuaaguuaggacugguaaaguguucuaguaauuaauuguaauugcauuuaagaagaauauaaugcuugauuucuauaguucaucacuguggcuucuuuaaaagcuuagggugcuagguauacaaacuuugagaacuauaguuuuagauguuuuuuacaucuagaaugaacaucuuuuagauguuaguaucuaugguuaugcugaaaaacuuuaaauauuacaaauaauguuuuuuggucuuuggaauugaaaauuccaugguaaaguaccuaauguaugaguagggaaaggaggacauaauaauuuaccaauaaugcauaagaagaaaaccuguuaagcaccauugccuaauuagaaaggucauuuaaggauuguuaaaugcuaaauuuaaauguuucaaaauaauauaauuuuaaaauaauacaaaauucaugguguucuugcugucauagauuuugcuaacagaaauucaaaaugaucaguucugcuuaaaaaauaaaauucaaaacugcuuguucucuaagaugaaagaucauuuguucauaagcaaaccuaaauuucccucucuaggaauguaaguucuuguuugguaaaaaggcaguuaucaaagaaagaauauacauauggagcuguauguacacagaaauucuagcuggcuugcugccacguagcugugguuggaacaauuauuccugguuccuuugcuuacuuuuguaggggcaagccaauaagaaucuuguggccaagacugugaaugucaucuuuucuuuuggcagaccaauuuugcuuuuccuguucaucacagacuuucccuuuugguuaaguuucuuuaucggcuuuauuuuuguuuccucccucaaaccuccucucccuuuucuuucugcucuuuuauuacuucucuuccccucuuccucugcaggagaagcagcgcaugcagcagaaaauagacaccaugacaaaagagguguuugaccuccaggagacacuucuuuggaaagauaaaaaaauugggguaugaaaugaaauugggcuuugguuagaagcucauugaugaggacuacaguagaauuuaaccuagagauugaaaaaaccuguccuuuugauucuucuugagcauuuacacaguaugaaaaaugagucaguaggagacagagacuuccauaggaaaaccugacguugugccuggaagaacucuucuuuucagcaaacacuaggcuuguaaaauguauaaguaggaacuuuuaaaggaaguuucucuguauucccuuaggauucuuuuuuuuuuuuuuuuuuuuuuuuugagacggagucucacucuguugcccaggcuggagugcaguggcaugaucucggcucacuacaaccucugccuccuggguucaagugauucuccugccucagccucccgaguagcugggauuacaggcacacacaaccaugcccagcuaauuuuuugucuuuuuauuagagacgggguuucaccauguuagccaggcuggucuccaacuccugaccucagguaauccacccaccuuggccucccaaagugcuaggauuauaggcgugagccaccaugccuggccucccuucagauucuuauccagaaacagccacaggcauucaauucaaacucugugguuaacuugauauccuuacguuacaggaauuuggauaagaagaggguagugguggggagaaaguuauuagcauccuauaaauccuugguguauaaaauaggaagagauuaaaaucaauucaauuacagaaauggauaggaauguaagacuuucuaggguggcugucuguaauuauaaccacagaacucccccaaguaagggcccagauaaacgaaaugucuucauugcuguuuugcuaagccuugcagguagauuccauguacaccaaaagcuggaaaaaauucccuccaguucaucucauguggccuuugauuggcagucccaucaccuggcugagcucucuguucuacaguaggggaaccacuuagccauaguugccagaggcuuaccuugucagggaagggcagaggaaauagaacauguaagaaaagucuuguucugcuuaagguuagggggaguagggaauaguuguuaaagaucccugagaacaucucuugagagacaggccuggauaugaaauccuguggauuauacccucagaauguuguuaggaacauucugaagcccaaccaguagucagcaggauccagucuuuuucaucacuucaaggaccucucucauuaauauacacaugggaagauuacauuaccucuuaagaguuuguaggcucaugccuggaauccuagcacggaggaucgcuugaggccagaggauugcuugaggucaggagcuugagaccagcuugggcaacauagugagacccacccugucucugcaaaagaauuuuaaaauuugcagagcaugcaccugccccagcuacuuaggaggcugaggugggaggaucacuggagcccacacgauggaggcugcagugagcuaugaucgugccauggcacuccagccuaagcaauagagugauacccuuucuuuaaaaaaguuuguagaccaaaaauuuaaagaacaaaagcuacuuuauagauaauucucugacuuucaaauugcugaguauuaaaaauuccaucuaaaccuagaaaagccuucuggggaauaaaucaauaauucuguuagguguuuugaaacuaugauuuuaaaauugaaauuugaaauugaaaagugaaauuugauuguugaaccauugauuugauuuaaauuuuugcuugggaaauauaagaggugaaaaaacguggggcaaaguagguaauuuaaaauuuuuaguuaaaaucuggucacugucuagaaugggcuucuuuuaggacuucacauaauuuucuuuaacacagaucuguaggcccaggauuucuagcuuguaugagugccuuaauauuuuaaacugauaaucuuggaccagccauagaaaccccucagaugucucaguuuaaaauauaaauuauuuggcuuuuaauuggaaaauauuuuauuuuaguauucuuuuuuugagauggaaucucucucucuccccaaggcuggaguauaguggcacgaucucagcucacugcaaccuccuggguucaagcaauucuccugccucagccuccugaguagcugggacuacaggugugcaccaccacguccggcuaauuuuuguauuuuuaguagagaugggguuucaccauguuggccaggcuggucucgaacuccugaccucaagugauccacccaccucggccuuccaaaguggugguacuacaggcaugagccacugugcccggccagaauuuuagauuuacaugcaguuguaagaaauuaaacagggcugggcaugguggcuuaugccuuuaaucccagcacuuugggaggccaaagaggguggaucccuugaggucaagaguucgagaccagccugaccaacaugguaaaacgcugucucuacuaaaaauacaaaaauuagccaggcaugguggugcacaccuguaaucccagcuacuugggaggcugaggcaugagaaucacuugaauccgggaggccaagguugcagugagcugagaucaugucacugcaguccagccugggcaacagaccaaaacccuguuucaaaaaaaaaaaaaaaaagaggaaauuuaacagagauccuauauauucuuugcucaaucuuccccaaauguaacaucuuacaaaacuauaguacaauaucacaaccaggauauugcccuugauauggugaagauacagaacauuuccaucaauauaagggauuucuccuccucuugccuuuuuauagucauagccuuaaucuccccuuccccucccaagcccuaagaaccacuaaucuuuucuucauuuguguaguuuugcucuuuuaagaauguuauaaaaauggaauuauauaguauauguuaaccuuuuggaauuaucccuuuucacucuguauaagucccucaagauucuuccaaguuauugaaucacgaguugacucuuuuuuaauuugaaaaauugugcuaaaguacaaauaacauaaaauuuaccauuuuaacuauuuuuaaguguacaguucaguggcauugaguacauucauguuguugugcuacugucaccaccauagaacuuuuuagucuuccccagcugaaaucuguacccauuaaacaacuccccauucagucccuucucccaaaccccugguggaauggcaacuaccauuccaccuucugucucugugaauuugacugcucuagguacuucauguaaguggaaucauacaguaucugauuuauuucacuuggcauuaugcccucaagguucauuuugcagcauaugucagaauguccaucccuuuuaaggcugaaucauauuccauuguauguauauaccacauucuucuguugauauaucaacacaucuaccuuuuggccauugugaauaaugcugcugugaacauggguauucaaauaacucuucaagacucugccuucaguuguuuucgguauguacccagaaguggaauugcuggaucauaugguaauucuguguuuaauuuuuuugaguaacaguuauacuguguucuguagcagauguaccauuuuacauucccaccacuagugaacaaggguuccaauuucuccauguccuugccaacauuuguuaucauuauaauacaagggcagugguccucccuugacuuuuaagacacauuuucaguauggucaguaacuacuugucucuagcuucauuuuuaagauuuacauuuaguaacuuaaugaagaaauauguccauuauucccagguuaaaguucaguucauuaguggucuugccucuagcuccacugcgguucuaaacaccaggagcccauguauagaauaggugcguaugaagaacuugcguaucucuauagcccagcauaaacucacuuccauucugaccaaagauauuuguuccccaguacaauuauguggagaauuaaccccuugcccaaaaguucagcccauuauacacauccuuuuggcuuccgggugguaggauuugagguuaggucagggauaaagaguuauuuugaacucuacaagcguguacuuuuuacccuaaaaaaaaucuacuguaggagcuauuguugcacacaaacacaaggguagugguuauauggucagguaauacagaggguuuuagauccagcuugaauacauuugauccaauuauaagguauuuuaguagucuucaaacuuuguggugaagugggugaauuuacaggauguauuuuauuuucucaucuguaauuaugggaagaggaaauuaaaaaguccgaagguaaaaauaaaacccagugcaauacgauguggaagaagagcaaaugucauguauaucauuugcuagaauuccuaguuucaaauuggccuguuccucagaggucuuuuuuauucaguguuguuguuuauguagagcauguugugacagugaucauuuacccacuuauauguggugauacaugacauaacuaugcaugcagauaccaguaaccaaaaauaccuaauccauaaagugacacucaacacaugggaaaguauuguugugcuuuguuuucccaauguuucaguuauuauuaauuauuaacauaauggaguguuaacacuagcuagauggugcuagaaaugcacauuguuaauucacaggcagacuugagacacaucauauagugugaauguaaauuguugaaaagaagucagauauugacauugcaguuuggauaaguaaagaguaggauuugccguauggacuccuuuccuagcaucaucugggcuaacaauaagggaauauaauguggccuucauagagcugugauauuuaaaaaacuauuuaagggcuuuggaaacaaaaacaaccagauucauuuucugguuuugccacuuacugugacuuugggcgaaaaaauauaaccacugugagccucaauuuucugaucuguuaaauggggauaauacaaguaccucacaggauauguagagguuucaaauguaaaauaauguauaagagagaaauuauauaaaauagugccugccauauaauuugugcuauacaaaucguaguugcuaucaucccuuauuuacuugcucccuauuugguugcaaaacaggauuauaaugauuuuuugaauugcccagcuauucagcuaucaauuucucagcaauucgcugucccacuuccaaacccagugaacugagaggaaaguuaccugauauaguuuaacuucuuggauuaaugggaaugcuaacagaagacauuaaauauaugaacaaaaauauuuggggaaaggcuuuuucaaauaggccaguaaucagauuccugcauagacuacuuaccuuggguguauuuuuaauucuggguuauuuucuuuuacaauagauuuuauuuuuucauaguagauuuuauuuuucauugaugaccaaaguauguuccugcuucugcauuguccucagcugacaguugugagauuaaggaaauggcagggaauuuacaaaugaaaucaccaaccugauucuccugaacugucccugcuaucuaggcauuacaggcaaugcuuuaccuugauuuaugccucugcccuugggaugggugcuauuaucccuucuguuuuuccagugaggaaacugaggcauaggacaaguaugugccagaacccaaaagccugauucugaaauccauauucuguaacucuucauagcuuggcuguauuuauuuugucaguguuuauuuuuguuuuucacauuuugggaguauaacagaaagccaaaugagucucaguuauauuuaauuaaguugucagaaguugaucuuugaauccuuuuggagguuaacuauuuugaauuaagugguauuugaguauuuugccacacuacuuggagaaaaaucuacagccaauauuaaauuaaaauaccuauguauaauaguuauuuuuauuccagaacuauuuuuuaaaaaaucaacuguauucuugaauaaacuaguuuaguuaaacaugaaaugugggguuuuuuuuguucaccaaauaaaaaugcacuuaggcagucaguaaggaaagcuuuauuuuacucuggcuucucucuuuaucuuccuuuuccuguuuuauuuuuuucauugacuggaaaagauuuauuucccugcuugaugugauuaaacauguuuugccaaauugaugcaugagaaccaguuucuaugagaagucucuucuggagauguauauccauguaacucuguauuuccucccauaucugacuguuuguuuccaaucuuuugacugcuuucuugcuuuuuaugccuuuaucuuugcuuauuugaauuagguacuucucugcuaccuuucaccugcucuuuuucugugccauuguuucccuugcuaccuuaccuaaaaccaggcccuagagaaacagaaagaauacauugccugccuuaggaaugagcgagauaugcucagagaggagcuggcugaccugcaggagacagugaagacgggagagguauguuagcauuagccuggaauucaggucccucacuguuuuacucucuaucuuccuuccuuucauccugccaucuuuccuagccuaaauacaaacuacaguguuuauucucuaauccagauuugguagguugaagcuauuucuuacacagagcuauauuucauguaacugauucuaaccagguuuuaccuguagcaaacauguauuguugcagagugaccucacagagcuuacagcuuccauacgggccuuuugugaugguggguuuuuccccccugcagaaacauggcuuaguuauaauccccgauggcacucccaauggugaugucagucaugaaccaguggcuggagccaucacuguugugucucaggaagcugcucaggucuuggagucagcaggagaagggccauuagguaagauacugguugcuauguugacuuggauuaauguuacccuauuggguuuucugcuuuuucauaucccagcuuggaaaacaaaaacagcauaagggcugagacucaaguagauccuuaacuagaagaaucugggcacauuggcacauugucuucagacauccuugaccuugggaaaucagcaucugggucacuguaaggcaauaaguguaacuguaaggccuguggauggaaguacuaugggccuauacacaucgguuuuuacuuaacuacaaacuguucugcaaagagauagucuaguauaccugugcuaggggagcaguaggcuagcaggagacuucucaaguguguuauaaguuucucauccuuggaacaucugguuuuauguuccacugcuuaccccaggguucuguaccucuuuuccaccacauuucuuaagccaagaaacagaugaccaaaaagauaucagagaaguaugacuuccagagcagggcuucccagacucuuaaagucuaaaccucuuaaauuuaacccuuugagaaucugacaccucucuccaggaaaccacaaaguugcugacaccucugucugagaaaucaaagucacccauccauugaccccacaaagaaaucuacucuagaggaagaaaaauggcacagauagauacuguaucauuagcucacuuuuauuuuaaaaaaaaacaauuuuuuuguuuuucaucuuguuuucauauauguguaagcuucuuagaggagugagagauacaagugugaagcaaacugaaaaacauuuugaaaguuaguaagcacauucucuaaugugcauuccagaaaugugauuguagggcacuuugaauaaaacaggaugcugggugagcaagagagaucuggagaauggaacgagagucuggcuauaggcagcccagaguguuucccugcuguuuuuucccucgucugcagguccaagcaggcagaucugcuuggaaggugcagaagaaaccaaaaucuuuauuuggcuaugacccuguuuacagaggguagugguuggcgagguaucagcugcuuuuuuaagugaaccaugguaucuccucagcugaaggggccuauuuuaaugcaggcuugggaagagucaaaccuccacaggcuaggagugagcccuaauggugcugccaccaagccgcagaucuacccauggaugcccacaucuuuuuuuuuuuuuuuuuugagacgaagucucacucggucgcccaggcaggauuguaguggcgcgaucucaguucacugcaacauacaaccucuaucucccagguucagacggcuucccgaguagcugggauuacaggcgccugccaccacgcuugguuaauuuuuguauuuguuuaguagagacgugguuucaccauuuuggccaggcuggucuugaacuccugaccucaagugauccacccaccuaggccucccaaagugcugggauuacaggcgugagccaccacaccuggccuggcugcccacaucuuggaguggguccccuucccucccuacuagcuuuuggggacuuugcuucuuccagcauuaugcuccucucuuuucucuucucuagcuuccuuugcccaguccugcucuuaccccaucuucuuucacauauuuggaucucucccgcuaagggcucagccuuuaggaacacacuugacauuugaguugucugucuacuagugaaagcuugaaacaaggaaaugaccuccuuuguacuucuguuugucuuuaaguggcaaaucacugcuguggggaacaaauguuggauuuggugcccugauaaauaucaguuguguggaaauacuuuuuagauaguuaagaacuuuucuguaaugcuauuaacaccuuuauuucuuuagauauucagagcuguaaguaauguaauuuaucagauaauauuagcuguuuaugaguuugaaaaauuuuuaauuguuuauguacuauaucaucacauauuuaguuuaugaucuuuuucauuuguuuuagauguaaggcuacgaaaacuugcuggagagaaggaagaacuacugucacagguaaaggcauucuuauuggaguguaauauaauuuuaacaaaguuacaugguaaaauacuggcuaauugaaauguucauuaaaaaaauaugcuucuuucaaacaucaguacucaagugagauaugaaggauagauaauucauauuuuaccucuuuguuauuuucuguucuuaaaacauuuuuuuaaggacacauaguuuaaggagucauauaguuuuuuacaaagcuuguuaugaacacagcaguccccugcccuggcuccucugaccucgccccugaccauuucuguuaaauacuuuuagcugauucuuguguacuguccuuguaucucuguauaacauacuuauguugcaucuugauuguucugcuucaggcauucuauauugacauccuuuuauggaagaugaggauuuagcuguuuuucauccuuugucccugccacacacauacuuauuuuccacucuuauauccuccuaauaaaggaacaguguaauuccagccugcuugugucauuaggacccucuaaacacuacucacacaguggagccagguugcauucuaggaucaucucccucagaacuauuaguuuccucuaaaguuaauguuaugguuuuucuuuguauuugcuugguuuucuaucaucaauuuagccacagaaucuccaagaguagauuaaucccacucaguauuuucagaugcaucugguguuauuucaguuccaguuuguugaaucuuggugcaucugacuugucccuuucuaaacuagugacuugcccucucgguacauagauguggucacccuucauuggcaucuggagauuuucuuugcaugugauuuagguuggguucccuuuuuccggugucucaugccuuucuccuuauuuauucucuuauuuugguacaucuuccaguagcuuccugagaagaggguuuguggauuguuaauuuuucaugaccuugcaggccugaagaugucuucauucuacccucucacuugauuaaaauaguuuggcuggguagagaauccugaguugccaugguucuccuuaagauuuuuuaaaaggacauuucuucauugugcugugacuucgagcauggcuguugaguuuucaugaacauuuugaguucugaucuuuucugauuugugaucuauuuuucuccucuuuguggaagcuuguauccuauucucuuucucucuagcauucugguguaauuugaagauagucaugugauuugaaguuuucaugugugaugcugggccccugucaauucuaggagcucccauccuuuaguucugggaaaauuucuugaaugauuuuguuacugauuuuuuuccccucccauaugcuguguucucuauuuuggaacuccuauucagucauucaacaaauguugagugagauucuacuauuuaacaugcacuauucuaggcacugggauauuucagugaauaaauuaguuuagaaaaaaaaaauuccugccugagaggcauucuaguaggaagacaucagacaauauuauaugauauguuagaagguuugugugaaugcauuuauuauauguguuucucuggcuacuuacagcagcauaggggcaggcauggaguggguagagagcuagauuuuacuaggacaguauuaauggggcaggagaggugagggaguauguaagaaaaugauuauaaugauggaccuugaaauuaaacuggaugaagaggauucgggagauauucaggaacacaucaagguauaguagaaagaagauguaaucuguagauuagugguaccagugugguugaaggguuguuggaauucgggucuagagagaaugaccuggaaagaugaggaauagugguuagagagaggauacauggaacuaaauuguguagggauuacaauugucuaaugaugagaucugguauaugacugugggagugaguagcugagggcaagaagggauagauagcaagauccuuggaagggagguggguuaguccauuuuuugcuucgcuauaaaggaauaccugaggcuggguaauuuauaaagaaaagauguuugacugggcacagcagcucaugccuguaaucccagcacuuuuggaggcugaggcaggugguugaggucaggaguugagaccagccuggccaacauggugaaaccccaacucuacuaaaaauauacaaaaauuagccgggcaugguggugggugccuguagucccagcuacuugggaagcugaggcaggagggagguggaggcugcagugagccaagauugcgccacugcacuccagccuuggguggcagagugagacuuugucucaaaaaaaaaaaaaaggaaaaaagaaaaagaaaaagaaaagagguuuaaacuggcucaugguucugcaagcuguagaggaaguauguugucagcaucugcucagcuucugagcucaguuuccugaggccucaggccaggcuggucuugaacuccugaccuuaggugauccacccaccucguccucccaaagugcugggauuacaggcaugagccaccgcgcccagccagccucaggaaacuucucaucacggcggaaggugaaggggcagcaggcacgucauaucucgagcggaagccagagagaguggggagguaacauacacucuuaaacaaccagaucuugugugaacuaccagagcgagaacucacucaucaccaagggaauggugcaaagcuauucaugagggaucugccccaugacccagauaccuccugccaggccccaccuucagcacuggggaauacauuucaacaugagauuuggaggggacagacauccaaaccguaagaggagauauaccagaaauugagagaucauuuguaagggagauccucuacuuagauguacauugaaauugccaaaaauuaagacaggaauagucuagagggagugcaaguugggagcuauuuaauaaauggugaugaaggaaugggauuuuggcaaugauaaguaguuaguguauauaauuugaagagacgagauuaagaccugggacuuuuagggaagauggagggaaaauaccagcaaggaaagcaagaggacaccuauuccauuucuagauucagugguaggaagcuguggaaguacaaaaaaaaaaagggccgggcaugguggcucaugucuguaaucccagcacuuggggaggccaagguggguggaugacuugaggucaggaguucaagaccagccuggccaacaugacgaaaccccaucuacuaaaaauacaaaaauuggacgugguggcaugcaccuggaaucccagcuacucggggggcugaggcaggaaaaucgcuugaacccgggaggcggagguugcagugagcugagaucaugccacugcacuccagucugggccacagagcgagacccugucucaaacaaacaaacaaaacaaaacaaaacaaaacaaaaacaguguuugagagagcugcagaagcagcaggagaggguuaucagagcacgaggguaaaggggggaugcucagaaaagacugaggacagaggguguuugcugaugauggacugauaauucuagagggcccaguggaaaaguuucaggcauugggaaagguuaggagaugaagguuaguggucguacagacccuugugaggaagacugcagaggaaggauaugacccuuugugagaugcacauaaauaggaaugauggagauacugagauuuguccugguucccucaaggcagcuaaugauggugacccuguguguugaaagggcagaggugccugggaaguauagaguuagucccaauauagagcuuacccuuuucccauuggggaguggcaaacuuaaucuuagugcagaggccucccuuugaccccuguugguggaguuaaggacagcuggggaagccaucucuauguauccaauuauuauuauuauuauuuuuuuuuuuuuugagacagagucucgcucugucaccaggcuggagugcagugaugugaucuccacucacugcaaccuccaccuaccagguucaaaugauucuccugccucagccucuggaguaguugggacuacaugcgcgugccaccaugccccacuaauuuuuguaguuuuaguagagaugggguuucaccauguuggccaggauggccucgaucucuugaccuugugauccgcccgccucagcuucccaaagugcugggauuacaggcgugagccaccgugcccagccccaauuauuuuuacauacaggauguuuucuaaguaagaaaauuuaaccuaugucuaaaaguaaacaacaaaaaacugcucauggaaucuuccauuuuaagaaauaaucucuugaauauacccuaucaguuaacuguuuauauuuuuguuuuauuuuuuuuagagaugaggucucacuguguugcccaggucggucucaaacuccugggcucaugugauccucaugccucagccucccaaguagccugauacauagguacaugccacuaugccuggcuagaauuuuccauuuuaaauaaaaguaacaaaaaauaccccaaagauguacuguuccauaagcagacacaaauuuaaaauauggcuauuuucuacugggacaccugguccuggggcuugcucuuuucgauguuuguucguagcuuaucuuuagcaccuaggacgaugugugucuccuauuaggcacucaagaaaauagguuuugaaugaauguggcugauacgauaagggucugcuuuguucuaugaugugaccauagaauaagcaucggcuucauuugagagauuggaucuugcugaugaaccuuuauuuucauuucagauuagaaaacugaagcuucaguuagaggaggaacgacagaaaugcuccaggaaugauggcacagugggugaccuggcaggacugcagaauggcucagacuugcaguucaucgaaaugcagaguagguaccaggggacaggccagucccagucuguauauagacugugucccagggguggguuugucagcagguugcugguaucuuguaauacacuuuucuuuuuuuuuuuuuuuugagaugggagucucacucugucacccaggucagagugcaguggugcaaucuccguucacugcagccucugccuccuggguucaaguaauucuccugccucagccuccugaguagcugggauuauaggcgccugccaccaugcccggcuaguuuuuuauguuuuuagcagagacagaguuucaccauaguuaccaggcuggucucgaacuccuggccucaggugaucugcccaccucagccucccagagugcugggauuacaggcgugagccaccgcgccuggccguuaauaugcuuuucuuaagaagagcuaugcugcaaaaauugguuaguccuuggcuaguccagaaaaacaguccuagucagcaauauagcugaauagaggcuccacuagccugugugcuucaggggauaaugagguuuauugcucuuacccuuucuggauaaagugauuucuaggaacuuuuugcacacagugaaaugccuuuugacaaccuggcacuguccuuuuccacauccauuugucaucuuuaagcucccauacagcaagcacccuuccccauuaaaguuuuuucucuggaauuugucuuggauaauuggacgaaucuauuuggaacuacuucacacuaaauugaguaguuucagaauuuuccuagaaguauuuuguuaauccaaguuuaucuuuauuagaugaaauuuaaaauaaguccacaaaauaaagucuauucuauucauuuuacccgaauuauuccaguuuuucucauuuuucuacuucugaccucauaauaaaaugaucacugcagucacacuaauucccauaguaggaagauuucagcaggaauuuguaguuagccuuuguuagugauuauguguaauucucggacagaggagauuuucauuuuuccaauaagaauagugacuuuucugauaacuaauauuaaaaucuuguuuauuccauggacuuuucaucuaaaccuucugagauaggcugccaagaaaagacauguuggggccaggcgugguggcccgcacccauaaucccagcauuuggagaggcugaggugguggauugcuugagcucagaaguuugagaccagccugggcaauguggugaaaacccgucucuucaaaaaaaaaaaaaagagaaaagacuuuuuggguuaaggcuuauuaauacuaacuuuugauauugguauuaucuuuucuguuggacaucaguuaggacacuugugacauuuccuggugaauauuuuguucaagaaugucauuuugguguuggcgguagaugagaacagggacaugggaaaaggcaggcugacuaguuaggaagcuacuacaguggugagccugaaccaguucaguagcugucagcagucuuagagagaggguagggaauagaucugagagauuguccuuaagcagcaaauuuaaaaggaaacagauuuagggggaaugggcuggcauuuaugugugaauacuuccuagaguagguagguuguuguauagcugguauuugcagaagguaaaguacccaggcaggagguguagaacaaagugagcuuugcaggacugugggaaagcuggcaaagacaaaagcaagcagcuucccuggaccagaaggccaggaguggagcaacucuugguucuggauggugccuugccuauuaugagaguguuuuggaaugggauuucaaaacacacaugaaguuacugagauaagagacuuaaacuuuugaaaacaggaagggaaaggugguuuggagagugagaaggaagaaguacauuuggauaaucaauagauugcugaggauaacaauuuaaaaaucagauccugaagcuuguuuuagggcucagaaauaggaauacuucucuuucacuaccagauauggcuuuuggggagaugguaacccuguuccuuuuaaggugacaguaauuguccaauuagaaaaaccucucaccacuuuaggaggcugagguggguggaucacgaggucaggagaucgagaccauccuggcuaacauggugaaaccccgucucuacuaaaaauacaaaaauuuagccaggcaugguggcgggugccuguagucccagcuacucaggaggcugaggcaggagaauggcgugaaccugggugauggagcuugcagugagccgagaucgcgccacugcacucuagccugggcgacagagcgagacuccaucucaaaaaaaaaaaaagaaaaaccucucacauugaagacuguauaaguaauuguaaccuuggucauguggaaauguagaaaaguucuuaaguuagauaaucugaauauuuccugugguauguuagauuugguuuaucuuuugcaaaucuuauuacuguaaucaugccagagacugauuuuugcuaaacuuggauucuuggagggauuuuaaaaguccccugccaucauuucuaaacuuuucauuuuaagugauuuacuuccuaggucagauguucaucuaguaacuuauagcucuacccauaacacauuaucacauuacugaacagcauuuauuccaacauauauuuauuuaggcauacacugugugcacuuggcuagguacauagguagauuuaggaaggccaagacagggccccucuucuugcuuacacauacgauguuuaaaaagcaugacaaaugucauaaaaaugcaaauaaaauacagcaagggaaggacuuauaauuaaggggagucaugaaagaggugaaaauugagcuuggccuugaagcaagucagaggugggagaaaaggacccuuacaguauuggacagcagaagcaaaaccugggagaugggaaggcauggggccgcguucagggaacuagagggcccagucccgugggcagggaggcuccacaagguuacacacaggguugguaggggcugcugcugaauuggcagggcuccuuucucaagcccugcucacacauaucauaggguaaagaauuuucuucuaacucuugcugcaagggauacuguaguaacauauaugcuagagcaucuuguaguauauacaguccagaaccugggcugcugaagaugcugugguuguugugugugcauuuguauuuuguaauuuuuuuuuggcagggggacggaguaucgcucuguugccaggcuggagugcaguggcgcgaucuuagcucacugcaaccucugccucccggguucaagugauucuccugccucagcuucccgaguagcugggacuacaggccugugccaccacgcccagcuaauuuuuauauuuuuaguagagacaggguuucaccauguuggccaggauggucgccucuaucucuugaccucaugauccacccaccucggccucccaaaaugcugggauuacaggcgugagucaccgcgcccagcccuguauuuuguaaucuuaagacugcaugguccucucugugccacagagguacugccugauggcucauacugucaucucugacaggugaagauaauucauugucuucuucuguucuaggagaugccaauagacaaauuagcgaauacaaauuuaagcuuucaaaagcagaacaggauauaacuaccuuggagcaaaguguaaguacuucuauaugguacuaaguuauuuaaauguccuuccugcaucuaaguggcuaacaacccaugagugccuggguugccuuugcaguuggaucaauaauaguucuguauuaaaauagaaaagccagcagagagcacuuguugggacauuuuagccuucuguuuucucuaaaaccauaggaaacuauagcuaucaguuuuuguagauauuucaggagaauucaagaucaucauuuguaauaaaaucccuuacgcauuccaaaaaguguaagaacuuuuccauuuagugucucuuccuauauugcuuuggcacuuaaacaauauggucauaauaaaacuuagcaugggaaauuggcccuaaaaugacucuacagcuguaauccucucuggggacauuacuugauuuauaaauagcaacugaguucugagaggacuuaugagucacccuuaggggacuuguuaguagauuacuuggcauuuauaaugacauuguauuuccauccuggcuaccaaaaaguggugacuucuagugcccaguacuagaggccuauguucucauacuuacagauuagccggcuugagggacagguucugagauauaaaacugcugcugagaaugcugagaaaguugaagaugaauugaaagcagaaaaacggaagcuacaacgagagguacuucuuuuaauauguuucuuggagaauacauuccuaaaaagaaaaaaucuucuggaaauaauucuuagcuguguaagaaauuugauacuuaaggaaacagcaguggagucacuuaacuaauuuguguugguuuuugaccugcauagugacugccauuuacuuuuauguuuuggucaauuagauacuaaguaaaaagauaguuuguauuuuugcuucagaucaggucuauuucuccaacuucuauauauccuuucugugauuaaaacaaauaaacaauccucaguaucaucauuuaacaccucuaacugauagaaaaaaugagguuguggguccugugcaaggccaucacaguuagcagugcuuucauuucccaggaaguugaaaauagaguagcacuggauguuguuucugaccacauguagugacugcauucucccugucuccaguuacgaacagcacuggacaagauugaggagauggagaugaccaacagccaccuggccaagcggcuggagaagaugaaggccaauaggacagcacuucuggcccagcaguaggaaaaccacccuucaaccugggugaugcuccuuggggcccuaccuagagggacugacuuuuguccauugacacaaaccccuuuuaguacuguuuugaguuuugucauuaaaacagccaccuuuguauuuuauaauuuaugacagaaugaagucauuuugaaucuacaugaaugaacacuuuggauuuuguuguaguuugauucuaggguagaaccaguccaugcuguuuuuauuuuuuaucuccguaauuguagaaucauguuuacucaacguuuuuccccagcugccucaguaacugggcacucggaggccuuggcacggguucuggaggacagacagcaauucuaugagugcucacugagauacuugcuggagaccucagaaaacacaagugccuucuccacggugcaauucagacuucagugaucuccaguggucaaaagacauuuacccuuaauaucagacaacauuuauauuuuagugaagaaacaaguucucggguggggaaucuauguuucacucagauuuauauguuuggaggaaaaaagccuuuuuuuguaaaauauuuaaauuuauauaagaaaauguuagaaaaaaauauggggaguguauauaaaacuugcuuuauugcauggggcaggggaaguccaggccuaauacuccuaaaguaagaguuggguccuuuuuuucuucaauacaacugugcuguaccuuguaaaguauuuuaucugcugcuuauuuguggaaugaaaccucaaacaaacccaaagggggaggguagggcagggcaggcagauuggaaaucugccugcagauucuauuaaauacacccuuuugccaaccacaauuggcuacugacauguucauuuuguuauaggagacuuuaaaacaaaucauggcaaccacaucccucuucuuuugucuccuucucaaggaaaaacaaucuggaauguagaacuuuuaaagacuugaguuucaccuuuagagguacccuguccaagagguuuuuuuaaaaucauggagugcaacuacuuugcagaauuuaugauucucuuuugcucuuaguacccaggugguuuuauagaaaugauuauuguaucuuuaaagugcuuacacagaaaauauauugggggaaaaucuagugacuaaaggcacauaagauaauaaaacuagacuuuaaaaagguaacucaaaagugaauaaaaucucuaauauuuguuccuuuuuuaauuagcccuucauuuaaaaaauauggauaccaaucuucugaauugagaugauuuucuauacauuuucuuucuuuuuuuuuugagacagaguuucgcucagucacccaggcuggagugcaguggcacgaucucggcucacugcaaccucugccucccagguucaggugauucuucugccucagccucccgaggagcugggacuacaggugugcaccaccacacccgacugauuuuuguauuuuuaguagagaugggguuucaccauguuggccaggcuggucuugaacuccugacuucaagugaucugcccaccucaaccucccaaagugcugggauuagaggugugggccacugugccuggccucuuuuuuuuuuuugagagacagucucgugcugucacccaugcuggggugcagugguaugaucuuggcucacugcaaccucugccuuccggguucaagcuugauucuccugccucagccccccaaguaggugggauuacaggugucugccaccacacccugcuaauuuuuguauuuuuaguagaguuaggguuucaccauguugcccaggcuggucuugaacuacugaccacaagugaucugccugccucagccucccaaaguguugggauuacaggcaugagccaccgugccucagccuauacauuuacuaauaguagcaaguugugugguuggggguggguagaaagguguucuaaagugcagguuuguucuagaacuccaucccagcuaaaaccaacacacuguguggcccagcucuugaagcucagaaaaccccucuuccucuccacucaagaucacccagccugugccccaccugggcucauggaaccucacuucugagaugcccuggucuacuuuauggaguucuuauuguucaaaacugaccuugccuauuuuguggcacaacaaauacgucuguaacauuuugucuuccuagucuuuccaagugaaauugcuccauuucuucauaagaugagaguagucuguucuuuaucacugaacuuucuucacugagucuuggaauauggauuuuaccuuaaaaccacagacauucuuccuuucugagcugaaugcuccauuucucuaaauguaggcaaauauuaaggaaguuuauuuugucacucacaguuuaaauuuauauuuuua

SEQ ID NO: 16157 - RNA, 1060 nt, Homo sapiens
uauuuucugugcuuggcucuaagccucugugucuuucuccacucuugcuuuucccuccagguagaaaagauccgccaggugaaagccaagucucuguaccugcagguggagaagcugcggcaaaaccucaacaagcuugagagcaccaucagugccgugcagcagguccuggaggaggguagagcgcuagacauccuacuggcccgagaccggaugcuggcccaggugcaggagcugaagaccgugcggagccuccugcagccccaggaagacgaccgagucauguucacaccccccgaucaggcacuguaccuugccaucaagucuuuuggcuuuguuagcagcggggccuuugccccacucaccaaggccacaggcgauggccucaagcgugcccuccaggguaagguggccuccuucacagucauugguuaugaccacgauggugagccccgccucucaggaggcgaccugaugucggcugugguccugggcccugauggcaaccuguuuggugcagaggugagugaucagcagaaugggacauacguggugaguuaccgaccccagcuggagggugagcaccugguaucugugacacugugcaaccagcacauugagaacagcccuuucaaggugguggucaagucaggccgcagcuacgugggcauugggcucccgggccugagcuucggcagugagggugacagcgauggcaagcucugccgcccuuggggugugaguguagacaaggagggcuacaucauugucgccgaccgcagcaacaaccgcauccagguguucaagcccugcggcgccuuccaccacaaauucggcacccugggcucccggccugggcaguucgaccgaccagccggcguggccugugacgccucacgcaggaucgugguggcugacaaggacaaucaucgcauccagaucuucacguucgagggccaguuccuccucaaguuuggugagaaaggaaccaagaaugggcaguucaacuacccuugggauguggcggugaauucugagggcaagauccuggucucagaca

SEQ ID NO: 16158 - RNA, 955 nt, Homo sapiens
ccuccugauugaaucaccuacccgaaaccuguuguaccaagagcaaucacuuuggaaucccugauuuaauagcucgguaucucaaccauguaauauuaaugauaacaccaugccuucugucuggauuaauuaacaauaauacgucugauuaaacuggcugauuuacuacggcugguacaggguggcgugugugaugacguguagauggucucugaccacggggcacagcuccuuagguagaucgggggauauucccagugugcacuugguguucguucuggcuggggugagcuguguugccagugccuugacaaaagcaggauggauuagccacuacccugucgcacacccucacguaagggauguuccuggccugcgggguuucgccuaggcagagggugaggccaggaagucuggggaaguugcuuguguggcuggaguuguacauuuuacaucugauccucauucccaguuuucaucugucacccagcuacacugguuuugcugugucagaguaucucuuaauaguucugacauucacuguguaggugcuauuucucaugcaaagaaauccagcucuugccagcaacuccuuuaguuacaugucaaacagaugccagucucucccuaagugccuguuuuccuuccaagggagugaaucaaguggucugggaacccagggugucagcuuuucaagucugacagagcagauucaaauguuuuguauaaggaaugacaguccuucuaaugccucgaaguuguuucuuuuugguuuuccagcugagcaucgagcaggcccagacgguggcggaacagguggagaugaaggcgaagguugugcagucggaggucaaagccgugacggcgaggcauaagaaagcccuggaggaacgcgagugugagcugcuguggaagguaacagggagagcucccccacccaggcugugcccacucg

SEQ ID NO: 16159 - RNA, 105920 nt, Homo sapiens
cccccugcuccuuucggcugggcgggcggcgggcuagagagggaaugucauugcuucucagagccguggugccgccuccgucugcugcuucuuuccuggcgcccucgucccgucggcuuucgccgccgccgccgcagcugcacuggggauacggauggcuaguggggcgccggggccaucuggguugagagagcggcgauugcggccgcugcugaggcggagacuccccgccgccgcuuccuccacccccaguccgccggccucgcggcgcugagggcgggagcgcgcagagcucuucccuccuccuuuuucuuccuccuccuccuccuccuccggguccccgcccagcaccccucgcaccaggcggcggcggcggaggaggagagcuagacccgccgccggggcacaacauggcggagcccucggccccggagagcaagcacaagucgucccucaacucguccccguggaguggccucauggcccugggaaacagccggcacggccaccacgggcccggggcccagugcgcgcacaaggcggcgggcggcgcggcgccgccgaagccggccccggcggggcuguccggggggcugucgcagccggcuggguggcagucgcuucucuccuucaccauccucuuccuggccuggcuugccggcuucagcucgcgccucuucgccgucauccgcuucgaaagcaucauccacgaguucgacccgugguaagugccucgccgccccucccccgcccguggcccgcggggaaccgggacccgcuccuccgcccgccgcagcucuccucgacuuggccccgcgccgccgcggagccccgcucgcguccuggcugaggccggcgcggaucccggagcuccgggcgcgcccccugcccgugggcgaaguuugccccgugcagccugaggcggggcgucgggguccaggagcgaaaccuugauucucggccgggcuagugugaagacugccaggaguguggaugcagccgccgggagugugggugcagccgccgggagugugggugcagucccucgcagcccgcuuuggucgcugaguccggacccgccacgccaggaggcggcagguagcuccuccgcggacugucggucgauuccccgcccuccucgcccgcugcuuucgcguucuuucauauuugcgggcgcguuuuugcuaguucagacggaaucggccaggggggcugcccuguugccgcuggagguggguccagaugugccggaaccccggcugcucacccuugcaguuuuacgcuuuuacuguuucuuuuuaugcucucaugauacgagaagggaaaaggagagugaauggcguguuggagggaaggaaauaauaccccugaaagugaucugaaagcuagcuacucuuauuuauuuaucauuagguauuuuaaagaguggcuuuuuuucagagcucuuaagugcacucagcaccuuacuguuucacuaucgucuuggguugcuuuuuagaacaagauccuuacccuguuagccacugucacccuuaguguguuaugcacaguaucugaaagcauugcauuaguuccuuuauuggucugcaggaagguuuguggauaagagcaaacaguaccacggugaugggaguccuagauuguaauaccgaaguugcacaugguguaagggacugaccugaauguuuuaggaaauuaccccacucuuaacaacacuagcuaacuuagacacuacauuggucugugaauuaucuagauggaaagauugcuuuaacuuuuuuuucgcaacuugcccaacccgaguuaggauuuuucccccugaguuaggauuuuccccucugagaguaugccuuuuaaacuaguguuaucuuauugaccugucaaccuugaguuaaucuuacuuccucacaguuagaccuaauuaaauuucaggauauuuguuucaucauuugagauucaaagagagagagucuuuuuugagaguuacuaacuauauagauaauaaguguucggguggaggggggcaguaacuuaccuguauaguaauauaccagauuuaaguucugcauuauggagagaaaaauugguacugcaacaucuauugaacaccagaggggcccacucauggacaauucaauuuagaucaguuaauuacugugacagucuuccaugaaauguuuucauuccauuuuagaaguuuugauuuuguuuucuaacacuaguuuuuuuaaaaaauaaccuuuuuguuaacgugcaaucacagaagaaaauauguuaguguagacuauuuaugagccuaagaauaccugugaaggcuuauugacacaauauuauuagguggucuuguuuugaaauacuuaagcaaguuagauaaaaaugaaauuggaaccagaaaaugaaaacuaguauuuacuggacaauaugaaaagagaaaguucucuuuucagauuaaaauagcagaaaugcaugguugaccaaacauuucagguaacaaaauugugaauauuuccauaguaacauuuuuacaaauggaaggcuaacgacuguuuaauaguaacucuggggcugaaauuaaagauugcagaaaaauucacuacugaaugaugagauuuuggucauuuuuccuuaagauuagaaaucugcaucaagucagccaaagauccccacuaaaauugaguaaugcaauaaugaaaaggcucaacaaguaaaguggcuaauauuuuuauuuuuuauuuuuuauuuuuauuauuuuuuuuuuuuuaguguagcuaaguauuaaaaguuuucuuuuuccagcuucaguagugugguuggagggcauaauucuuuuucaugcacaugaaaauauguuuuggucgggcgcgguggcucacgccuguaaucccagcacuucggaaagccgaggcagguggaucaccugaggucaggaguucgagaccagccuggccaacauggugaaacccccucucuacuaaaaauacaaaaauuagccgggaguggugucgggcgccuguaauccagcuacuugggaggcugaggcaggagaaucucucgaacccgggaggcgaagguugcagugagccgagaucgcgccacugcacuccagccugggcaacaaagagcgaaacuccgacucaaaaaagaaaauauguuuugcuucauuuuuuauauauaugaaaacgcauuucugacacauuaucauuuagcuaaauuuguaccauuugaaaguauacaucucuguuuuaaagagcuacuuaauuuagguauucugcauauaguuuuaauguugacauuucuuaauuaaauguuuauauucauaauguuagauaaucuugcuuaguaguaaggagauuuguauaauaauggacugucuccugugccuuaccgugaauggagauuugucaguaugaaucuaauauaaugucuaauucaggugacuuaaugagagaaucagguuucagacaaaaaaaauaccuuguucuuguuuuuuuuucaugucuuuugaagaucucacguaguuaggcaucucauucauucuuaucugauucuuacagucauucuuuuugaaaagguuaaaaggagggggauguguagauugccugccauuauuacuuugggcuuuuaaagcuuuucggggcuuuuaaaucuaguuuucuucuauagcuacuaauagucgcaacacuuuaacuggucuguagcugaacacucuaguguuucuaguuugggaguugcucagaucaccaucauaucauauagcaauggcacagaccuuuaauaauauuuaaauguuacucucaggcugugcauccacaaaccgauuuauucuggccugcucauaccuucccugaccucuuuuuccauaucucuaucaaugguuucauuucugcaagucguuuuagugaaggguuuacuuucucugugagcuauuucuuuaaauuuuacaguaguucuuaaauuguguaaaagacucaaguuagcugcugaaagugacgucacagaguuauacuuguuuuuuaaauuugucacccaaguuauuuaucuuaccaguugucauaaggggugaugugugauuuauuuauugaaguacacugcacuuuuuuaacauuuagcaacauuuuugguaacaauuugacuucacuuuaguaauuccucccuuaucagcugaguugaacagauaggaggaagcaguuugaaaauauauugucuguacuugccaaacguuugguuaaucagccacuuuaacagcacuuaacuauaccuuuuuaucuggaacaaaauguguuuucuacauauuuuuauuguaagagauaauacuuuuacuuuauauuagccagauaccuucuccauauccauuaucuuguucaauugugguagccuuucccauagaagcaaugaaguucccuaugugagagcucuuuuuucccugccuuagcagguuauaaaguggguucucccuagagagaauucucugagccuuagguuuuggcuguaguuagcaaaaaugcagcagacgccuuuuugcugggcagaaaguugcaaguuagaguuggaacuuagaaugcaauuuuuccgaagaaacuaugguauaaauugguuaauuaguacagauguguuuucaaaggaaugauaaaccuuuggaacauaagcuguuagaaguuggggacuacuuccuguacuuugaggucuccauguuuuccuucacuuugcagaugacaaaaagaggcuguugaccucaguucugaagaagacaaauugguagccaaaccaguuuuagaacacaaacguccccaaaucuuaaaaagucacuuugugggaucauuagcaucagcaguccagcugcacuucagaccagguaucacuguuacugauugcauugacaauuaaauuguaugaauuuaugauaagauuggugcuacucccauuucgguugagugugauggcuuccauaaguaguaaucauagauuucaugauguauaggcccuacgguaguuagggucugucaugaaugcccuugggacuuuuccuucccccuuuaugguuuucauaucguaaagguuaacuuggguaggacugcaugccccuuacugccaugaguaguuugcauaaagacaacauugguuauaaacauuagaagcucaauauaaggauuuacaucauaaucucugacccaguuguuaaugaauaugggcuaacuuaacuagcccuucuguaccuaaucaauuuuuauacucucuauaaguuuugaguguuugagaaaauguuaacauuuaucuuuauuguuauaucuuaguauucgucugugcacacgugcucuccgaaaugaaggauggaaagguuaauauuauucucaagugaccaaaucauguuuuuccccucaauuuguuuacuuuuaaaacuuaaugaucuuagggagugaaaauacugcaguuaacuugaauuauaaagaccccacaauucaacagaccuauugcuaaacuauuauaaaaauuuucaaaugcacaagaaaguugaauuuuauagugaacacucauauacucuaaccaccuagauucuacaauuaauauuuugcuuuagcauaucuuccuauccauuacuacuuuuaaauccugcuuguagacagacauuguuacuaugauaugaagaaugccaucuuuguuccccaacaccaugauaaagaggauuuauuucuacauaguguuuguuuucuauauuauuugaacauauguauauacaugcuguuucaguauccucagagugaaguuaggaucagauuccaucauuccagguuuugguuagcaacuuaccugagugcauuguaaaucagugcauuagccccacaucuguuaaaugacuugaguuugcugaaucuggugucucagaagaaacucuaaagugguuagauggauauugauguugauguugguuuuguuagguguaauuuaugugaaacuccuaaauuccuugaauuauuagaaggcuuuuauaggucagccuguugucucugccaucuuucauccagagguaaugguuuagcuuuagugugauugcaacagugacuucuguaaaucccugcaauaaauaggaaaaaagaaaaacauuuccaaauaguauaggacccacugauauacuauaugggccaaauuaauacuguugaaaggggaaaaccuguaaaugguuaaccugcuacucugucuucaaccgucuaucuaccugauucugguggaugcuuuuuguauuuaaaccaguaacucuucugagaaggcuucuguuguccucuucuuaccuacuucugaccaugaguaauuucugggaauuuagaaauugauagaaaguggaauacuguaggguuuuuuguuuguuuuuaaagucgaauauauuaggaggugaggauuagcguugggggagauaggaucaguugcccagaggcucccauauuuagguaaauguauguuaaucugcauuuguaggcuugccaggaaaucuaaccauuauuuagaauuuuaugucuuuggaaaaauacuuccauaguuucagaugaaaaacaucuaaacauguuuuggaauauaauguguacauaaauuagugaaugccucuuuauguuguucaagguuguacuauuuguagacaaacaaaucucuaaacaauugugacuguuggcacuaauugaccacucucaaccaugucuauuucuuuucuuucuguggaauuuaauguugcaagauaacuuuaauauauguucuaaaugauaguagaugcuuaguuuuuacaguguuuuacaauccagugacaucuuagaauugaggagaugagguaacaucuuuuauuuccauagacaaaagauaauucaauucaguauuucccacaagaauugaaggauacagaucugccagauuccaaagucuguuccucuuaccacacccucugccuccagggccagcuuaaauaaaaguguccucuguuuaauuuauguuuuuuauucaggugccccaacuuaagucuuaaaauacuggucuaucagaauaccucuucacaauccgggcuguagcuaacuaagcuuacuaguuggauaauagcugauuacuuugauuguuuugauggagcgaagagaugaguugaugguuaagacuuuuaaccuucaauuacuaugggauuuucggaaacucugaagagaguagcugaaugagaggaaaagaugaucaaauccaacugaauauuguucuuauuuagauuuauuuugucuauaaaaaguucauaauaaugagauuggaagucuuaagccaugccaguuaagggaauugggagauggagagcugaacuuucagaguagacucagaauucuauaacccacaggauuuuuaguguauguguuggcccccuguuucuauuuucuaagaagcuaaggaccagaaggauaauacuuuuucuaaggugauacaauuauagcuuggcuagauucuuuuccauuuucuuugcaccuauguuugcuguagaagggaauauuuugagaagucguuugaaauuguuacuucagaagaugaggggaaguuacuuucuaccacuuaguuuaaauuuacaauaucguaaauguugacaauucaggcuuagauuuggaaacaaauagagcuuuugugugaagcuugacucauuuggaauuauuuaaaaaaauuguguguacugguugucuguaaucuccauaaauuagcaguauaaauuuuaaaacuuuauucuuuuuuaccuuguuugcucauuccuauuaaaagggaaauguuacugcaugaagacauguaaaggaauuuuguuuauauuaguaaaguguuaaaguauuaaugauuaguugauaaccaaguugauaauauuuucuuuugggguuuucuuuucuuuuuuguuucaugccuuacagauuuauuagcuguucucaaguaaagacuuuucuccccaguaugguauucuuuucuuuggugauaucuagcuaucccugcaaccuauaaaauccuucaaaugcauuguuuuaaacuuuaaauauuggugcuuuguuucacuuucuguccccugccuccccgccccacaauagauagauaauguuguagcguauaagauauacauauauauacaaauacuaauguugaagguaaaauuuuauguuguugcccauacuguuaaaaaaauuaaaauguagugugauuuuucaaaauucuaguauauccacagcuuaaauuauuguuuguugcugaccaaauuuaucuuuaggagaacacaggccauaaggaguuggagaaaaggaucauaacuggaaacucacuugugaccaccaugccuaccacacguuuauuauuugaugccuauucuuaaaauaccaguaacaccuguagacuauacccaguuuaagaagguuuauuauuaaaguaaauuauuauacaucuuauuuauguaacccacaucagaaauggaguacagaacuaugggaggcagcacucuuguacaguuauauucuuugaaaauaagucuuaaauguuucuauaaacaagagcaaagaaaugaguucugcaaaggauuucauuagaggagaaaagauaauucaguuucaguuuuuaaagcaauuuucuuuuaugaugaaguaugacgcauccugaaaaauauaaaucuaaaguauagugaacacccaugugacuauuacccagaucaagaucauugccacuaccuuagacgaccugguguguuucucaaucccuuccacccccugacuuuauagugaugacauccuuccuuuuucucauaggugguaaacucugugugcauugcuaaacaauacaauuuaguuuugccuauuuuuaaacuucagauaaauggaauuguggcuuuugugucuuuuuuuuucuuuuuuuguuuuuuuuuuuuuuuggcugagcauuuucuuuaagauucauccuuguuggucaaaggauuguugacaauauguacguaaguaauaaaguucagcaauaauuuuuuuguuuguuuguuuguuuuagauggaguuucucucuguugcccgggcuggauugcaguggcgcgaucucagcucacugcaagcuccaccucuuggguucaugucauucuccugccucagccuucugaguagcugggacuacaggcgcccgcgaccaugcccggcuaauuuuuuguguuuuuagcagagacgagguuucaccguguuagccaggauggucucgaacuccugaccucgugaugcacccuccucggccucccaaagugcugggauuacaggcgugagccaccacgcccggcauuucagcaauaauuuggcuaaccaggugucuuauucaccugacgggguugccuguucuuuuauagcgggaggugccucuaggaaagagaaagggaagguauuuuucuuuucacuugagauuuaaaaaaauuaucucaaggcugaacccuugagguggagucauccuugacuagaguaacuuugacaacuuuguuuuaagguacuaauuguccagagauuuaauuuuucuacagaaaccaaaaauacaagaaagugggugggagagaagagagagacaucgucuuuaaggagacaaaugauaaucagauaaaugcaaaaugacugguuuuaaacuauggcuuuuugucaacuauuaaaguauuguauauuaaaauuggcauaaagaaggcauugguugcuugauacuucuugaaagcaggaaagagaauacuggaacuggaggucugagcugaggaauuuaggaaaacccugggcauggacuguuugcuguauugauauauuuguagagauugucaauccugguuuugagguauuuuguuguuuauuuguguagauguagcaauuuugcauauauugcauuucugucauaguuaauucuuuguugaagaaaaauuuaaaucuaggacugucuuucuucaaacucuguuuagucagccaguauuucuacagaauucaaacuuaauauuuaaaccaagugucuuaggguggguauacguacuguaucccaucuucacaaaaucccauguguaccugccagagaguaauauaaauggcucaaauuaggcucuauuuggaugaugguccaacugagugauuuaagcuauuuuuaacgccucuaguguauuucuuguagaauuccucaaauggagauucuuuucugagauauauugacuguuaagaaaaauuccaggcuggcugggugugguggcucacgccuguaaccccagcacuuuggguuacacgaggguggaucaugaggucaggaguucaagacuagccuggccaacauggugaaacccugucucuacuaaacuacaaaaauuagcugggcauggugguaggcaccuguaaucccagcugcucgagaggcuggggcaggagaauuguuugagcccggguggcagagguugcagugagccgagauugcgccacugcacuccagacugggcaacagagugagacuccaucucacaaaaaaaaaaaaaaaaagagaaagaaauaaauuccaggccuacuucucucagaaaucacaauugaucaucugugucuuacgugagaggucuagguacagguuuuauuaauacaaaacaaacuaaauuuuacuuaggacuguuuauuuggcuaacuaggccagagccauuuugaagauuuuaacaccugugcauguaaaaacacucaaggagacuuaaguuauuuguucuuugccaaaguugguaagguacuguuaugauuauuuaaauuuuggugcucauuuuuccucuaaugaauauaauaauaacuuacuacuauuauuguagggaggcaaaagauucuuuaaggcaagaacauuuuucuaaucuuucuagaauauccuacacaguauuaggaacauagugagugcacagugaauauuaagacagauccuuuaucuuuaaugguaaccacauuuuauguuuuggucauaauaguaauaguacaguaagucucuguugugcaauacuuugaaauuuuggauuugacugugaugucaguaagaucacaugugcagugaacaucauaaucccaguuucaauacacaugucauauuauucuuuauagaagaagggaagaguugaugaagaaaagggauaaugcuuauggaagaaaugguauaugugagcaucaugacagccaucaacaauugggagaugaauggcuggauggauaacuuaggaagaacuuugaggaagauuuuaguuucuugaguauuucuuccaaguacaaguaacucuuacagaggucugucuccaguguuaacucacuaguuagggaacauugaauaagagaagacagaccaguuaauauacaaaaaccauaugaguuaugaaaguuuuauuauuuuucaaaugagaaaugaaaaaagacagaugacagcaauagaaguaaaauucacaagaugccauuuuaauugaacuugagaaauauauucugauacgaaggaauaguaagaauugaaauuaucauugcauacauaggcauuaguuagaauauacuaaauucaugcacaugaugaauuugggugggguuggauuaaugauucauuugguuucauggcucuugauuuaacuuuaugauuauaguuaauuaauaugcaaauuaagcaacacuuuaggaaaccaucacagcucugacugaucucauuuaaacuuucccauaagagguuaaaggauacuaaauaaaaauacucauuagggauaaaauaaguugcuugucuucauuaaagugucuuugcaauggaaauagcuuuguucuugucuaauuacuggagaggaucauugaauauuguagauauuguggguuaaauaaaccagauaaagucuuuauuuucuuuuauuaugcauugaauccugacaaaauggucagcucuuuaguuauagaaucauuccauguaauaauggcaguauuccugugaauccuaaaacaguaugcuguaaugaucucacaagauguuuuugcuuuuaaaaaugugugcuguuuuaaaaacaaaucuuuguccaucagugugccuuuaaaaaaaucuauuacagugagcaggguuuguugaagacauugacacuuaaagcauuugcacggggcgcgguggcuuaugccuauaaucccagcacuugggaggccgagauaggcggaucaugaggucaagaguuccagacuagccaguuugagaccagccuggccaacaugaugaaacccuaucucuacuagaaauacaaaaauuagacgggcugaggcaggagaauugcuuaaacccaggaggcagagguugcagugagccgagauugcaccaccgcacuccagccugggugacagagcaagacucugucucagggagcggggggggaacauugcauaugcucuuaauuuuuaaaauuuaauaaccuuguuccauauaaguuuaauugcaaucccaagaugauuuuuacucuagaccaucgcuaaagaaggcuuuuauuuuaauaugcuaagcagcuuuauggcauuugaaggaacaggauaaugaaacugugaaguagaugaaauaaaucuaaucuuaaaacuguaaaggccagucauaagucaugaguuugaggagcaacuaaaaucuuuuuaaauaaggauuuuuuucuaaaguuguuaaaaugaaucagucacuucauuagaaaggaagaucuuuucaccuguuuaaauacuuuauuuuggcuguuaaaauaauuuacugcauuucaaugaagugucaaauagaaacagcuguuauaugaaagguuuuccuuuuggaauaaucauucuggacauuugaaaagaguauguaacauuaagugauguuauaacuguguaagaaucacaacauaauauacaguuauaaauaaauuuuaaauaaauugaaguauauuuaacauacaacuugcauauauaaugggcugucauauucuauauauaauuauaaaacuuaaugauaaauacuugugaaccuccuagccaaccacaaaaccagaacauuaccaauuuuacaucuggcuguguuucuucuuuagccuguccccuuaguuucccccuuagcacuaggcaacauuaugcugaauuuuguuuaacguuuccauugcuaucuuuuaauaaaacucucauauguauauaucuguaaaccaagcuuguccacccugcagcccagagcggcuuugaauguggcucaacacaaauuuguaaacuuucuuaaaacauuaggagugguuuuuuuuuuuuuuuuuuaagcucaucagcuaucguuaguguauuuuauguguggccuaaggcaauucuucuuccacuguggcccagggaagccgaaagauuggacaccccugcugugaaaacaauauauugcuaauuuuugcuuuguuuggagcuuaaaaaaugguauuagcuuauuuauccuccucuuugacuuucauuuauacaucuguuaguugacagacauuugaauauccaguuuuuuuucuauugugaaacaugcuacuaugaacauuaaaacuguuuucugaugcauauguguggauguuugcugggguauauaccugggagugggauuuugucaaaauaugcuucaguuauuuaugaaaauauaccacuccaaaacuuagugacaaaacagcauuuuauuauuucacaauuuuguggguugaguggggaguccuucagcuucaugugucagcugaggugcugagaugauuguagucaccuggaggcucaauaggcuguagucagcugggacuagaauguuugggaugccuggacagcugagagucaucuggaaucuuguuccauugggaccucagcuggggcuuuuggcuccuccaugugacugcuuagucugccucagcauugcagcgggguucugagaaagaacauuucaaagggggagaaagcugccaggucaacuaaggguuaagcuuggaauagacacaaguaacuucagcuauauuuuguuguucucaaaauacacacagaccuagcucaauguugagaggagaugcauauacagguaggggcagaauuguuuaaggucaucuuuggaaacacuuaccacaauguguuuaucauuuuuaucucccguaaaauaucuguucaugucucucccaaaguuuuagacuggguuguuuagucucacuaauuuaguaggagguuauauguauauguauuuugcauccuaagucuggguuaaauuuguugcagauaucuuauuccaguuugugccuaauugguccuuaaagcaauccuauuagauauuuuauugcccccauuuuacagaugagagaguacugcuuaguauguuaaaaggaaaggccuugaagucagccuccagggugacauuuuuguuacaaagaauagcauuugcaaagguguacaauuaugaaucagcaugaugcuuugcucaaccuaccuguuguaccccuuccccuccaaauaauugaggcuuggaagaauuuacaaguauuuuuauuuacuuauaaauuuuuauguaacugugacuuuugcuaugaguggacugaggacguuugaugugagaggacuugccuggagugacagaguaggcaguaaguucagccccaaguucuuucuagucuuaucugcccuccuuauuccucaauuuuuuuucccuaaauuauucguuuggaucaaccagguucugccagcauauucaaaauccaucuuaaauguaguggcgaaauauuuugcaaaauuauaauagaagccagagauuuauaauuaauauucaaauguuugcauuauauacuuuaaaaagaacauugcaggucgggugcgguggcucacaccugucauuuccacacuuugggaggaucacuugaggucaggaguucgagaccagucuggccaauauggugaaaccccgucucuacuaaaaauacaaaaaaucagccgggcaugguggugcaugccuguaaucccagcuacucgagaggcugagucacaauaauugcaugaacccuggaggcggaaguugcagugagcugagaucgugccacugcacuccaaccugcaugacagaacgagaguccaucucagaagaacgcuguaggcacgcaucaaguacaacucaguugguuuaaacugaaaugccacagaacaauucugaauuccaaaaugcaaagcuuuggauaaaacagccugaacaaguacaaaaagacaauaaauuuguagacacuucuucccaaccuucaaauuaggaagauuuguucuguguaaaaguauaguuucugauccuuaaaauucuauguguugaaggcaccucagcauaucucugcaguguaaaagcagugcuucaggcagcaugacuuauuuucaugucaccucagauuucuuggaucuaauauucaaagacagaguggaaauaauaauacuuaguggaaggauucuuggacauguaaugaaaugcagagcaucuugagacuuuugaccaaguaauguuuggucauuuaccuuccuguuugguuggaacaggaguggugauuccagccauugcaugauugagccucauuuguuuuuauucuuuccugccccgaauucuuccauuuuaagugucuuaaagagguaguuauucuugccuaagaaguaaacuaaaguauaacauauuugcuauaauaaugcugauauaauguuacugugauaaaguauaagugucaaguaguuuggcaaaaagauuucaccagguugagcauaguaacacagggaaaaugagccauuuaaaacagggaaaaaaaauguuucugugaaaccggggagaaaaaaacagccauuuuuuucccuguuuuacaaaugacucauuuguaaaauagggaacaaaaugagcccauuuaaaauuuaauaaauguauuuuuaacauuuguauucucaaaauaaauuuuaaaauagaguauaccaaacaugcuauucucugaggaguuuaaugcauguuauuauuuuacagaaauuuaaguuauuuuaaauauguuaaggaugguaaagcuucccuauaguucaguauugaccaccucuccucaaccugucucuaaagguaggagaaaacugauuuauucuccuuguauucucuucuuucucugcuccgucauuaguuugcugauauuuucuguucggaaagggggugaagaaccuuccccccuuugagggagauaaguuuugguuucccuguaauauggaacaaacuucauaccuggcgagcacaaagaaauuauuauuuugccaaaguauguucugcagaccacauauuccagaaauuacacuucuaagcaaaauaaucuuugauaauuugaauuugggaaaaaaacugcuuacuacauucuuugauacugauaugcaauacacauuaccauguuacagucuuaagaaguuguucaguuaacuguuaauuuuauuuaaucugguauuuaccguauuuaauuuaugaaucacuguaagauuuuaauuuuuuuuuaauuaauguuccaugcaauucauggaaaagacugauguagauguuuuauuugauagaugaggagccugaggccuaaggcuaaguaacuuuaccaaagucguagagauaauaaaacuaggacugacuuucuucaguguuuuaaaucuuuuuauuuguuuauuugaauuacugcauuaggaacaaguauauccacauuaggaacauacuuuuuuuuucaaaugggacaguugaguaucugcucauugauagcauccccccugauucuccugauuugucuuggugacuaaguugaguauuauaccacuaacuucuaugauaguuaaguucucaggccuguauacauugcuuauuuugagugauuguuuuauuuuaguuuaccuugugcuguugcuuuccaccgagacuguccucagaaaguuggucauuuugcuuaugaguuuauuaguuguccaaccacuuuggcucuuucaucacaccaacuugugggccaugggauauuauuacuauggauaaugcuuguuaguuauacauuuuauauuuauaguauaugacuaugggucugacuuaaacguguauuauguauuucuauaucuaauaauuguuagaaauccucuuuauauaguauaaugcauaaucauaugucuaauuuagauaauaucuaguaacaauaaagaaauguaaauauaacauguuuacauauaauauuuauuggagauuuguuucuauaauauaugaauaguuaugccggacuuaaauauauguuauacacguugugcgugcguuauauaaagagaaagaacacuugugcccaucccuucugccuacauuauuuagauuuccaucucuauugggcuuagcugagcaaagugucaccggauaguuuuaauugaucaaauauacuauuuuguaugugaucuuagauuuuuuuuucagauuuuuuuagugccauuaaaaugcucuaacagccucuuauuuuguuguaauuuuuuuuguugucaguugcuuuuucuuuuuuccaauuaguuuaguaaauguccuuuauaaaucagaauagacccuccuuuuucaaauggauacugauaaaaauugacagcugucacugccaguuaaggcagaaauuaagagaugguacuaaaauaggaauccuguuuucaguuaauguguguuuaaaaguuuugcccuguguguucuuuuuugauuugcacaugcaucugacuuuaaauuggaagaugcagaguagcucuaaggagucuucaagacauuuuugcagccuuuaaacaaccuuugguuuucucucuguguugcucaaaguagagagacagguacuuuguuaucugaagcuuaugacaugcucucugcuucaaucaaaaugaccacccaucaguugcaagagcagagagagagguuugugagaguagucugagauccaguugcaacuguacagugucacauuuauggugguaugacauuugugagucuuucccuucagaguuaaccuaguaaaaaaaguuauucucauauaucauuaguaauccuuaugaauuucuaucauuguuuuccugcuguuacuuaaacacugauaggaauuuauguaaucauauuaggcuugagcauaacucucucaugaguuuccauauuuuaaguuauaaaauuggcuauguuuaaugugauuaucuagacagugcucguguguaucacuuggugagauugaauuuaggcuguuuuuuucguucuauugaagggggauuuuuuuuuuccauguguuacuuuuaauagaguucaucagucuggcauccuuuuguuuuugauccugccacuagauggcaggagcaauaaaagguagauugaaaugccaacuuuaguuggccuuagcugcuuuguacuuuaccuugguuguucucugucccuauuagugcugaauuuuggguauauaugaaguguugcaaauagugguacuuaguccuauaagaaagaucugguaccuuauauagccugagagggccuacuaauaggguaaaggagaaagaauagaauaauccuugagguguucuaacacuuugucuuuugccuuuuacuuuucuauuuuucuucucccuuuguugaauuguacuccuuuccuuuauuuccugauugugguuuuuggguguuuuuuguuuguuuguuuguuuguuuguuugguuuuugauagggucuuguucugucacccacaguggagugcaguggugucaucucggcucacuacaaccuccgccucccaggcucaaaugauccucccaccuuagccucucaaguagcuggcacuacaugcgcaugccaccacgccuggcuaauuuugaaaaauuucugguagagacagguuuugccauguugcccaggcuggucuugaacuccugggcucaagugauccacccaccuuggccucucagagugcugggauuaccugcaugagccacugugccuggccucuuuccugauucuuuuaugcuuacguuagcauccauaauuggucauuucuguuggugguacuagucgcuuucucauuuaccguucccacgaauacauguuaacuuggccaguuuugguagucguauguguaacaacaaacuguuauagguggcuuuguaaaucuuuacagaaaggguuauuuucaagagagccuguuaauugauagucuuugaagaacagagugauagacagagucuagggugaugggauguugcuuccgugauuaugugacguuguguaaaacuuugucuuaccaguagacuugcaccagagacuccuugcuggcauuauaagauaagcagcccuguuagggaagccuauguggcaaggaacuacuaacagccucuaugauguuuccaccaacagccaggaagaaaccagggccccucaguccuauaaccucaaggaagugaauucugcuagaagccugagugagcuuggaagcagauuauuucccuaauuuagccuccacauaagaacccaacccuggugacauccugaugucaaccuugugcgacccuaaacagaagauccagcuaaacugugccuagauuccugacccaugaagcuaugauagaauuaguauauguugguuuaagccacugaguuuguuuaaaauugcuguauaagcaauaggaaacuaauacaaauacccuucguaaaccuuucuuuccaucucugaauguuacuaccuaacuucucucugaucucauguaaucaaaaaauauugauugaauaccucuuacuugccagggacuauggcuacaguagugugaacccaaauagacaugauucuaguuuagugagggaguuagacuugaaccaguaagaaugaccaaugcugucaaggaacaugauacaaugagagcuuauaauagggagauaaacuaaacacauugucuuuuuaggaauccuuauuugacuuuuaaaaacuuauacuuacuacauugcuuucuuaccuuuuuuuuuaaagcauauuucugccaucacaaaacuuguucuaucuuuauuuucuguuagcauuaugaaaacuaccuauguguauuuuuuaacccuuacgaguguucuuuccucucucaagaacacuucuccucuuuuccugccuuuuugcucaauaauucauccagguuuaaguuagaugucaguuguagaagccauccacgaguccuuuggacaguaagcuuugugaggacagguccguccuguuugcuaguaucuuuagcacccagugugauacauaagauaggcucuuaaaaccaaauaaggccgggcacgguggcucacgccuguaaucccagcacuuugggaggccgagacgggcggaucacgaggucaggagaucgagaccauccuggcuaacacggugaaaccccgucucuacuaaaaauacaaaaauuagccgggcaugguggcgcgugccuguagucccagcuacacgggaggcugaggcaggagaauggcgugaacccgggaggcggagcuugcagugagucgagaucgcgccacugcacuccagccugggcgacagagcgaaacuccgucucaaaaaaaaaaaaaaaaaaccaaauaaaacuugauagggaggaacuggaacuccuguacauugcugaugggaguguaaaugguaacuauuuuggagaacuguuuaguauuucuuaaauacgugucuacuauauaacuuuggaguggaauugcuaaguauucacccaaagaagugaaaaccuguguccuuaaaaaaggcuuuuacaagaaugcuuguucauauuuuauaagaaugaauguacagccuuauuauuuccucccccggaaacaacccaaaugcccuucagaaggggaauggauuguaguaugcauuaaauggaauacuacucagcaguaaaaaagaauaaacuguugguauaugaauauaucucaaaaacauguuaaaugaaagaagccugauucaccuuuuuaaaaaguagaauuacgauuauuccauuuaucugaaauccgagaacaaacauaaugaaucuauggugaaagaagucaaaguaugcuuggaaagaagugccuaaaggugcaugugggaacuuucaucaugagggugauguuaugcauacaguugucaaaccucaucuaaugaaacaugucaauugguguauuuuaaagcaucuaaauuauacuuuagauuuuaaaaaugaaaaaaaaugagcgaagaagguauccuuuaguacccccuggguucucugcuuaauuauauuuucuuguugccucuuccuccugugagauugucagcucugugaggucagggaccaaguuugccugugguucuuagaauuguguacuuguaugcagaaugcccaaguuuauuggcccugaagugaauaguuauuugagaucuauaaucuauucauagauuauauccauauuuuauggcugcauuuuuaagaaaaauauuugcauuauuacagaaucuuacauucaguguuuuucuuuauguagcuucuagcuuuuucuguucuaggauucacaaaagacaucuguuuaaguguugguagaguagucuugcuccaacuacaauuuugccaaccacaguuugagauagcacagugcuauauuuguaaaccaaaguuuaaaaaucagauuuuaagaaacaaauugugguuuauuuuauucuccuuaaaaaaaugaaaacucaauauuaaucuuguuuucuugugaaucccuuccugccaguucuuaacuuuuugagccaauggaaaaaaugagccuuggucauuuaaucuuuuugaucaaaagcccuuaaacaccagaguaauuugaaaaagaaccaggugguuacauagcuuuuugucuaacuaguacuaucucucguuguuguuguuuguuuuuguuuugcuguuuuguuuucccugaugaaaauaauacuaaauuuuaaaugauuuaauggccgugucaaaaacuugaaagauaaguguguagauagucugaauuucccaaaaccgcgucagcagcuccaagguguaauuucucugaaacuuuaagaagguaacucagagcagauuuuucagugcuggugaguuuuaauuuauucaucaaguagauggcuuuuuauugugauuuauguuggaggucuucuaaaaaauaauuuugaaauucugcaaaacuuuuaugcacucuuuucugguaagagaauccauauuuucaucagauucuuacagacccucacccagaaagauuaaaaacccugccuuuaccucuauuuucucuaagauuuuuauuuugccagcugcugguuuugccaacuuuaagaaacauaacagcccuaaagucaacaagaauuuauucuauagugauuguuuaccuauauugaccaucaguauguauuugauauguuuguugggucuguuuucuucaugauuguuuuuacucucuuuuugaccuucuugggugcagaacuggaucauaauuacuggauuccacugacuggccucucugccucuguguuccaaaccauuccagacauauaagaaugaugaaaaagaaauauucccaucagcauaccugguuuuuguuuugcaaccucugguuagaauauacuuguucucaauuauaguaccaauuuuguggggaauauauauccuucuuggcaagauguuuaggaaugccaaaaucuaaaacuguguggcugcaugcauauccugucaccugcucacuuacucugugcugccucuauuucaaauccucuuguuauucuugaggugguuccuagcuauaaaaaccuaugaaaagauaaaaauaacaugauucuugcaaaaaauuguuaggauaagcuuuauauuuaaagaaaauucaugagucugcauuuugauaucuguauucuauuuuaagaacacuguuagauguugauacacuuaaucaaaacuuaauuugauuaaggaaauagcguuucuuucuuuuucuccuugauaguucuguuacuccugcuucucuguuuuggcccugauugcugggaaacuaagucacauuacacauuugaaucauaggcccuuauuacuuaaauauuuguguguuuuauccaaucucaacuuauuuauacuugucuuguucuuuagucuuuuuacauuaucuuuguuuuauuauguauuuuuguggaaccagaaaagugauaaacuaggacacccuuaaaggucucagaaucuuaaacauuaguuaacaucacuuuauuuuauugauauauaauauuuuacauauuuaaugguguacauaucauauuuuguagcauacauagaauguguaaugauccagucaaguuauuuagggguauccaucuugaguauuuauuauuucuacguguugggaacauuucaaguucucucuuuuagcuacuuugaaauacauaguaaauuguugcuagcuauggucacccuacucugcuauacaacauuagaauuuaugccuuguaucuaacaguauuuuuguacccauugaccaaucucucuucaucucugcuucucuccuauccaccauacuuugccuagccucugguaucugucuaccucacugagaucaacuuuuuuuuuuuuuccguucccacgaaugagugagaacugugaaauuugucuuucagugucuggcuuauuuuacuuaacauaaugacuccaguuccauccauguugcugcagaugacauacuuuuauucuuuuuauggccaaauaauauuccauugugcuuauauaccacacuuccuuuauucauuugucuguugauggacuccuagguugauucugcaucuucgcuguugugaauagugcuguaguaaacgugugaacgcacgugucccuuugauguacuaauuucuucuccuuuggauaaauacccaguagugggguugcuggauuauaugguaguucuauuuuuaguuuuuggagaaaucuccacacucuuuuccaaguggccauauaauuuauguucccaaagcaauguauaagaguucuguuuucucugcacccuugucagcauuuguuauugucuuuuucaauaauagccauucuaacuuggguaagaugauaccuaauugugauuuuuauuugcauuucucugaugauuagugacguugaacauuuuuucauaugcuucuuggccauuuguaugucuucuuuugagaaauaucuguucauguccuuugcuuauuaaugugaugaugaugaugauuuacuguugugugaguucuuucuagguucugcauauuagucccuuguugaaugaauaguuuacaguauauucugucuuucaguagguugugucuucacucuguugauuauuuccuuugcugugcagaguuuuuugguuuaauacagugccauuugucucuuuuuguuuuuguuuucugugcauuuaaggucuuagcauaaaaucuuugccuugaccauuauccuaaagugguuuuuuauuguuuucuucuacuuuuauaguuugggaucuuauguuuaagccuuuaauccaucuugaguuaauuuugcauaaagggagagagauagagguccaguuucauuuuucuacauaucgauauccaauuuucccagcaccauguauugaagacuauguccuuuccccaguguucguucuugaagccuucguugaaaaucaguuggcuguaaauauguggauuuacuuuuggauucucuguucugugccauuggucugugucuuuuuauacuaaaaccaugcuguuuggguuacuguagucuuauaaaaucagguaguuuggccuccagcuuuguucuuuuugcucaugguugcuuuggcuauucucacucuuccuugguucuuuauuaauuucaggacuguuuuuucuauuucuguaacaaaugacauugguauuuugauagggcuuguguucaaucuguauguauacugcuuugggcaguaugcucauuuuaacaauacuaauauuuccgauccaugggcaugggaugucuuuccauuuguuugugucccuuuaauucuuuuaucauuguugcguaguuuuccuuauagagaucuuucacuuccuuuguuaaauuuauuucuagguauauauauuuuuauuuuuauuuguuuauuuauuuuuuugagacggagucuugcucuguugcccaggcuggagugcaguggcgcagucucggcucacugcaagcuccgccucccggguucacaccauuguccugccucggccucccgaguagcugggaccacaggcgcccgccaccaugccuggcuaauuuuucacauuuuuaguagagacaggguuucacuguuagcuaggauggucuugaucuccugaccucgugauccgcccgccucagccucccaaaguguugggauuacaggcgugagccacuguauuuuuuauaucuauuguaaaugggauugcuuuccugauuucuuucucagcuaguuugucauugacauauaaaaaugaaucaguacaugauuuuuauaugucgauuucguauccugcaacuuuacugaauuugcuuauuagcucuaagaguuuuuuggcagagucuuuugguuuuuccaaauauaagaucaggugauaugcaaagugggacaguuuagcuuucucuuuuucaauuuggaugccuuuuacuuuuguccucuuaccugauugcucuggcuaggauauccaguaguauguugaauaggaauggugaaaguagauauccuuguuuucuaguucuuuguggaaaggcuuucaacuuuucuuaauucagcaugauguuagcucuggguuugucauauauggcguuuauuauuuugagguguguuuuaugcauagucugagagcuuuuaucaugaagggaucuugcaaauucaagauuaaguucaaaauuaaaaaaucaaauguuuucuccuuauugagaugaucauaggguuuuugucuucauuuucuugaagugauguaucauauuuauugauuugugucugucgaaucauccuugcuucccugguauaaacccauuucaucaugguguauuaucuuuuugauguacuguuggauuuuguugagaaauuuugcaucuguguucaucaaggauauuggcuuuuagccaguuguaguauccuugucuaguuuugguaucuggguaaugccucauagaaaaaguuaaggagaauucccuccccuucaguuguuuggaauaguuugaggagaauagauguguguuuuuccuugaaaguuugguaaaauuugacagugaagccaucaauuccuggacauuuuuuguugggagaacuucuauuacuaauucuguaucauuacucauuuauuggucuguucagguuuuuuuuuuuuuuaauuuauucuugauucaaucuugauagguuaugcuuauccagaaauuuaucaguuuccuguagguucucuagauaguuguucguaguagucucugaugaucuuuuguauuucugugguacuaauuuguagugucuuuguuuucauuucugauuauaguugggucuuucucuuuuuucuugguuagucuaggaagugccuuauugguuuuuuuuuuuuuaaaucuuuucaaaagaaccaacuuuuuguuuuuguuucauugauucuugggguguguguguguguguguguguguguguguguguguguguguguugucucuuucauuuaguucugcucugauuuucaugauuucuuugcuucugauuugggguuugguuuguucuuuucuagcuccuugaggugcauuauuagauugcuuauuuggagucuuuguauuuuuuuuuuuauguagguguuguuuauugcuauaaacuuagcaugguuuuugcuguuucuuauagguuuggguaugucauguuuagauuuuuguuuguuccaagaaauuuuuuuuauuuucuccuuuaaaauuuuuuccuucacccaguggccauuugggagcauguuguuuaaguuccauguauuuguacaguuuucaagguuccucuuguuauugauuucucauuuuauuuuguuguggucugagaagauacuugauauuguuucuuuuuuaauucguuaagacuuguuuuguguucuauuguauggucuauccuggagaauguuucuugugcuaaucagaauaauguguauucuguagcuguugaaugaaauguucaugucaaguacauuuugucuaaugugcaguuuaaauccaguguuucuuugguaacuuugucuacaugaucuaucugauggugagaguggauuguuaaaaguccccaacuauuauuguauuggaauauaucucuuccauuaaaucuaguaauauuugcuuuauauaucuggguguuccaguguugggugcguauauguuuagaauuguuauuucuucuaguugaauccacuuaucauuauauaauuaccuucuuugucucuuuuuacuguuuuuugacuuaaagccugcuuuaucuaaguguagguacucgugcucacuuuugguuuccauuugcauugaauaucugaauuuauuucccuuuacuuucagucuauaugugucuucacaggugagauaaguuucuuguaggcagcauauaguugggucuuuuauuuuuuuaauucauucagccaguguauaucuuuuaaguggaaaguuuaauccauuuacauucaggauuauuauuaauauguggggguuuauuccugucauuuuauuaauugauuucugguuauuuuguucuguucuuucucucauaauuuaucuuugugguuuggugguuuucuguaguagugguaacauuugagucuuuucuuuguguguguguugcuuugccagugguuuuuauauuuuuguguguuuucaugguaguagauauuguccuuucacuuccagauuaaguacucccuugagcauuucuuguaggcuaguguagugauuaugaauuuccuuagcuuuugcuugucuggaaaauauuuuauuucuccuucauuuaugaaggauaauuugcuggauauaguaucauuagcaauuuuuuuuucuuucagcacuuucaauacauuaucccuuucuuuccuggccuauaaguuucugcuaagaaaucuuuuauuagucuuauggggguuucuuuauaagugacuagacucuuuucucuugcuguuuguggaauucucuccuuauguuugacuuuugacaguuugacuguaauguauuguggauagaacauuuugcauuguaucuguuugcagauuucugagccuugugucucuggauguccaaaucucuugcuagacuugggaaguuuucaucuauuauuuuguuacauaggcuuuuaaaaucuuuuguuuucucuucaccuucuaggacacugaaaauuuuaauauuuguucacuuucuguugucuuuuaugaagacuuuguucauguuuuuaaaauuuauuucuuuauuuuugucugacuagguuauuucaaaagacuugucuaaguucugagaguuuucuucugccccaucuagucugucauugaagguuucauauauauuuuuuauuucauucaaugaauucuuauguucuagaauuucuguuugguucuuuuuuaugauaucuaccucuugaguaaauuucucauucauauccugaauuguuuuucugauuucuuuauauuguuuuucagaauucucuuguauccuacugaguuuuuuuagaauaaauaauuugaguucuuuuucugggauuuugugaauuucuuuuuuuuucaaaauuuuuuauuuuuuaaaaaaauuuuauggguacaugauaaguauguauauuuaugggauacgugagauauuuugauauagacuuacaaugugaaauaagcacaucauggagaaugggguaucuguccccucaagcauuuaucauuuaaguuacaaacaauccaauuacauucuuuuuuuuaaaauauacaguuagguuauuauugaccauagucacccuauugugcuaucaaauaggucuuauucauucgugcuggaauuuuuuugugugugcccauuuaaccauccccaccuccccaccaaacccccaacuacucuucccagccccuguuaaccaucuuucuacucccuguguccaugaguuuguugugaauuuauuuuuuugauugggaucuguugcuggauaauuacuguguucuuuuggagguguaucauauuuucuuuuuuauguuuccuguguuuuuacuuugguaucugcacaucugguguaauggcauuuuuugacauugcuuuuguuggagagaauuuuuuccugaagauauauguaugguguugguuggauauggcacuuugguauugauucugugugugugugguaguguguagucuccauaugauuuucuuuuuuucuguaaacagcauuagugugucugugauuuccccaggggcuuaagaugugguuguuaguggaggcuguggugaaguuuugauggggucagggauaccagguguaacagucuuuuggacccagugguggcagcagugaacugagcauccccucaguguuuuggcccgagggcagcuuaugccagugacagcguucgugcauccaggcugauuuuaggccuccagguggccugcuuaggugcugggauuccaguggugggucaugcaggggagggcagcuucucgagccccugggcagcagguguagcaugggugauugcaguagcagcgguggacaacucccuggaaccuaagugucugugcugguauugugguggcugcaaugaguugugugggcugguccccagaccugcaggugaugcaugaguauggguccuagcucugcugguaguggcagguuaagugggccugaccucagacccugggaguaguguucaggugucacuggugguggacuuagugaggugaucaccagagaucauccacaccuuggauuguguguuuggguacuugcuuugguggggguauggagcuagcuggguggaccggcuggcagugguaggcaagggaggggugauccccaguuuguggguggaaugcucaggaggggccagcagcaacugcauugcaacccugcucuacuagggaaggugggguugcuuuccuucagaguagcuguaggcuggcaacuugggggcggggcauggguuuccugccuuggcucugcagcagccugcagcccucaaguggcuguaagcaauggaauuuguccuuagcgcagguaaaaauucacagucgcccucugcuggggugggcaguaucgcugccuuguaguggcccuggcagcaggaugcaguuuaauggggccuguguucucaaaauggcaccauguuguagcugcuuagguucgagugauucgugggauccagcaugagcugucucucuggagcagugcuuucgcguggacuucaggcagcucccuguuagucuugggaccugagagggucaaggagcucuccuguggcuaggauuuuaggaguccuagugguuccagugggaauguagaccuuagggggucucucacccuuuuucugcauuauaagccacuccagccuccuaccugaucccagccgaacaggcuuguuucccucuuuuuccuugcuuuugaugcuucccaucacuacucucuugaauuucauuguucucucucaggugaucuuuuuuacucgcuauugugguuccucuccauagaugagacaaguaccagauacaucuagucaacuaucuucagcauugauuuuuauugguuuugauugcuuaucuaaacuaguagagcaaauuauuuuaguaugcauggugagugccuuuaacauucagucauuuaacaaauauuuauugugugauaacuaugugccagacacaguacuaagcauuugggauauauacaaggaucuuuguugugauggagcuuauuuuucagauaggcaagcaaacaaguaaauaaaaagaucaagauaauuuuaguuagugauaaaggcuauuaaaaaaguaauaugcuaacuaguguuugauguguuuguagaccauggcuauggggccacuacuguagauugagaagugaaagaaggccuuucugagauaauauuugaacuaaaaucagaaugacaaggaauuagggcccugcaaagaucuggguuaagagcauuccucuuagcagauaaaaaguugauauguugaaggaacagauauaaugccccuguggccaggauagaguuagaaaaguggugugaauaguguuaggauagagccagaacaagugcugaaauugguaauuguggaaauuagacccuuauucagacguuuuuuuugagauggagucuugcucugucacccaggcuggaguguagugggcgcgaucuuggcucacugcaaccuccaccucccggguucaagcaauucuucugccucagccucccgaguagcugacugcagcagguguuuuccguuucuguauacaauacuaaaugguucugugagugacuguugaugaaagacuucagaggccagaacaugaaccgggacccaaacagcauugaauaucaaguauacgggaguauucccugaaugaaaauuuaauuaaaccaguuacacuauuuuagugcccucuaucugaauaguauauuucuauauaaaaaaaauaguuuaccuuaguaaagugggaauguuuaaacauuucacaucauuuacaaccucacacuggcacuaaaucacuuugcucgggcgacaguuguguaaaaaugcuuuaaaauugggucauauauaaaauaguucagaggagcuuuaacacauauuuuauuaacuuuacuauauauaccaggcaccguccuuggugcuaggaguuggaagauugauuccuucauauuugcccagaggcaaaaugaugugaaauagaccccuggcuuugcugcuuugacuugucuaaccuugaguaagagcagguuacuuaaccucuuugugcuuccaucuucucaucuguaaauagggaaugacaauaauauacaucucaauaaguugucauaaagaucaaauuauuaauaacaaagguauuuaaggcauaauaaccacucauaaaauguuaacaauuuauugauuuuguuguuuucauuauucucuuaggcuggggguuucuuuucucaaggaccuuccaauccaguggaggagacaaaucuguaaaucaaugcuauuucguauauuagauuggaaaagguagaaugcaaggugcaaaguucaucaggguuacguauaaaggaaggauugccaauaaaaaguaaaaugagauuuuuuaauuucagugaaagaagagaaacaaucauacuuuaaauuccugggggauuagaaaguaccugaugaccagaaagaggaagagauuccgaaccaauuguuaaacuuuaaaucccauaaauaauuuauucaaaucaaaauaccaauauauaauaauuauggugauaauaauggaaguucuguaucucuuggaagauguugcaaauaauggacaauagaaacaauaggcuuaaccuuuuaacaugccugccugucuucuuuccuuccuugcauucucucauucuuucuuuuucaugagaaauugguacuuugcuuucucucagauuaguuguugauccauguauaacguguauuacaaagaugaacuggccuuuuuagaccaaauagaaauuccuguuucuuguuuuuauaucucagaguuguaaaagcaggaaggaaaaauuaugugagaacaaaugcuuuuccauuucuucauucuuuuuguuacacuuacuauucaaaugauagcaggcagacauuauauuucucauuggacaaucucccaaguaguuguguaacauuaugugacaaacuuggcugugaucagaggagggauugagauaaaauaagcauuuguugguugaaagaggaaggaguuguuguacauuuuuuugauaaugaaguguacacauacuuacucauaaccuuguaagaacuaaacuucggagaaguaaagaugacaaauuauagcuuacugagaagaguucaguuaucugaagauugacagugguugaauugguuaauauaagaaguaugagaaaggugccaaaaaggagagaaaugugagcuagagauagggacuacuuggcuuuguuucuuugugauagucacacuuauuggaggauuuguuugguaaaaccaacaauuauguaugacccuuguaagguggugagugaggaugguuguuacuggucaagcaguacuuaauaaagguuucuggccaugauuuuuuaagacauaccuauaccaaagaauugaaaucugaaaugguacagucagacauauauuagacuucucuguccuuuuauuuccaaaguaacuuuagaaagggcauaagcuuuaagguucaaaguugcaucuuaacagaucuuaagagaacuacaccagugguuuuuguuuuagauauuuuaaacauauauagauauagaucuauagauacgcaugccauuguuuucaaauacuuguuuagcauuugaauccuuucuucaaaugaguuuguacaaaagccccauauauaaauagacaaauagguaagguuauauaagaugguaccauaugucauucaaaacuguguguccauucugguaccccacucuugucuggaaucccugagauacugggaacaguuugaaaucuuuaagguucgcagugcccagaaggugauacaaaugauuuaccugcauuaauugcccuguugcuguuuggaaucaccuugugaucaugcuuaagaaugugggcaccagagucaaagcuaccuugaucaaaucccaucuugaccacuucauggcugugugacuuuggacaacuuauguuacauauugugccuuagucuaaucauauguguaguguccugccgcaaaggaguguguaugugugugaugauuaaaugaaaaauaggaucauagugucugacauguuuuuuuaaaacaauaauugugcagaaguaguguacacaacauaaauuaccacuccccuucuugaacaucuuuuucuuccuucagcacaccauuucuccaccucaaggccuuugcacuugauaguuucuuugccuaggacagcucuuuaacucuuugaauugcugguuacccccauccuuaaagacuucacagauguuuuaagauaggaccucauuuauacccugcuuacagcaaucucuaccccuuccuccuucccuucuucccauuuuacucuuuuauuuaucugaaucuuuucuccucuacuccccccagcucuuguuucaaacuguaauuaccugguuuguguuuauuguauuuaaguuccaaaagagcagaauuugccugucuuuccagugcucuauuuccagugccuaacagaaaccugguacacuaugguugcucaaggaguuuuuugaaaacaugauuauuaccuuguaaaaaugaaaacaaaucaaugucagauauagaauaaccaccuuuagaggcacauuuuucuaauaucuugucaugcaagacuuccugggauucucuuaaagcugugcugucaaacugucauuaugcucucucuauccaugggagacaacccugagcccucacuuggagucuaugugugguuauuuugauagauagaaacuuuaguuaaccuguuucucaacucagagcaaauuaggacccuggcuuugccuggccuuaagggggcacuguguugaaauguaauacuugguacagugcuccaccucgcugccuuuugcugcaccucuuuacccuccuuuacuacuaauauuugcuguucuuuuaucaccaucauugaucaaagcuucuuuccucccuuuucuuauuuucuuucuguuccugauugauucuuuucuguuuguuggauuuaauuugcaaagguuaaacuaaaccagauuuguguugucuuguuaaaauuacauuugugaacugaacauuuuuggaaugugggacauguuugucgcucauuguggccacagcauuauggcuaacaauauauuguucuuccacuuaauuuauucuuaggcauuucuaauuauuaauauuucuuucugauacggugucacuuuuaaugaggacugaaaauguuaauuaaacauacgaaacccuuugccaccucaaaauuuguuuugaagauauaaaagccuuagguuaauuuuaaggcugagauauaauuuuuaauuuuuuauaauuauggguacauaauagauuuaucuauuuauggguuauaugugauguuuugguacaggcauacaauguguagaagucaaauccagguaauuggcauagucaucaccucacgcauuuaucauuucuuuguuuuagaaacauuucaauuccaaucuuuuaguuauuuuaaaauaugugcuaaauuauuuguugugcuaucaaauaccagaucuuuuuucuuaaauacuagaucuuauucauccuaaguauauuuuuguauccguuaccccuccccacauuuugccccccucucuaccacccuucccagccucugguaaucaucauucugcucucuaucuccaugaguucaauuguguuaauuuuuagcucucacauaugagauauaacauguaaaauucguccuuccaugccuggcuuauuuuacuuaacauaaugaccucuccaguuccauccauguuguuguaaaugacugagucucauucuuuucuuuauggcuaaauaguacuuuauugaauacaaguaccacauuuucuuuauucauucaucugaugauagacacuuagguugcuuccaaaucuuggcuauuaugaauaaugcugcaauaaacaugagagugcaggugucucuuugguacacugauuuucuuucuuuggauauguaccaagcagugggauugcuggauuauaugguaguucuauuuguuuucuugaggaaccuccauacuguucuucguaguggcugugcuaauuuacauuuccaccaacaguauaggacuguucccccuuccccacaucuuaaccagcauuuguuacugccugucuuuugaauacaaaccauuuuaacugaggugagauguuaucugauuauaguuuugauuugcauuuuucugaugacuaaugauguugaacaucuuuucauauaccuguuggccauuuauagagauauaauuuuuuuuaaccuaagauuaaaaguauauugugguauuuugcuucaggacauaaucaugagauuucuuuguuguuguuuugaguguaaauuagguguuucaauauaagaugaaauaaaucugaaaccaaauguaucaaaugauuggaucucugacaagaucuauggaaggaaaaugcaaaggcagcuccuugugacuuccccuuuuuauuuguaaaagcccugguuuacaaauagguugauauuccuaguguuuguuuauguaaggaaauaaugcaguauuuacuggauacaccuaccagcucauaaaguucuauuuaagcugaguuuucuuuucuuuacuuucuuucuuucuuuuuguuucuuuuaaagacgggaucuugcucuguaacccaggcuggagaacaguggugcgauuauagcucacugcagccucaaacuucugggcucaagugauccgccugccuuagccuccugaguuguuggacuacaggcaugugccaccaugccuggcuaauuaaaaaacuuuuuuuucuuuccccaagcuguucucgaacuccugggcucaagcaauccuccugccucaggcucccaaguagcugaguuuacagaccuaagccacuacaucagccauaugcuuuaauguuuuugaauaccguauuguacuaacugugcuagaacccaaaaaacauaaccauuuuuuuccauaaauugaauuccaaaauuuaauaucuucuugcuaccuuaggagacggucucuuuuucccuaaaugccccuugcagaaaaaguucauuagcucuaaaaaucagguuaagagaaguuggaggagguguguuuuuguuuuuguuguuaacuuuuaugaaaauuucaaauaaaccaaaaguaaaagaccauaaugaauuaaacuaccaccaaauauacuuagcaauuuuuugucacacuugcuucaaaacagauucuuuuauuauaguuaaaauaguaaaacuugcauugacaguauuaaaagaaggaggauauaugugagauuggacaucguuuuuuacuccuugauuucucuuuuauuuuuauuuuggugacugcuaauuuuuaaaacauuauuucuaagccaguucaccuagcuuuauugggggaaaacuauaauugugugugagaguaugugugagugugugaaauuuuccauaauagaguuugcauauauauguauuauguuacucauaugugucauuauguauguaaaucauauaaauuuuauaaguacauauuuauaaauauauguauagauaauaagcuauaucuacguauauauacccuucauuauggaaaauuucaaacauacagcaaaguagagcuaauacuguaaugaaccuccaugaauacaucacucagcuucaacaguuuucaguuuaugauucaucuauaacacucuccuuucagcuauuuaaauauuuaaaaaaauauguaaguagggcaugccaaaauugaagacuaccuuuguacauacagguguuugaguuuaaugaagaagggaauagaagacaaaaauuaaaguaaguguugauacuaguaugcuaaaaaggaguaauuagcuaagcaagcauuaauugaaccucaugagugaacugccagaaacuaugagauaacuccaagauacaaaaauuacuaagaaaauguaguucauugugaggugaacuucaguagagguuucaacauguuuuaagagcagaaauuaagguagacugggaggaggaggaugaaacauuagagaagacuucuuauaaaaugauuaggaacuucaggucugagaugaucguaugaagaagugagaauaaaguacuuggcuauggcacguuucuauguagacagagccaagggcugaggaaaagaccaugcugaaacaucucaaaaagcaggugugauaaauacauucaguuuuuaguuaucuaaaaauggaauggaaaagaguaguuauaggaucaauauggucaauccaaguaccuuuuuuuaaaaagugauaaaaacagauuuuauucaggaacuaaugcaauagggaagagacaucuaaguauggaacugggcucaauucugaauacaacgaaaauggaagauuuguagucaaggagcagggauagggucaguggguggaaaacacggauguaaggaaaggaguagggggauucuggcuaaacuagcuuuacagggauucuugcugaaggcagaccagggugaccagauacccugggggauccuggggauaaggaauuugaucauauugaggugaucagaaauggaggguagggauucuuucugaacugacuuaacaggauucuugcuguaacugggcaguccaggcccaacaggaacagacacugaagcccaaggucaaagccuaguugagaagaggguuuagagaaaccuaauguuuggucaagaggagaguauuugucaacuaggaagaaaaaaauuacauagguauugcuaugucuucugacaugaacaggcagcucuaauccuguguagacugcacuguccagagauaaucacacuauagguuuuauuaaguggauuuuaaggguagucuuaaggggggaaaagggagaaaaaguguuacuggaaagccucaugcauuuuuuuuuuuuuuggaagaggagguguaaaaaagagaagcaaauaagccaguuaugccuucaauacuuuggugaagcacuaaguauccaaguauuuucagcaucacuaagggcuuuauuuuauucuaggaaaaugaauuauagugccuacuacauucacaacccuugcacaauucucaugcccaucaucuucuacucacagcacaugcaaagaagccaaaacagccauguuuuauaucauaugacccugcucuuuuggcuacagguauuggauuacaagcaugggaucucauggcagccaacacauagauugucuguuaccugugaugugugacuuuguacgaaaugauuugagccaaucauauucuuacucauauuuacaugaacagaggaaaagaaaaucaggcagcuaaagcuggaggaaacagagaaguccuugagauagauuuggagccauguauuaggcucagaugccuuauauuugcuuuggauugaauugcuaauguuccaacugagguauccugggaauuugcaugaaugaaaauaaucagacuaugcuuuguuuaguaacaacucaaucuguaacauaaguucaugauauguuauaaauuuagguuaggugcuuccuuuuugagauuauauaucauauauauuauauauaauauuaaauauauauuaaaauauuaaauauaucaauauuaaauauauuaauacauaauuauuuuauuaaacauauuaauauauauuaauauaugauauauuaauauaucauauauuaauauauuaaauauauuaauauauaaguauuaagauauuaaauauauauauuauauaucucaaaaaggaagcaccugaucuaaauuuauauauaauauaauauauagcuaauuauauaugagauauauaauauauaauuaauuauauauauuauauuauauauauauaugaugaggaaugcaagcaguucuuauauguaauuacucaaccuugaaccagaauuuucucuuaggccccaaacaaacuucuguauuauuuaauuguagaauuuaacaguaaggaaaacuuuuuuuaaaaaauuuagucuuugacacuuaucucuaugagucaaaauuuuugcaauuuugugaaccaaaacaaaauacagaaguagauucaugacaugguuggcaucauugcagcuaugaucucuaaccucaaguuuaagauuuuuguguucauugaaacaauguaauuguucuuacuauugacuaaguguuguaaguuugaacuuacauuuauauuuuuaaaaauauucuuggccuggugcgauggcucacgccaguaaucccaacacuuugagaggcugaagugagaggauugcuugagcccaagaguuggagaccagucugggcaacaaagcaagaccucaucucuacaaagcauaaaacauuagcugagugugauggcacacaccuguaauccuagcuacuugggaggcuguggucagagaaucacuugagacuuggaggcugaagcugcagcugugaucgcaccacugcacugcagaagcaugggcaaccgaaacaaaauucucauauguccuuugaguuugugaaguaccagaugcugugcuugguguuggagacacagugaugucuucuuaggaguauuuaucuauuugaauagauauuaaggaaacagaugugaaauuuuaucuaugucaagauggaaaaaugacagaaucucuuagaaauguguugaaguuugcaggaugaguuaacugggauagggagggagacaucagugauacaggcagaggggauuagcagucuuaacgauccuguaacaggaaggaaugaggugagcuuggaggacugaaagauggaaagaagagagguaauacggugugagaugagacuagaguuauguaugagguagacugugugguuuugaccauuauguuaagaaguggagguuuuucugcuuuaauuuuaaagugaugaagucuuugaauaauucagagaguugcaauaugaucacauuuacauuuugaaaagaacuuccuucuuguggcagagugcacagauuggggaacuagaagugggcagaauggauguaaagagaccaguuagaggcuauuucaguagucuaguuaaaagaugauagcuuggauuacagugcuaguagcagaauaagaaaauaguauacagauuucagagauauuuaggaagugacaaccuuguuaugauuuuuguauaggaugugagagagaaggaacuuucaaaaaugacaccuagauuucuucaacuuagguggcgguaagagaauacugaaagcagauauagugcauauguuuguuuugggaguggaugguaggugucugaucaggaguuuaguugaauguggagucugagaugcauuugugacauucaagaaaaacauuccacauggguagucacauaacacugguuuggacaugagaagaaagaucuaguuagggagaugauauuagugaauugugggcauacugguaauaauugaagacuugggugaaugacauccuuucggcagagauuuuagagugaauuaauaagaguaucuuagguagaggaggcuaccuauacagaaaacagagaagauuagagagguggggguaaaaaaaucaagagacuguuguagucauuaaagccaaaggaagaaugauuugauaaagagggagaggccaagaauuauauaaaauggaaagugaaaaaauacuugucaggaaaacuuuaugagguuggacucucaugguuccugguuuuuaaaauguguuauuagcagucccuugaagucaguuuuuuaaaaugaaaaauuagguugaaaauuuaaaaccuugguauucuugcuaaaauacuaggccucuuccauuaaaauauuuccagaaguuucggggggguguuacucuuucugggguauacucaacuuuguguggugaaucucuuaguuuaacuguuguuuaugagcuuaucuggguagagcuauuuuuaguuuuugcuucuauugcuaauccagguguuuggaucuuguuuucaauguuaauuucuugucuugggaauucuuuguaaauuuagacccuugaugcuuagcacaguguuuaauuuagcuuuuuuuauuggagccuuuuaagccuuuagauagagaagaacuuugucacuuccaugguggugguuagauuguuuuccaucuuuuacuagacagccuuuccauaauccucgcuuuguaaauacaaucacuacuuuguuucuggcauuugaagauaucccuuuuuaaauucugaucugguaaauacuucuuggaagaggaagggagcaggguagcauuucuagcauuagcuuagcuuuccauguuguuggcacacaaaguuauuacuuaaaauucugauuuuaaaauuccccucagaaauuuggauauauuacuccuuugccuuauuagcaauccagugguuccacugagaagguauuaaucuaauuuugucauuccuuuguagaaaaccuuucucucugaauuaaugauuuuaaguuguacuucaguauuuugaaauguauugggauguguaugcucugcggaaaaaaaauuuuuguuuuauaucaguguaagaacuagacuacuuaaauuuuuuuauacuuuuuaucuuguucuaauuugcucuucauuuuuguccuuuaugcuauuuagccuaucuuuuauuuuaucuuggcaauuacaauuuugccauucaaaaucuuaaauggauccuuuaucauaagucuguuucauuaacuauagacuuuaagugcuucagagaugcuguauuguuugcuuauagcuacacuaguacuaucauagguacuguuguuaaucccuguuuuacaaaugaagaaacuagaaugcagagaacauaaguaacuugcccaaccaaggucacauagcuggucaguguggaacuaacauucaaaccuaugcaguaugaugcuagaaccugaccucucaaccucuagguuauacuuccuuucaggucugaaaguuuaauauuaauaacucuuucagaguuaauauaacucuggguuauauuaaccaucugaauauauucucgcuucuguuucuacaguauuaauuuuucuauuuguugauuuugauauuuagcugucauggugauugcuuuugucaaaugcuugauuuuuuugggggggggauauguugcuuauuuuaguauuggaaaagacuguaaaaaugcuacaaagcuugcaucuagugauuguuggaguugagaucauaacuugcugcuggaaaggauguaucaaacugaucugggguauaaggauuuccuguucaucuuguauccagcaucguucugcuucuugacucacuugucuauguguagugcuucuaccucaggcagacaccucugaugcccacuucccugcuucgaaauaguagggggaaggggauugaccugacugaguauaccuaauggcauuacccugaggauugcuccaggcuuuuccccugcccaugacagcugcuuuauacuaaacauggaauaucccuggaauugcccucuaugguuugugguuuucuucugccuuucauuuugggcccugguuucuucaauuucauuuuuucucauuugucucagaaauuauaauuucuuuuucuauaaggccauauucuuguuuuauagugcugcuaugguuuauucucuuuauauuuuuagugcuauuauaguuuaaagccaauguuuuuaggguugcaggauuuugggcaauucuggugaguguaccguuucuuccauuuugauguuaucuucugucagcaguucuuaaucuuuugagauuuaugaacuucuuuauagcccucuaccaccuggaccccaagcaauggcuaaauguuauuuugaacauuacuaguuuuguagguguggguuugaaguugggggcguuuuuauuuauguagagguauaagcauguucuuuugauaucuucagauuauguuauauaaguuugaugaaaacgcucugaaagauacauuuauguagccacagaguuuaauauaaagaaggagcuauuucuauuaagcaguuuuauaacauuucuuuuuaucucuuuucucuagguuuaacuauagaucaacacaucaucuugcaucucauggguucuaugaauuuuuaaauugguuugaugaaagagcaugguauccacuaggaagaauaguaggugguacuguaaguauauuagcaguucuuuauguuaauuauaacauuuauuguuacuugaguaaaucauuaauugccaaggugguagggauucuugaaagcuuuguauaguuaacaaauuuuucuguggcuuauuauccaguauucaguuuacuuaggcucuuuucuugauaccuccuccccuuaauccccaaccuguuuuuggguugucucacacuagccacucuuuuugacaagugguggaggcuggguggggaucugcugucacaguguaucugaaugaaguucaguuuauuuguguauuugcucuuauagcaauuugguugaaaaagcaauuuggaaggagauagaaacguagaauaaucaugauaauuauauaucuagaauaaucagauaauuaggauuuuucaggcccugaauauggagacauuccaaauuauuccagguaauugacuaaagauuauaguucaugcagacuucugauauccagaaagaugacacaaaggcaaauauuuuuaggauuugggacauaaggagaaaugaaggugaaagacaaagcaacauugucuuguaucggagaaauauauguuugauuuuuuuaaaucaauuuugccaggcuuauucauuuuauuaggguuuuucuuaacccaaagaaacuucugacucuguugauuacuucuagcauagguuuguuuugcauuuuuuaaauuuuaauuuauuuucuucuucuuuugugaguuuauuuucauguucuuuuucugacuucuugagaugguuucucaguaauuuucaacuuuucuucauuauuaagagaugcauuuuaagccuagaaacuacacacuagccacuguacuagcugcauuucauaaguucugauguguaguauuuucauuaucauuuaaaacaaaauguaucuuuauuuucauuauaauuucccugacucauggauuauuuagaauuguauuuaauuucaaacauaaggggauuacccaguuauguuuuuuugcuuuguacuucaaauauauugugguuagagaacaccuucuauguaauuucaauccuuuaaaauuuauugagacuugacuuguggcuuaggauauauccaaauuuuuauaaauguucccuuuguguuuagaaagaacauguucuccaugauaguaagguguuguguuucuagucuggggcaucuucuuauccuugauguaaauagagagaaagacauaaagagaugaaggcacaauagucguuaucauguucugcauugugaauuggagaaguauuaaauggguaguacauacggcagauagcuauuaucugcaguucuuguggugcuaaucuuaucauauaccuaaauuguauuacauuugauaacuauaguuuuucuugugcaguuuauaacuuuaucuuaaauuaauccucaguggaagccuguuuucucuaagaguccugauguccugagauuugggaucaucccuguaauaaucuuucuuauuugccuuugcuggagaauuuuagggguuucacugguuuuaggacaguuuuacuuaguuugagguuucuuauacuuaagguuauuauaaauguagaacccacauugacacauuugaaugaguuucauauucuccuuuaggacuuuguuucugcucugagcauuggaaggcuugauggaugaauagaauuugucuaguuucauaagcagguccugacuuuuugcugguaauuaggucuucacucugaucccuguguugggugaaacccccucauuuucauuccuuaaggccuguaucaggccugguuauguuuggcuuuuuucuucucuccugugggcucccaugacaucagcaccuacuuugaauuuccucuucauuuuuggcaucuggagaauacccuaucuugagcuugauuaugcuuuuuuuguuguugggguuuuauuuguugauuuauuuuugguucuuucauuuaguacuucuaugaaucuuggcuguuuuugugugugucaguucagucuaccguauuauauggauauauugucuuaucuugaaaaauauuuuaaauucacuuuguuuuuuuuucccccccaguauugcugacaaaauuacacacugguaccuaguauugaaucugaaguagaacagaauuuuuauguguugagaauguggaugaauuaucaugcuuuuuuuuccucccccucccccuuucuccuuccaugcaugcaguagguauugagcauccacuuugugccaguuauuuuucuggaugcuggggaaaaauuuccugcuauucuggagcuuauauucuugugagcguaggcaguuaauaaauagaaaguaaauaaauaaaauaaauaguacgucaaaugaugauaaguauuauggagaaaaagcaagagaguuaaagacgggagugugggggagagagguugcaguugcaaauuguauagccaggaaaggaaauguauaaccuuuguaguuucuguuauggaguaaaaaaagagucuuuuaggacuuaccuaagggagcagauguaaaugcauguuuuagucacugaauaauaacucaggaagaauguccuguucacuguucuugaauccuuuuaauauuugauguuccucuuuuagagugaggguacguauaacuguuaacuggccucuucuaguuuauuauuucccuuuuaucccuaaguacuuuaugugguauaaaaaauuuaauuuuucaggagucccaaaacauuaucucuggauucaccaacugacucuucccucuuuuccuagcuagacuguucccucuuuuccuugcuuacuuuccaaaucuagggcuugaaaggagggaacauuuuuuuauaaauaugacuuaaauaauuuuguguguaauuuuucuuuaucuuccuuuucucauuuucuuauguacacacaaguaugggcaaaauuggaguauguuagaacuccaaacucaaggauaagcuagacuaagacccuguuuugauaaaaaaaaaaaaaaaaaaaaaaaaaaaguuagugggaucaguaaaaaaguuaccuacaguuaacauuguuaaacauuuugaauuuuaaucauucuuguuucauauucucccugaucuuuuuauguauuccuccagauaugagcuaguucuuuguaugcaacacaaaaagguguggguuuuuuuuuguaguuuauaaagaaggcaaauuguuuugagauguugcuuucaaacuuauguaagguaaacaaaauguaaugaugaagaguacauacauuaauauuuuugugucucauuuuauauguaauuaaauuuuccauuuuuuucuuccuagguuuacccaggguugaugauaaccgcuggccuuauucauuggauuuuaaauacauugaacauaacuguucacauaagagacguauguguguuccuugcaccaacuuuuagcggccuuacaucuauaucuacuuuccugcuuacaagagaacuuuggaaccaaggagcaggacuuuuagcugcuuguuuuauugcuauuguaccaggcuacauaucucggucaguagcuggauccuuugauaaugaaggcauugcuauuuuugcacuucaguucacauacuauuuauggguaagugacauuuaauguuuugcugccauuauuacucgugaccuuucuccugaaacacuuuaggcuguacgcagauuugucuuuuacaaauuauguaguugcguacagagaucuguauuacuguucauaaucaauuuaauaauggauaacauuuuaaaauauguuaggcaucucucaaguuauguguaaauauccuuuuuaaauaagucagaacuccaaaagaagagcuaucauaaaacaaucuguugauauuuuuguuucuuuguuuuggggagauagguaagaaauaguuacccaggaaaguugaagcaugguuugauggcuaagaauuuuaaauuguuucugaaacuagcauuauuuauuuugcugcugccaggcuauuuaaacuuaaugauuuuuuccccuguguaugaaauaugaugcuacuuggguucacuuuagagcuugcauuuauuuauguauuuauuauuuuagcuuuagcuuguaauuuuccagugauagaaauuaccaaaauuugugugugucaauauguuuuuguauauuuuauuaaguauauuuuuagguagcuaggugaauggcagcauaaauuuucucuuuaauaauuauuuuauauuguucaaaacuacuuggcuaaugaguauuuuugcucuagcauggaauucuggaggagaagguugcaaugugaucaguauagacagugucuuaaucuugaguuuaaaagagaagaaagaaaaauacccauucaagugaagaugauaccaagcaguaggauguugccagugcugcuguacuuaucaaaaaguguuuuuaaaaacucuuuguuuauugugugcagcugaggagaaaaaaaaaaaaacaccuuaaaaucgagaaccucuguugaaugccuuuuaauaaacuauauaauauuuuaaaucauaaaaauaauacaugcguauguggcuagauccugauaauauaaugcuuaguggaaaaauaaguugugauaaaauaugugcaguaugagaaauccuugauguaaguuuuuaagcaguacaaaucauacuaugucuguuaauagcaguuuauaaagaaaguauaaaaaugugauagauaagcugcauguacgccagcuuugugauaauggguuuuccugagggugggugggugauacugaggugggcaauauuaagggagcuucaccuagcucagcuaaaaaaauuuuaaaucaaauauucugaagcaaauguauaauuuuugaauuugaaagucugaauagcuagguucauaacuauuuuaauauucucuacacuuguguauguuucaaauacuuuauaauaaauuuaaaaaauaaaauauucuauuuuguggacauuuaugcaacagaaaaauacaaagaaaaaaaucacccacagugaacuaccauuugcauuuuuuaauuuugagcacauuacauucaugaauaagucccaguuggucaugguauauaaucuuuuucauaugcugcugaauuugguuugcuaguauuuuccuaaggauuuaugcaucuguguucauaaggugauauugguuuauaauauucuuuacuugcagugucugucugucuuaggauuaggguaaugcuggcaucauagaaugaguuagaagguguucccuucucuucaguuuuuggaaaagauugaggaggauuaguguugguucaguucuuuaaacguuuuaguagaauucaccagugaagccaucaggaccaggacuucucuuuuuugggagauuucugauugcugauucagucuccuugcaaguugucucugcagauucucuauuucaucaugacuuagucuugguagguuuuuguguuucuauuaauaggacuuuguugauguaagcuauucaauuuguuggcauacaagacuugauaauacucucuuaaaauucuucuuguucccuauggaaucaguaguaaugucccgcuuucugauuuuagugauuugagucuucucucuuuuuuacuuaaucuagccaaagauuugucaaucguguugcucuuuuuaaagaaccaacuuuugguuucauugauuuuuuucuguguucuuuuucuuuucucucuuuuaguguauaugcugcugaagcaagcacucuauuuuaucucuguuauagucuuuauuauuuauucaauuuugucuuucuggaagcuuuggguuuaguuuguucuuuuucuuuccuucuuuuuuuuuuuuuuggagacggagucuugcucuguugcccaggcuggagugcaguggcgcagucggcucgcugcaaccucugccucccagguucaagcgauucucugccucagccucccgaguagcugggacuacaggcgccugccacuacguguggcuaauuuuuguauuuuuaguagagauggauuuucacgauguuggucaggcuggucuugaacuccugaacucgugauccacccaccucggccucccaaagugcuagguuuacaggcaugagccaccgcgcccagcccuaguuuguucuuuuucuaguucacaacguaguuugugaagucagguuuuugacuugagauuuuuuuuuuuguuuuugaauguaggcauuuauagcuauaaaguuuucccuuaguacuacuuugacggugucucauaaguucugauacauugugguuuuguuuucauucaucucugaguauuuucucauuuuuauuuuuugaucuguugguaaguaucuuguuuaacuuccacaaauuuauuucccaguuuuccuucuguuauugauuucugacuucauccuguuguaguuggagaagauacuuuguaugguaucugucuuuuuaaaucuauugaaauuaauauuuggcuuuaaucugcggcccaacauauugucuguccuggaaaaugucccauguguacuugagaagaauuguguaugcugucguuauucaauaauguguuuugugcaugucuuuuagaccuaguugguuuguuguguuaaguucuauaucaucuccugucugguuguucuauccauuauugagaauagaguauugaugucaccagcuauuauuguagaacuguuuauuucuucaauucugucaaguguuuucuuccuauauuuugauggucuguuaucagguacauaaauguuugcaauugcuauaccuucuugcuguauugaacuguuuuauugcuguauauauuggguucuuucucuuuuguaaccuuuuuuuuaaaaaaaaaauucaaagucuguuuuuucuuuuuuaauuuuguagagaugagguuucaccauguugcccaggcuggucuugaacuccugggcucaagcaauccucccuccucacuucccaaaguguuggaguuacagguuugaaccaccacacccugccuuuuuuuguuucauuuuguuuuguuuugaauuuuauagaguuaaagucugucuuuucucauauuaguauagccaucccugcucucuuuugguuacuauuugcauggaauaacuuucuguccuuucagucucuuugucuuuggauuuaaagugcaucucuuacauaacugcauguaguuggaucauguguuuauucuuucugccaaucucuguuuuuggagaguuuaauacacauuggaaguaauuacucguaaagagguacugauuucugugguugugcuguuuucuacaugccuuauagcuuuuuuuuugucccucauuucuccauuagucuucuuuuguguuuaguggauucuuuugguagugaaacauuugaaucccuuuacuuuugagcauauuuguggauugccuuuucacucuggauaguguccuuugcaugaauuuuaaauuuuuaugaagucuaauuaauuuuuguuguuguuguugcuugugcuuuuagugucauauuuaaggaaacuguuggccuaauugaagcucaugaagacuuacaccucuguuuccuucuaaagauuuuauaugucaaguuccuccacuuaggucuuugauccauuucgaguuaauuuuuguauauggugugagagaggaauuccaacuucauucuuuugcauguggauauccacuuaucuuagcacuguuaaagaaaaauacucuuuuuuguugaaugguuuuagcacuuuugucaaaaaucaauugauuauaaauguaugaguuuauuucuggacucucaauucuguuccauucccuugccaucuguauguugugucuuuaugccacuaccgcacaguuuugguuacuguagcuuuguaaugaguuuugaaauccaaaagcauaaguccuucaacuuuguuguucuuuuucaagauugcuuuggcuauauggggugccuugcauuuucauaaguuuuaagauuagcuuguucauuacaucuuuuuuuuuaaguggcaugauauuguuuuguuaauucaacagaaauuuuuguagaauacaauauggagcaggugcuguuuuauguguugauuacacaagguuauaugaaguugauaaucuaguagaagaaauuauagauaucauugcuuugaaggaucauauuaacagaaggauggaaugguaaaacauucucacccagaaacugggagguuaucuagugaguuuuuccuuuguuuucuuuuuaaaaacaauauauuuaaauaaauuagguuuacgguggaaauagauucaguauuugaaaauuagaacacuuguguuugaguucuggcauaaaauacucucugacucuugacaaauugacacuuuugaaucucauucaguuuucucuuaagauacagaaaacguuuugccuacagaauuauaauagaugaugacauucauuuaaaauuucauuauuacuaauugaaaguggaaauaauuacaguucuaacuacuaugaaaaguuguuuguagcccaaaugaaguuauaaaaaggugaaaacauuuuuuguaaucucuaauauauaaauguuaaguugucuaauuccucacccaguguuuuuauuuuuaaaccaacucuuuuaaaagguacauguuuuuaaaauuuaaaagauaaguacuuugucauagcauuauuauuuguugaugcccuauuacuguuacaagcugguguugauagacauuuuuggauacacuuuuggauuuguguucuacagagauuaaaacauuuucaucgugauugagugauugagaguaaagucuauagcauaauugccaggguuugguuuucucuugguuugauuuccagcucugucacuggagguuguuuaaauccccacccugugccuguuccaucaacuauaauauggaaguaauaauuguaccuuccuuauauaacuuaaaaauuaauacauguaaagguauagaauauugugagaacauaguaagaaaugaguacauguuuguuauuauuuacgagcaccagaguauaugauucagaaaaguaauuaacacagauaaaguaguacaaggagcaguguuuaucauauugccucuuacagguuuuguuuuguuuuguuuuuuguuuuguuuuguuuuguuucuuuaagguucccuccuguaccuuuguagucagucuucucccuaccccauuucuggcaaccacuggucugauuucuguuucucugucuauauagcuuugggaguuucuuuuuuagaaugccauauaaauacagacaguaggcgugacccuguauauccgucuuccuucacuuagcauaauauuuuugagaaugucauccauguuguugauguuuuaguaguuuguuacuuuuuauugcugaauaguacuccauuauauggauguacuacaauuucuuuuccaguuuuuggcaaugaugaauuaaguggcuauaaaauguuugcuugugggucuuuguuuggacauauauuauuauuucacuuagguaaaugcauaagcacagauuggugguuugugugauaaguauagguuuaacuuuauaaaaagcugccaagcaguuugccaaaguugcuguauucauuuugcauucccuccacaaauacaugacaguaauauuuacucuacuuuuccaucagauggcauggucacauuuuuaaauuuuacccauucuuguagguagguaguaguaucuuauggcuuucguuugcuuuuccccaaugacuggugagcaucuuuucacguauuuauuugccaucccaguucuuugaugaaaugucuguucauaucuugcccauguuuugauuaaguuguuuucuuacucuugaggugugagaguucuuuguauauuuuggaaauacuuuaucagaugugugcucuacaaacauuuucucuagucucuuccuaagagcagaaaauuuugauuuuuauggaauguaucagcuuuuuuuucaauagaucuugcucuugguaucuucucuaagagaucuuugccuacccuaaaucacaaagauugucucauguauuuacuuauagaaauuaaauaguuuuagguuuaacagucaggucugucaucuauuuuaaguugauuauggucuggugcaauauaaggguuguuggguuugaauguuagguuuuuccaacaucauguguugaaaagauuguucuuucuccacugaauuaucugcuuugguaaccuugucaaaaucaauugaauauauacauaugggucuguuuugggacucuucuguuuaucugugucugucuauauaacaauaccuuauguuguuuucauuaguuucuagaaacucuugaaaucagguagcaugaguaaucuaauguuauuucucuuuuucagaauuaauuuggcuuuuuuuagcuguuugcaucauguaaauuuuagaaucacauuauuaacuucuuuaacggaaaagccuucugggauguugauuggaagugcauugaauguauaggucaguuuggaauagaauuguuaucuuaauauguagucuucugaucugugaauaugguauuucuuuccauuuauuuagaucuucuucauuuuugcuuuaauuuuucugggcgaucagguuagugacuugaucuauuuuaagcaccgaaagcuauaauuuuuccuuuacguacuuuagcuguaccccauaaauuuuuuuauugaaaaauaauuugcauauuauaaaauuuauccucuuagggaauggaauucagugacuuuuaguauauuaaccaaguuguaccauuaccacuauccaguuacagaacauuuuaacacuccaaaaagccucgcccaugaucagugacuuuccauuuucacauccccccagcccuuagcaaccgguauugcuuucugccucucugauuugccuauucuggaauuccauauaaaaggaauuauauaauauguugccuuuuguaucuuuuuuuaaaauuuucaaauuagauggguucuccuuauauugcucaggcuggucuuaaacuccuggccucaagcuacccucccaccucagccucccaaagugugagcgaccuuaccuguuuuacaucuggcuucuuucacuuacaauaguauuuucaagguuugucuauguugaaguauuuauaaauacuuuauuuuuuuauugcugaauaauauuccaguguaugguuaucacauuguauuucuccauuuuuucaguugauuaaacauuuggguucuaauuucugucuaugaugaauaacgcuucugugaacaucugugugcauuuuuauuacauuuuaaacauuuauaaacaucuguguacaaauuacuauaagaauugcacagaguuuuuaugcucuauuuuaauuuucuagcucagauauuuucuaauuucccaugugacugacagugucaccaaggaugcugaacuucuauccuacuccaaaucuuuuucaugacuacuugguagggcuuaugaaaagagcuugugaauguaaauuccucuuaugucugguuuccuuagcuguuuuaacacuugcuuauuugccuugugacuuuagcucucugauaagccuaagaaaacuuacuauuuuguagaucaucuagaauuuuucccuuauuguugaggugaaaauaacauucucuugcagcuuuccacaucccaagcacaaguggaauucagugcaucuccuaauacugugaaccaaaacacaagauggcccauguuuguaggccuagagcaauacuacuuuccaauagaacuuucgacucuguuuaauaagauagucacuggccgcauguauauggacuuuuuuuuugugcagguacuaggugcuucacuauaauauagguaauagaauugaguuuuacccuuaaaauauuugucucaaauauuuauuucuuuuaaaucaguuaggaaauguuaacuuauucuagaaacagaggaccucauaauuugugagaauuauguaaaguuaauucccuaagccuaauccauuaaaaaaauccuuuuacaaaaaugucucuuuagucaucuggaugcacuacauuucugcuagauuugcucaguauagaggaagaaagccauuuguaaauucuguuggaauacaguuuucaugccauguuugggcuaccacuagauuuuugccuuuuauuccaauguagauuuuuccaguguuguuuucuagaaaguguugcacuuuacauucaugucugugauucauuuugaguuauuuucaugaaaaguauaagaucugugucuagauugauuuuuuuuuguaugugguuguccagcuguuacagcauuauuuguuaaaaaaauuauucuuuuucuauguauugccuuuugucaaaggucaguuuauauuuauggggcucuauuucugugcucuguucuguucugcugaucuguuuguucuuuucccacacugucuugauuacuguaguuguaugauaagucuugaagucagguguaguaucagucuuguuucaauaucauguuagcuagucucagucuuuugccuuuccauauaaacauucaaauugauuuguugauguccacaaagucacuugcugagauaagguuuguuaucuuaacaacauugucuuccuaucauaaacauggaauaucucucuguuuauuuacaucuuugauuucuuucaugagaguuugguaguuuuccauauagggauuccacacauauucuguugguuuuauacuuaaguaauucauuuugugugugugcuaauacguacugggugcuaaaugguauuauguuuuuaauuuuaaauuucaguucauuacugguauauaggaacaaguuuaacuuucauguauuaaccuuguauccuccaguguugucuguaaucauuuauugauuccaguaauuuucuuucugauucuuuggggucuuuuacguagacaaucaugucaugcacgaaaaaaagucagcuucauuucuuccuuuucagucuguguacuucuuuucuuuucuugucuuauugcauuugcuaggacuuccauuacaaugcaaauaggagugaugagagagaacaacuguaucuuguccugaucucagggggcaugauuaugaauuuauuucuggagucuguucuguuccauugaucuagaugucuaugccuaccucauaaacauagaucuaguugucuguacugacccaauuacuauaacuucauuguacauuuuuaaauugggaaguauuguagauuuuuauguauugaucauauauucugugaccuugcuaaauuugcauguuaaaauuuacuuuuuagauuccuuaggauuuucuacauacaagaucauguuaucuucagagacagagggucuuugcuacuuuuuucccaaacuguauaccuuuaauuuuuuuuccuugccugguuguacugacuggaaccucuaacaucacguuggacaggguacuuuuuccugcccuauuuccugaaauaauucucguaggauugguauuacuucuucuuuaacuguuuguuuggcaguauuuaccauugaagccauguggaccagggaagauuuuuaauaugaauuaagcuuuuuaaugacaucguauuauucagauuuucuuuuuucaugaguaauuugguaauauguaucuuuuuaaaaguuuuuuuauuuuaucuaaaugaccuaauuugucggcagaaauuguucauaauauuucuuuauaagucuuuggauuucuguacaaucuguagugaugucaccuuccuuauuccugguacugauaauuuguaucuucucuccuuucuucauuagucuagauaaagcuuauccaacuuuggguuucacugauuuuuuuuuccuuuauauuuucaauugcauugauuucuucgucuucauuauuuccuucuaauucacacuugguuuacucuuuucuagcuucuuaaaguugaagcuuaaguuauuuucuccauuucuacuuuucuaguauaacuauuuauacuagaauauacuguauuuacuucuuuagcuguagucucuguguuuuaauaugugguguuuucauugucaugugguugaauauucuucgaauucauaguuucuuugacucauggguuuuuucuaagcaugguguuuaauuuccaaauauuugggguuuucuuagcauacuuuuuuuuguugauuucuaauucuguuguugaagaccauacuuuguauaauuugucuuuuuaaguauauggagacuuguuuuauggucuagcacagaagucugugaaguauggcccauauguagguuaccugcuuuaguaaauaaaauuuuacuggaacacagcccuggccauucauaaacauauacugucuuuggcuucuuuuacaccagaauuacagaguugcauaguugugacagaucuggcuccuaaguguaaauauuuacuaucuugacuguucaaaacaagauugcuggauccuggucaagcaugcucuccauccuggacagugauccacauaugcuugaaaagaacauguauucugcuguuuggagguugcauauuguaaauuaauggucaggucaaguugguugauauuguccaaaucuucuauaugcucaucguuuuucuuuucaaguucuaucuucaacaauaugguuggagauuucaauaacugccucucagaaacuguuucuucuuuuaguucuguuaguuccugcuuuauauauuuuaaggauuuguuuuaggucccuguauacuuaaaauuuuuacauuuuccugguauauugacccuuuuauuauagugaaguaguucucuuuaucucuaggaauguugucuuaaaaucugcuuuguuugauugauuucauaugauuccuguuuccauggcuuaucuuuuucuguccuuaaaaucaaacuauuuguaucucuggauuuuaaaaguuucauugacugcguaugguuagaucuugcuuuuuuauccagacugaccaucucugccuuuuuauuggaguuuuaaguauuguuugauuugcaccugccauuuacuguccucuuuuguguugaaaugcauuuuuaaguauaccauuuuaauuccccugauuguuuagccuguuauugcuauuuauuuauagcgcuugaugcagagaacgaauuaugcaucuuaauauuacaaucuacuucuacuuaacauaauucugguaaaauauagcagcuuugcuccaacacagccuuauuuuuucucuccucuccucugugcuguuauugucguauguauuauaucuauguauguuaucuaccuaacaauacagauuauauuuauauucauauaacuuacacuuauuaaauuaagaaaacaaucaagagagucuucuauauacuccauauuuaccauuuccaguauucuuuauucugucccaugaucugaguuuccauuuuuuauaauuuccuuuuagccugaaggacuuucuuuaauauuuuuucuagagcaaaucugcuguaaugggauuuuucaauuuugccuucauuuuucccccaguuuuuuuaaacuaugguaaaauugacauaacacaaaauuuauguuuuaaucauuaaguauauacuuuauuggcauuaaguacauugauuaugcaaccaccaucaccaccauccaucuccagagcucuuuauuuugcaaaacugaaacuauacccauuaaacaauaucucuccuuuccaccuuccccuccgccccuggcaccaccauucaaauuuuugucucuaugauuuugacuaaauacuucacauagguggaaucauauaguaguugucuuuuugugacuggcuucuuucacuuagcauaaugucuucaagguuuauccauguuguagcaugucaggauuuucuuccuuuuuaagguggaauaauauuccguuguauguacaugccauauuuggcuuauugauucaucugcagcuggacacuuuuauggucuagcuacuuugaaagugguuauacaaaucucucuccaagaccuugcuuucaauuauugugaguauauaccuugaaguggaauuguugggucauaugucaauucuauuuuuaaauuuuggggaaaugccaaacuguuuuccacaacagcaguaucauuuuacauucccaccgacacugcacaaagguuuaauuuuucccuguccuugucaacacauguuauuuucugguucuuuugauaguagucauccuaaugggugugagguggcaucuuggaguuuuauuuguaguucccuaaugaguaguaauguugagcauauuuucaugugcuuauugcccauuuguaaaggccuacaccuucuccaggguauucacggugacuuucuaauuucccgucauauauuucuuuguauaugugguugauuuugaaugucauagucuuuaguauuugguuuccaaaguggggaaaagcagaaaaaugaaggggaaaaaagugccagcccuuuaaauccccugucagucacuucagccagaggaggagggacuugcaacauuggggccaaagugcaaaggugaucacuucugucugcucuucuaugacaaaaagcagcaaucagugagcagagugcagaaccucaguacuuggaggacaagcuuccucacaucagauugauucugcccgugcaauuauugucuagguggggagcugauuucuguugcuucuucuuucaguaucuucccagaauccucaccugccuuccuuuuugaaggauaguuauguaagaauauauuagguuggugcaaaaguaauugcgguuauucccauuacuuuuaaugauacuuugcucuuucauugaacacuugauaauuuucucuuucauuuaacgcugugaguaugucauuccacugccuucugucaaaauuuuuuuuucugaugcaaagucaaucauaucguuacuuccuuguggguuuuuuuuucuuucucuuuucaacuuuuccucuuugucuuuaucugccaguacuuugacuacaguuugucuagguguaguucucuguauuuauuguauuugguggcuucuuggguuucauggaucuguagauuagugcuuaccuuagaauuugggaaguuguaauuguuucuuuaaauguuuuuaucugucugucuuuguagccucuccuuuuuugaacuuuguuuuucucuguucuuuggguuggauacuuccuguugaccuaucuucaugcucacugauucuucugccaucucaaauuugccauuaagccuacuuagugaauuuuuuauuccauuuauuaugcuuuucagcucuaaaauuucuaguucauucuuauuucucacauguauaggagaauauguaucucuguuucuuuauggaaauuuuguguuauaucauuauauuuuucuuuaauuuucuuaauauaguauucuuuaauuccuugaacauauaacagcuguuuuagagucuuuguccucuaacuccaacaucugggcccacucagaaguaguuuuuaucaaccauguccccuuccccagccuauaccuguccaaauuugggucacacuuucuuguuucuuugcaugucuuauaguuuuggguugaagcuuacccuuguuauuuuuaaaaauagcuuauccgaacaugcaauuuucuauuucaaagccucugcuacuggacuccuuaauauguguaaaugaagaccaaauggugagcaugacuuauugucugggaaaaaacucaauccauauuuuuucucugcuuucacaccaaaacaauaaucaucaauacagaagacuuaugugaccucaaaauauuuggcgauuucuccccacugccaagcaguuaauucugcugcggacaccagcugguguccucccuaucauuucugacacugucugucuggagauagcacgagaucccacagguugagggccuguccccaagacacugucccagcuuaugcccccagacaccaguugaaagucugggccucuagaacuucugauagcccagcuuaaauuagggauucccaucacccccucaagguuuuuuuuuuuuuggauggagucucgcucuguccacaggcuggaaugcaguggugugaccucaggucacugcaaccuccaccucccggguucaagugauucuccugccucagccuccugaguagcugggauuauagucgugcaccaccacgcucagcuaauuuuuguauuuuuaguagagacgggguuucaucauguuguccaggauggucucgaccucgugauccaccugacucggccucccaaagugcuggaauuacaggcaugagccacugggcccagccccccuucacagguuugauuaaugugcuagaucggcuaacagaacucaaggaaacacuuaguucaauuuguuggcuuauuaugaaagauacccuaaauuauacagauaaacagccagaugaagagauacguaggacaagaucuggaagagucccaagugcaggagcuucuguugccauggaguuggggugcaccaccauccugguacauggaugaguucuugaucaccuuccugucagccuccuuguauucagcuguccagaaguucaccagacccuguccuugggccuuuuauggagacuuuauugguuguccaugauugaagcauggacaaccuugucaaaaugugacuggacaaaaagagugugaccuaaacccagcaaagucuaucuguucagauucuucuuggccucucugugcagcauuccuuccuccagguauggggcagaacccucucugaaaugagggucuuaugacccaaaaucaaauuagagcccugccaaguggagaagugaaaagugaguaggagaaguucagagacagagauucuguaacaaggggaguuaagagccacgaacuguggaugaaaguccauauaucauaauaccauacuuacaaaguccuaacuuuucuccuaaagucuuuucaguuccuucugaguagcucagcuguuuucuguuuuggcaggugguguuguuuuccccuuuucguuauugaucccucucuccuuguuuauaauucuucagugccugcuuugacauuuugaccauucuuuuacauagauuuuguuacucucauuucuguuuucaugcaguuaguuucugauaccuaccucuauuauaacacuuuguauauaguaccuuucaucaauccuaaaauguauacuuucuccccagauuuugacaucucugaaauuaggauguauguuaugagugauggucauaguuucuaugaaauaugguauauugguuacuugcuuuucaguuuacuuccuccucuagauugugagcuuuuugugggcuuaaaaauuuuaaauuccacaccuauacuucuuccaucugugccugcuacugaauccacugugggugauugauuggaugccuugcaucuuuccugccucauugcccucaaaguucugcccaaaaccaccaccucaguaaagcuucugguaauuuuaucccagccagaacugcuuuccugccuuuggcauucaggcucuauaaggaccuuuugguacucaguguuuauacucaccguagagucucuuuuauauuguguuugacucaaguucuugccuuuguaucuuaucuccacaguacaggacugaguuauaguuuguguccaacauagccuagcaaaguuuucuguguauuaguaaauacugaaaaauauguuucauuuacuuuucucuuucagccaauuggauugagucuggggaaguuccaagauaugaacuguaguuagugguuguaaaauauaccuugguuuuauuguaauagauuauagcagucuggguucaguuaggagagagaaagaaguauuaauuaugauaaaagaguaacuaaaauagaaggaaacucuauaugguauccugaggcugagggagaguacccaggaaagggcaaacuuggaagguuuucacaccucauugcguagggugugguucagcccauugaacugguuuggcacugcugaacaagcaaaagaccucucuggaguguagacaccuaaggagaagggguaggagguggccauggugaccuguggcaugguguguggauaucagugagggcaagagacuuugcagaaaaugagaaaaauguaauuuguuauuuaaaagaugauucuuuuuacugaaaacuacauaacagagaaugagagcuauucuuaaaaugucucagugugcugcucaguguuauaaaugcauauaugaaguaugucugcauaucugaauaaccacaguauuuuuuagaauaaccuugacuuuuuguagccugugguuaccaaacauuuaacuuuuaaaaauuccgcaagaacauuuguaaacauuuuuauuauaucaguugcuuuuguuuuuuagguaaaaucuguaaaaacugggucaguuuuuuggacaaugugcugcugcuuauccuauuucuauaugguaagauuucauauuugagacuacaugaagucuaguaggucucuggagguuaaaacaguucuuuucuccugaagucuguaggauuuuuauuuuguuuaauguaaucuuucauuacuaccauccucuuuccuucuccuacucacagguccuguauacaccugcuuugguggagagggcuaacauuuaaccccucaaauauuugcagcaaguaaaacaaaauguuuucaaguguaccacuucaaaauacuuaaauguuuuauuaagaauuuuuuuuaauuuuuuaagauuauauucauuauuuauuuauuuauuuugagacggaguuuugcccuguugcccaggcuggagugcaguggcacgaucucagcucacugcagcuucugccuccuggguucaagcaauucuccugccucagccuucugaguagcugggauuacaggcgcccgccaccacgccuggcuaauuuuuguauuuuuaguagagacgggguuucaccauguuggccaggcuggucuuguacaccugaccucaugaucugcuggccucggccucccaaagugcugggauuacaggcaugagccaccaugccuggccugucauuucuuuuuucagagauagugucuuucucuguuagccaaucuggagugcaguggugcaaucauagcucacuauaaccuugaauuccugggcuuaagugauucucccacuucagcuuccugagcagccaggacuacaagcaugugccaccacgccuggcuaauuuuaaaaaauauuuuguagagacagauccucacucuguugcccagacuggucuuaagcuccuggccucaagcaauccuccuacguuagccucccaaagcacugggauuauaggcaagagcugccgugccuguuuuuuaacuuuuuaaugacuuaaauuuaaauauuauuuuucuauucuuccuagcuuuauucauuuuauuucauuauuauuauuauuauuuuuuuuuugagacagagucuggcucuguugccuaggcuggagugcagugguacgaucucggcucacggcaaccucggccuccuggguucaagcuauucucgcgccucagccucccaaguggcugagauugcagaugugugccacuaugcccggcuaauuuuuguauuuuuaguagagacaggguuuuaccauguugaucagacuggucucaaacuccugaccucaagugaucugccugucucagccucccaaagugcugggauuacaggugugagccacggcaccuggccccuagcuuuauuuuuuaaauagcucugacaaguaaaauauuuuccaaguuagauugcauacucaaaaagaacaggaaauuuugccugucauauaucaagcauggaaccauguuuagaugaaauaaguuuuuacuuaacacucaauuuuaaauaugguauuaaaaauuaguuuuucguauuggaguugacuagauaacugcuuaauguuaaaaucugaguuuuuaaacagucauuaucuaaacaguuuagugaagugaacuuagaacagagaaauaagaguacuuggaaguuuuggugaaaaagauaacccaaguaaagaguuaacuaaaaagagagacggauugagaaaaagcuguagaaagacuguucuucuggcccauuugcuuucauuucacuccuuaaaguaaaugaaggaaaacucuuaaaaugaauuuauguggguccgagaagaaauaaaucccuguaguuaaagaucaugcauaagaucagcaaguacuuuucagaacaucagauucacugucagacugguuucagcuuuucuuuguucuuaagugaagagaguagauaagguagcauauugauauuaugcucaauuuucaaccuuaauguaguagauaccuagagucauuaccgaaauaauggucauauccucuagguuaaccuguaaauuuacuuacuuuuuuuuuuuuuugagauggaguuucgcucuuguugcccaggcuggagugcaauggcaugaucucagcucacugcagucucugccuccuggguucaagcgauucuccugccucagccucccgaguagcugggauuacaggcaugugccaccaugccuggcugauuuuuguauuuuuaguagagacaggauuucuccauguggucagacuggucucgaacuccugaucucaggugauccgccugccucggccucccaaagugcugggauuacaggcgugagccaaugugcccagccaccuacauauuuuuuuaaacagguuucuuaagauugggguucaguauuaccuuuuuauucuucuuucucuuuuuuucuacaccauagccuguauaguagucuuguuuugaaaauuaaugacaauuugagcuaaucuuuuuuuucuuuuuaaacaaaugucauggaauaugugcauccaaguuaucugaguuaaagugguuagagccuggggcacauucuggguaguuguacuuagcaauaucaaacuuguucucuuucaaauuuagacuuaaauuuuuaaaguaaucagaagucuuucagauaggacuggcgcuccauuagaauaacauuguuuuuugugaaaaauagcaugugaccaaggcagaaaacugauguauguauugaaaacugauggcaguucuccacaagggguucugaaauauuuuacguaagagaagcauuauuggaauagauaugcuagcauauagucugcuaacaugacuguugauacaaaugagccuuucaagcucugauuauuagaggacaucuaagaacuuugauauugacaggagcuuauuaccuauuauuuaguguaccaaaaaauuaauuaauucuauugguugagaauggagauucucuuuagaauauucauuaauguagaccaagaacauccucaguuauucuggcuaaauaguguauauuguauaagccaaagauuaaaaugggaucuugcuuuguaauccauuuuuaagaaaaaaauucaugcccaacuagcacuuuuaguuuugagaaucucaaagcguauucaugucaucugaauuuuuuuuaguugucagugaguccuuucauugcucuuacucucagugaccuuucuuacaacaaauuugucauaaaaagugggugagguaaaacccguuuuuuuauuuucaaaauuuaugaucuauauccuaaaacuccuugucucuaugacagucuguuuacugacaauucacaaauuauaauacucucagcuuuucuauuaaaucuaauuuaauuugaacauuucuccagugcguuuggaaaagcauauuggauuugugggaucguguuauuuuaaugaucaauaaaaaugaggaauacguucuucauagguuaguaaguucuuauuuaagcauuucucaaaauugcuaaaaucuuaauguuuauauuugcucauuguauguuuagauuccuaaauauacuuauuuuaaaaaguaaaaauauauauuuaacuuagcacuucuuuuccuauaggucucugcuuggggugguuauguauuuaucaucaaucuuauuccacugcauguauuuguguuguuacugaugcagagauacagcaaaagagucuacauagguaaguaauuugauuuuugacaucugucaacuaagagauguuuuguauucauucauuuuauugaagagauauuucuauuuggucaauauuaugcaugaaaagguaaaaauaauuuuguguucauuuugcuguuuauauugauaaggucaggcauuuuuauauaagugcuuugucaucaacuuuuccuugacaaguuuuuuuuucguuuuuguagaaauuagucuggguuuaauauuugucuacacuuuuuccuccucuuaauuuuggggaaugggaauuuuuaucaugaaaaucguucacauuuuuuauaucgaauucaacuuacuguaagagauugacauccucaaaguaagcagcuuaauaagcuuucagaagcucuuuuuuggauaauguacuaauagacugagucucuguugucucuagaaaaauguucauuuuucucuacagguuuuaaaacaauauuuucacugugauguuuagcgguagaugauguuucaccuuagaucucauuuuccaugauagaguuagaacuucuauggguugaaggaacuagagagcaauugugaacugaaaccagugucuuaguaaaauaauacaauucuauuauaauaauguuuuuggaaaacaauaacacaaagauaaaucuuaauuaaauucauuuucaaaagcauaguagcuuggcaauuucucagaaguuaaccauagauucgucauaugaccaagcaguuccacuccuagguauuuacccaagagaaccgaaaacauauauucauacaaaagcuucuaugugaauguuuauagcagcauuuauugugcauaauggccaaaaaugaagacaacccaaaugucuaucagcuuuaugaaaccauaaaauaugguauauucauacaaugguguauuauuaagccaugaaaaggaauaaaauacugauauaugcuacaacaugaaccuugaaaacuuuauaccauuauguaaaaaagccagacauaaaaggccacauaguauaugauucuguuagugugaaauguccagaauaggcaaauccauagaaacagaaaguagaguuugugggaaauguccagaauggguaaauccauagcaacagaaaguagauuagugguugccuggggauuuaggaggaggagaauguggagaggagaggagaggugugacuguugaauggauauggggucucuuucaaggaugaggaaauauuuuagaauuauauaguagugauggucgcacaaccuugugaauacaccaaaaaccauuacaugauagguuauuaaaagauaaauuuuauaguauauuaauuguaucucaacaaaauaaaaaagcauaguauauuacauuuauagccauuucagcauacuuuuucauuugauacugugaggguagguacuauucucauuuuacaggugaggaaacaagaggagacauaauaauuugcuaaagaucauguagcuaauaacggggcugaggcuugaacucagauuuuggcuuuaaagccuguaaugagccagcuguaguagcucacaccucuuaucccagcuacucaggaggcugaggcuggaguuccacuugaguccaggaguucaagacugcagugugcugugaucuugccacugcacuccagccugggugacagaaggagaccugucucugauugcaugaaugacugaaugaauggcccaugaugcuaaaaaccaccaaaucugugugccucucguuuaaacaaauaaccguacuguugaaauacauacaccuauguauuucucuaccccaaaaacacuauaaacaguaguugggauccagaaaggagaauaauaaauaacagauuaaacuuuuuuuuuuuaaguuaaaugguuacagugaaggaacuaagaggguguuuuguuguugcugcuguuguuguuguuuuguguaaauuuaaaaauuggggaucuuggaaauuuaauggucagaggaauacaagagagagaagauugagaaauacacuuuaugaaaugccaugauucaggaagaagagccaaaggagaugucagaaguagucaaauaaguauauuguuaaaauggucagauggaaguauauucuacauaaaaguuuaaaauucaagcaguguccaacuccccuuuaaccuuagcaccaagauuucaaaggauuagaauuugagaaaggccuuuguauuugguagcugggauuuuuuuuuuuuuuuuuuuuuuggucacucuagaaaaauaugaaauucauacuacuuugguugauucuugagaguauuuuaagaagaaagaauaauaaaauggguuagggauguauguguguauaaagcuaauguucauaauguucaaauucuccacucuacccaacuuguuucuuuuacuuauaauuauccaggaguauuuugaugauuucuagucugcuuucuuaggguuuacuucuaaauggauggaaaguaguaugauagagcaaguguugcucuuccuucauccagagugugucaggauuuaaguucaauuucucuuaacuuaaugguccuaaaaacuauggaagcauuguaaaguguuuguauauaaaguucuuugauuuuggcacguaacauccuuugucuuuuguucucucuccccuugagcagaaauguuuagguaaaaaaaaauaaggauugauaaaugucagacucauaauuauauuaacuaaaaguuuaguuguguuguucuaaguguugaauuaaaugacuugaauuauuuuaaauaauuaugaaaaaguuguguccucuuugaguagauuuuuucaaguguccuuaaaaucaauuguagcacaaccacagaaaacugucaaaguuuauucacauguggaaaaggaggcacaugggugguaauguggauguauagugguagaagaguggcaugggaauugagcaagggagguguaagaaaagcugagaugggaggccgucucuacuugaaauuuugggaggaaaaauuuaauuuucuguuaagagauauuuuugacuuggugaauuucacuauauugggaaguaaauguuuaaaaauuauguuaugcauaggauucuacuguuuuaaaaggaacacccaaaccuuauguugcauuuguagaaagaauggcuugcaggaaaucacaguaaaacugaugggaugugaagugauuuaagcuuucuaauuugauuaaagcuuaucauacuuuguguucaugucauaaggaaauuauuaaagauaugaagucaaauuuagggauauuuacugugguauaacuuguaauugugaaaauauggaacuaacuuaaaugaccaauaggggaaugauuuuuuaauugcaguguugccauauggaauauuaugcagccuuuaaauuuaaucuuuuugaguauuugaugacacaggaaaauguuaauuaaaagcagacaguaaggauuaccagugauuuuuuuucauacuuauuucugcuuuccagauacauacaaugaguauguguuaaguuuauaauaaauaagacuugguuuuuaguuuauagaaauaggaauuguaccucaagggcugcauuaacuagauuagguuaguaauuuaagcacagaaaagaaaucaauuucuaauauugaugaaugcuuuugaaaugucacuagaacagcuuguuuauggcauugucuauguuuucugcagugaguugaguaaggagaguaacaguuguuuuucauauuauaucuaaaauguauuuuuuagaugauauuugcugggaaccgucauuaaaguuuuuugaacauacuaccuacuuuaguucuguacaaauuauuaugggcauuauauauuuugugaauaaagaaaagauaauccaauuauugaguacauuaaaaguaaagccaaauuauuaggagucacauuuauacuuggcagcuguaaacagaacacagcuaaugcuaguuuaacuuagaaaaaacaaacuuaaaaagauugcauguaaaaaauccagcauuaaaaaaagaaaaguucccggauacaagggcuggaagcucuggaguuuauuuugucuaauucuaccauacuacugaggaaauuaaagcaaauuucacucaccauacauuuauuaaguguugaaaaaauaaauacuguuuugugcuagccauuaugauacaaagaugaauaaaaaccuucguguaaggaguguauauuauacaguguaaucaauuuaauagcauaugaucaaaauggaaauagggaaaaauuugugaaaaucaguuuggacuuuaaccauguucuuuuaaaaguuuuggagauaagucuugaucuugagaagagagaauaguacagaagcagacuuagaauuugugguaauguaaccauaaauaaaaggugccaugacauugaggguaagaguacauacuccagagccaaucuaccaggguucaauucuugcucccuuacuacuguguaacuuuggacaaauuaauguccuuugauguccuuaggccuuaauguccucaugggucaaauaaagauaauaauaguuaccuuacagauuguuaaggauuaaugaguuacagguuaauauaugaaaggugcuuaauaauagaugaacacaaaaaaauacuauuuaaguguuugcuuuuguuguugauguuaaaguuaugaaggaauagccagauagacaaaagaguucaagaggcuaagagaggugauuacuguauuaagacugaaaggauaaaaccccagugugaaucuaaggaguguuccuucuuuuuuuuuuaagugaaaauaaacuuucacucaacuauuuuugguugugagaaacauaauggagaaauaacacuuguguguuauaaaguacaaaauagcaauuaaaauauaaccuguaauagguguuuuuuuuuauaauuuuaaaauuugauaauaaauguugauaugguuuggcuguguccccacccaaauuucaucuugaauuguagcucccauaauucccauguguugugggaggaacccagugggagauaauugaaucaugggggugguuuaucucauacuguucucaugguggugaguaagucucacaagaucugaugguuuuauaaggggaaauccuuuucucuugguuuucauuucccucuugccugcugccauguaagaugugccuuucaccuucugccaagauugugaggccucccagccacguggaacugugaauccauuaaaccucuuuuucuuuauaaauuacccaguuucagguaugucuuuaucagcagcaugagaacagacuaauacaguaaauugguacugguagaguggaaggcugcugaaaagauacccgaaaauguggaagcaccuuuggaacuggguaacagacagauagauauuggaacaguuaaagggcucaggagaaggcaggaaaaugugggaaaguuuggaacuuccuagagacuuguugaguggcuuugaccaaaaugcucauaaugauauggacaaugaaaucuaggcugagauggucucagauggagaugaggaacuuuuugggaaauggaguaaaggugacucuugguauguuuuaacaaagagauggguggcauuuugccccugcccuagagauuuguggaacuuugaaaucgagguagaugauuuaggcuaucugguggaagaaauuuuuaagcagcaaagcauucaaaaggugacuuggguacuguuaaaaagcauuccauuuuuaaaagggaaacagagcauaaaaguuugggaaguuugcagccugacaaugcaauagaaaagcagaacccauucucugaggagaaauugaagcaggcugcagaaauauguguaaguaacaaagagccaacuguuaaugccaagacagugggggaaaugucuccagggcaugucagagaccuuugcagcagccccucccaucauagguccagaggccuaaaggaaaacaugguuucaugggccaggcccaggacccucccugcugaguuuugccuagggacuuggugcccugugucccagcugcucuagccauggcuaaaagggguuaagguacaguucagacaauggcuucagagguugcaaccuguaagucucggcagcuuccacaugguguugagcuugcaggugcacagaagucaagaauugagguuugggagccuccaccuagauuucaaagaacguauggaaaugccuggauguccaggcagaaguuugcuggagagguggggcccucaaagagaaccuuugcuagggcaguguggaagggaaaugugggcuugaagcccccauacaaaguccccacuggggcacugccaaguggagcugugagaagagagcuaccgucuuccagaccucagaaugguagauucacugacagcuugcaccaugcgccuagaaaagcugcagacacucaaugcuagcccaugaaagcaaccaggagggaggcuguacccuguaaagccacaggggcagagcugcccaagaccauggaaacccaccucuuguaucagcgugaccuggaugugagacauggagucaagggagaucauuuuggagcuuuaagauuugacugcccugcuggauuuuggacuugcaugggaccuucagcgccuuuauuuuggcccauuucucccauuugggcuggguguauuuaucgagugccuguacccccauuguaucuaggaaguaacuaacuugcuuuugauuuuacaggcucauaggcagaagggauuugccuugucuuggaugagacuuuggacuguggguuuuuguguuaaugcugaaaugaguuaagacuugggacuauugggggacuauugggaaggcaugauugguuuugaaaugugaggacaugagauuugggaggugccagggcagaauguaugguuuggcuguguccccacccaaaucucaucuugaauuguaguucucauaauuuccacauguugugggagagacccggugggaaaugaugcaugggagugguuuuccccauacuguucuccugguggugcauaauaacucucacaagaucugaugguuuuguaaggggaaacuccuuucgcuugguuuucauuucucucuugcaugccaccuugauugugaggccuccucagccacauggaacugugagcauuaaaccucuuuuucuuuguaaauugccuagucucagguaugucuuuaucagcaguaugagaacagacugauccaaguguuauauaauugaauaaauguauauaguugaaaaagucaaauacuacaggguuuauagcaaauaaaacguugauuuccuguuuuuuguuguuuuugggggguuguugugguuguuguuguuuguagaaaugguagggggaucucauuaaguugcccaggguggucucgaacuccugggcugaagugguccucccaccuccgccuuccaaaguguugggauuacaggcgugaaucacugugcccagcagcauuuuauuuaauauagcuacauuuuguugccacaaaauauuugggauuacaccccaguauuuacagugguauucaguauguaauuaaacaaguaguuuugaugguuuugauccuaagguauugaaaacaauaagaggcuguacaguuuuauguuuguggcagauaaaguuuuaucaagacaagauuccaucuucuacagaugcaauauuauuauuugcauuaauuguuuugccuuuacuguuuauuguaccuucaagguaggugagccaagagcagacaggcaaacgggacuacaauaacuacacuccuccgccccuauuuuuuccauagguuuucauuuaaaauuagaaguuucaguguugauuacauaaagugaguuuucaagaugaguguuguaacaggcacugaagcuaguuauugggggaaagagaugggauuuuccuuagaucgguuuacaauauuuauggaucuucuuugcagcuuugccaguggauauuuuagagguuauugggguugggggaaacugaaaguucaaacacaaagggaagaugguauugcuugcaccaccuaugcugcuaauaugacucauuguguaguucacaaggauuaguccuccaguaucuccuuauauuaaaacucgggauauuuagagcaaggaucucaccuguguuguagcaauaaucauuggccugaucaaaaaggcuuucagugaauagaaacagucuucauguucuacaggccaaccauuaucuagaagaauagaccugagugagauuuccuuuaaaggucuauucuucucauugagaaauguguguuucauaguccagaagaauuaacuccugcauagaaguaguuauggauucuucaugguaucaguuaaaugaauuuaggagccuacuacaguaguagucgacaauaagaaaaggauguguuggccaggugcaguggcucacgccuguaaucccagcacuuugggaggcugaguuggguggaucacgaggucaagagaucgagaccauccuggccaacauggugaaaccccaucucuacuaaaaauacaaaaauuagcugggcuugguggcaugcaccuguagucccagcuacucaggaggccgaggcaggagaguugcuugaaccugggaggcggaggucgcagugagccgagaucaugccacugcacuccagccuggcgacagaaaaagacucugucucaagaaaagaaagaaaaggauguguuaagaagaaccaaaacguuuuuaguggcaacaugacuugugguaacaggauuugugauuuccuguaguuuaaaucuuuuuuuauuuuuuguuuguuuuacucucuucuuuaugagugaauuaaauuugcugguauuugucuuuuacuacuucuugauauguuagguauagucacuacuuagcucuagaagcuacugaggaucauuaccuaacaccucuuaaguuacauaaaaauuauauauuccaugaguuuuucauagucuccaaacacaccacacauacaguaccuuuguaauuucacuauauuuuaauauuauuucauuaaacauugccagaauuaaaugaauuguucccacaggguagaacuuaaaccaagauguacuuuguuuagauuuguuuuuucauuuuaguuaucaguaccagauacacuugcugaguuuguuuuuuuguuuuuuuguuuuguuuuguuuuguuuugagacagaaucucacucugucacucaggcuggagugcaguggugccaucucgguucacugcaaccucugccuccuggguucaagcaauucuccugccucagccuccugaguggcugggacuacaggcaugugccaccacaccuggcuaauuuuuguauuuuuaguggagaugggguuucaccguguugggcaggcuggucuuuaacucccaaaguucugggauuacaggcgugaaccaccacacccggccacacuugcuguuuuaaaaauguugugauuaaguaucucuacugaaguguuuugaacacguaaguaauuucuugcugcuuuuacaagucuggaguuuguaaaauauaaguuucagugauucauucucaacauaguuuauaaugagcauuguccuuggaaaagagaaaugauuuuuaucauuauguaugccuguuaaguuaaucauauauuucucugcuggucaagaagaaucaguguuuuguguuuuuuuguuguuuuauucuuuaauccauguuucuuacuauucuuuauccugcauaucuaccaggguucacaguaaccagaagugauuacaaagaaauaaaauaucuuuaguauucaaagccuucauaagccuuuaaucauauuuguuuauaauaaagcaaaauugguuggauuuuaaaguaucuacccguuguguguguuuuggcuaauacuauuuugguugagagagagcaaagcaauucaaaaaugcuaaugugauuuaacauggguuaaaguuaaugggaauauaguauuugcauaaccuuuucuaacuuuauuuacauaaaaagaaguauaacaauaacuuaaaaguguaaagagcacugucaauguaagcugcaaugccuuaucagagagaagguacuuaaagauugcuuuggggaacagcaaacuucuucaauacuuaaaauuucauuugaauuugagucagacuuuucagugccuuuucuuuucuagaauaauucacuugagcacauuaagucaaggacuaugguauauuucuucucuauaucugucucgucccacccuuggauauaaaauauuuccaagaauguagacaucuuuagguucuguugagauuauuacuuaucugucccagaugagagauuuucuuugguuaagaauaaacagaauaauaauauauguguguguauauguauauacauaucuuucuaaugguaauuuuuuguggaauuuuucucacacauuggaauuaucaucuccaguaaugaaugccaguaacugugcauccacaggauggcagugugguaacauuuucaugauguaauaaaugauuuacaacacuauugguaucauguauuuccuuagagcucaccacuuugauggaaugcuuuauucuucuaacuuaaaggguaagaaaaguagguuuacauggauggauagaaaauuguaauagauggguauaguaguuuaguuaggguucuuaaagaguucauuggaaggagaauugguagagaaugauggcuauggguuugucuuguugaggucuucugaaaacacuagagaacaguaccagacauuaauuaccucuucgaaguccaugucaagaaaagaagagaucuuaaguuuuauagagccuuucccccaccaaaugucacaugaccuuucuuccuaauauuaugguuauuuguuuacaucucugauuuuuagcaauuuaucugacucuuagaggguaggauugaucuuaaugggauuuucuguuuuuagaauauauugaccauacucaaguuaauguuuaaaugcauaaauugaagagguaauuucuaaacauauauuagaugcuguaguacaaagucuggcaaaaagcguauguuuucauuuugcaguggagauuguguuucuuuauuuauuuugagauggaguuucgcuuuuguugcccaggcuggagugcagugcgauuucagcucacugcaaccucugccuccccaguucaaacgauucuccugccucagccucccaaguagcugggauuacaggcacgcgccaccacacccagcuaauuuuuguaauuuuaguagagacgggguuucuccauguuggucaggcuggucucaaauucccaaccucaagugaugcauccgccucagccuccuaaagugcuaggauuacaggugugagccaucaugccuggccaagauuguguuuauuuuuaagaauugaguuacuucaccauuuuuuuuacucagauguaucuaauuucuuauuuucuaugucuuaaaauguagauuuguaaaugagauuuaaauugagauauagcaauauauguguaauuuuacaaauucaagcagagcagucaguauuaagcaagguauuuguuguauuugacauauuaucuggcaagcaaucuucaacuuuauuuaauggaaguacaaguugaguacuccuaauuugaaaauucaaaacuuucugagcaccaauaugauucucaaaggaaauauucacuggagcguuuccuguuuugcauuaccaguuuggguaugcucagcuauuaaguauaaugcaaauauuccaaaaauccaaaaaacuucuagucccaagcauuuuagauaagggauauucaaauugugucuauccgugcacugaagaguguuaugacauaaaacacauaccuccaauauguaaacaucucagguucagugauccaaaaaaugugaaaaauagguacuuggguccaguucucuuaaaaguaaaugcuuauguuuggauuguuguagauaccacguuuaucagauuuguaccauuggugcugguaaguggguaugaaugagacuaauugggauagaggaaguuucaagguaaaauacuguugaaaacuugucuguuucuauuaguuuaucuuuagcauuaaccuauguuuaccaaauaauacaaauuaaagucccaccugggcuuuuucauuuccuauuuucuuuuucuugaacucuccaucacucuuauuauuaacuuaaacucuagugcaucugcuucuguauaaaauguuuucuacuuuacuaaugauaguaaauaucucugagaaguugcagggaagugcugaauugagaguauuaucgggucuccucuuuucaaauacgccuggaaaugaauuugagcaaaugucuaagaugaaacuucaucuguaguuaccaaacaugauugcuaaaauuuuuacauugucaagcaaaguguggcuccauuugaagagaaaguaugaauaugacuaugaauauguauuuguguacccauauaccugcuagugauuauuucuggagaaugugacuuagagggaaauaaauaggguggaaacuuuuucacuuuuuacuuuaagacaaaaacaacaucuauuaccuuugcaauugaaccaauuauccauacagacagaugcagauuugugguuaccaugggcuggaaauaggacagaauguggaguaguaagagcuuagugaguguaggguuuuguuuugggguaaugaaaauucuuuaggacuauagagggguagugguugcacaaccuuaugcguguacucaauaucccugaauuuguucucuuuaaaaugguuaugucaugugacuuucaccucaauuuuuuuaagaaggcuuuuucauucaguuuguaucauuucuuauauuaaaccuaaauucuguggcaguguuacagcauucaguguuuauuuguacuuagaagaaagaaauccagcuucagaagugauugucguguuucaacauaaguggacuuagcuauaauaaaaacauaaaugacauaagguuuucucaggccuagucaguuucuaguugugccuuuguguguucaguguuugucuaggauuugacuucucagcucuggauaucugaaaggccuguugaucauagaaucuuaguuuauaauuguugggagggaucuacaaaucuuguccaacccacauucuauagugaggaaacugaagcuuuugcuguuaaguaguuguaagauuacauagugaucuucuucucaguuuuuaauuuucuuuauacuuuaguaugcaugguucuuuuuuuuuucucucucuuuccugccucugugacucuccuuuaucagggcuucaacaggcugauuuguuuaaaaaaauaauuuguagacauuucgggucaugugacggggaaauuuuuguuuaacuuugauuacauuuggguuuggguacgucauagaggguaauuccauuccaacauuaauguguuuggaaagaacguuaucugauggauuaugucuguugucuucuagacaucugguccuccauuagcuugaggucaguggaaacuuuacuuacuuugguccuuccuauuaaauuuaugagcuucuuacugucuuccuaacacuguggucaucucuuaucauauagauugugaggcaacuuaauauuugaaccaguagccccuaacuuccuucucuagauggauuucuuuuaaaagcaaaugaauauucuuucucaucuaaguugggugaggaggaaaguguguaguacacuaugcuacacaguauauaggauacacaaauacguguauuccuaaauauaccccccaaucuuuguuuuugauagaguaguuuauuugccaaaaacuauuaaaugauguguaaucuguauaaaugggguaguuuuuacguuaacuuauuucagaugggcuuuauuucuaaugaauuuuuaguuucagugacuucaaauacuuucucucuaaucaauugcguaacaguggucugugaauauaaagcagguauuugacacaaauuguaaaucccuccccaguuuccuuguccauuuagauugacaaacuuaauuuagauugaugagaauacuauaacauacuuagugugaaaagaagugaguuucuuuuauuagaugcuaaauucaguagcuggucuguauaauggcuugacuucuguguacuuaguucuuuaauuacagaaaacuugguggacauaugaauuuauuuaacucauaguacuauacaaagguauuaugggauaauaaaaagguaugaacuacuucagagcuuuugagacaguagcagguauucacacaugcuggcaguggugaugaguauuaagucguguauuuuggauuaaugccaauaggacugauauuuacuuaauuuuauguauguauuacuuagcuucuugagucguaugaaugauugcuaaugguagaucaaaacaaacuugauuccauuucugggaaaggaaugcaacacaagucucacaaacuguuguaaugaucugcaaaauauaguacuuaguauuuuugaaaaauggauagaauauucagaaucuguaacauaugguuaacaaauggacaucuaauaaaagucauuucaagauucuguucuuaaauucaguuaauacuuugcuaaaaacaggauuuacauauacauuuauguuuuagguacuuaaugguaguaguaaauuauccuuguuuccuauuuugucuuuauagcauauagcacuuucuacauuguggguuuaauauuaucaaugcagauaccuuuugugggauuccagccaaucagaacaagugaacacauggcagcugcagguaugaaaaauauauauuuuccuucuucuaaagaauauguggacgugugauuggcagucuuccaagagaugacaguuuuugaucauuuugguuguugcaaugacaaccaaaguaaucugacucacaauuaugggaaaucuguagauaaaaauuuuaucagagauucucauugcaagguucaugacccauuggaagucuguggguaguuauuuuauuuguaacaucuguacacugauacuauauagauagcaauauauaacuuucagaggugguguuucuauagaguuuauuaucagauucucaguggagucugacuuaaucuccaucuucccagaauaguuaagaaucacuaucuuacuguuauauagcacuuuaaaauuuaugaaaugcuuuuacuuagauuucugaauggauguugucacuuuaccaaguaguaauuugagacgcagagagauguauauuuaguguuguguacacaauaaugaauagaaugucuauguaauuacgcagucaccugucuuuacacguaugcauuacaacauuuccuaaacucuaaaucuuugauaauacuuacuuaaccauuguaaaauggacuuuuaaaaacaacccuuaaaauugaauuuauuuuuaaaaauuaauauucuagaugcuugaggauucuuacauccucuuuguuuaaaguuuuauguuuaauguuuuuguaucauguuuuguacuuuuugagaauccguuuuugcgacuacuccuuuaguuuuguauaucuuagcacucaccuuuauauuuacuaauguaggggagaaaagauuguuaucucuaacaaaagacagauuaacaagagaaaagcauaaauuuuacaugacacaagagucuucagaagugaaaauuuuaaaaaggcagggaaacuguauuuuuaugcuuagguuugaugaagaguggacagucauguagaaauaagauuggacaaagagaaguacgaucuaauggcaacagacugggaagaacuuaaggccuauuuguucauauucuucuuggugucucugugucuucaucuuuuccucuggguguuagaaggaccccucuggaaugaggaucuuauaaccuacuuacaggaaggucagagaauuauuuuaugaccugccucaggggagaacaaacagaaaagaugagagagacuucccaguuucugcugguuucucaaaugccaagaugccauaauuuggcaugagcccugauacaaauuuagaaucuugucuaaauguguaauuaaggucacaucuuauuacucaguuauaaauaguaacuauauaucaagauuauccugauccuaagucuuuguauccuucagcaaaacaaaucggagaauuguuuuucagugauuuugaaaaauuacuucccuccaccccagaaaaccccccuaaaauauagaggaaagggaggaacuuaauguguuaaauaggcuuguuauucaaaugggauuuuuuuuccccuuuggucugguacauguguaaggagucugaucauuuaggaaaaaaaaaaaaagucacagaauuuuuuggauguauuaauuaggcaacugucauuugacaaaggaaauguuggcuagaugaaauaaguagucuuugauaugaauggugcaggacauucuaagaagcucuuucaaaugaaaguuuuuaaaugaccuuggaaaacugcuuuguugauuaugugacccuuuucuuuaauuaggugucuuugcauugcugcaagcuuaugcuuucuugcaguaucugagagaccgauuaacaaaacaagaguuccagacccuuuucuuuuuggguguaucacuagcugcaggugcuguguuccuuagugucaucuauuugacuuauacagguacguguuaucaccuguagggugugaauauugucuauacaaacaauauaagaaaaauagccaaaguuucuaaaaucugaauaacagcaugacuacaaagugauuuuuuucuuuuuuuuuuuuuuugaauaguauaucuuaauuuuguggcaucaagcucugauaaaucuacuuuuaagcguccuucucuugcuggaugaauagucccaaacuauaaaaagaaaaaaaaaaucagagcuucuguuauuuaccuguuauaugcucaccuucucuugcaugcacacacacucccucuuucuccccuacuuuucagcaguuuacuaacagaaucaguuucagucugcuucuggauucuaaguuacccucuaaccuuuauuuaccaguccuuagaaacaaauugaauucuuucuaaauuuauucugucaaauuaauguaaaagccgugaguguuuaaaaucaucuuugaauuuaucuggugggauauggcauacuggacuagaucauuuagaaacucccuuuccccugccccccguuuauuuuauuuuuuuuaaaugaucuggucuuguuuaaugccuuagccuuauuagucaacuaaaagcuuaagagaauuggaaaacuuucuacaacuuuaucucaaauguguuucucuggaaguggguucuccauggauauuguuuuuauuugaucacuaccuuauuuuuucugacugccaacugucugaaauagguugacaccuauaaaugaaaacugaaauucuuugaacauuaguuugucuaucuauaauuagcaauaaacauaaaggcaauaaaagauuuacaaaauaauaaaaaggcagauuaauuucauccauguuuuuccuuccaagguuacauugcaccauggaguggcagguuuuauucauugugggauacuggguaaguacaguuacauuauuuggcaucauauuuauugaaauacugcuuuuccuuuguuuuuaucuguuuugucaguguuucacucaguucuugggcaacacuucuaaguaccaaagaugcuaguuuaguaaauguuaaauuccuuuuacuuuaucuuguuaugauaccuguucugaaugcaucuuuaguaugaaauguacguuguguauuacuguucugcaugggcaacuccuuguuuccguuuuguuuguaagaauauuuagguuaccuuugugcaauuuaaagauugauuugucuuuuauaacauuuucaucuuuaguaauaauuuuuuauucuuaagaauucuuaaggauacuguuuaauugccauagauaggaagaaaauuuaauuuuuucuaauaccaucugaucuaaguuuuuuuguuuuuuuaaaucugugaaacacaagagaauauauaucuguugugguuuuuuuuuuuaaagugcuguuauaaaaugaguuaauacauuugguuuugaauuagacuaguucaauaaaacuuuuuuucucuaaaauguuuuccuggagauuagaaaauaucuauugauuauaauuuaugccccuccucuguuccugcuguucugucuuguuacuccccagguggcucaauaaaaaacaauuuauugaacagacaugcuuucugaugugauaccagaaggacuuguguccaggucuaauuaaaggacauaagcaaauuaugcaugaaugacuggaacuaacaauuagacacauacuucaagaguucagccuguggaucacuaacgaauuugaaggauaacccaaguuguagaauguuauucugauuagguuaaauuacuagguuaacuugugcaguuauauuauaaaguaauaauauaacuguaaaauaaauuauacaguuauauauaacuguaaaguaaaauuguaauauuauaauauaacuugugcaguuauauuauaaaguagucaauuaauugacuacuuuagaaucucaggguguuucaguaauaauuuuuucaguccuuuccauuuccuucaccugucuccaugccagcuucaugucaagcaaggcauuauuguguaagguguaauuauuggguaaaguauuucugcuacagguugaguauucaaaaucugaaacgcucuaaaaucaugaacuuguugagcaccaacaugaugcuaaaaggaaaugcuuauugaagcauuucagaauuucagauuagagaugcugaacugguaaguauaaugcaaauauucuaaaaucugaaacacugcugguucuaagcauuucagauaaaggauauucagucuguaguaauaauuccaaaagguaaugagacucguugaugcaaacaugaaaaaugcugacuuaaacuacagaacaaauugccaguugaacagagauuucuguauuggaauucagagccaacauucucaugucuggaucuagauaauucucugaauuuuacagagggcauauuaguuuuaguuuuaccaguguagaccaaacagaaacuauccaguauaacugguuaccuuggaagguauauuuaaauaagaagggguagggaguagguaccauuucuacaaccaaacaagauuucuucaucuaaaaggaacuccuguuuuaucacuuaauuguaaacaauauuaacuuuuuuaauaccagguaugcaaaaauacacauuccaauuauugcaucagugucugagcaucaaccuacgacuugggugucuuucuucuuugaucuacauauucuuguauguaccuucccagcaggccuuugguucugcaucaaaaauaucaacgaugaaagaguauuugguaagagagguuuuuaaugaauacuuugauauggaauaguuauuuuucuuuuugagauuauuuacuuuaaauuuuuguuuuucuauguuugacucuauauauucaagauaaauuuucuccuuuauuuugcauaggugcuuaaccaagaaaaauucacugagaggcugggcaugguggcacacgccuguaaucccagcacuuugggaggccgaggcgggcggaucaccugaggucaggaguucgagaccagccuggccaacauggugaaaccuugucucuacuaaaaauacaaaaauuagccgaacaugguggugcaugccuguaaucccagcuacucaggaggcugaggcaggauaauugcuugaaccugggaggcggagguugcagugagucaagaucaagccacugcacuccacccugggaaucagagcgggacucugucucaaaaaaaaaaaaaaaaagaaaaaaauucauugaauuuguauuaaguauuuugauuguuuuaauuuaggacuaguauauuaugguuucugagagguuaauguuguaguuuguguuugagaauugaaaauuuuaacuuuguugacaauagccuugacuuuguuuucugaguaaaauuuuauuuaaguaggaagaaguuuuuagggacauucaucuuccagauuucagagcaaagaccauuuuauagcggaauaaggaucaccuuucacuaaacauccucuucauugacagauuuguauauuuccaacuaauaagacuugaaauacaaaauauuuaaaugccaaguauuuaggguucuauauuucuaauauaaguggacaaaauaagcagauaucaaaggcuucuacaugauuuaaucacacaugaaauaugcugugguuguuuuguaugagauaaaaacugaaacugagaaaaacuuuaucacgugcacaggaucacaccaguugguaaguaauuuguagugcuagaaacuuguacaauuauaggaucuggaccaugagugacacaugaaucaggaaagaaagaacagcaccuguagggguucaguuuaaaggauugcacacucauuguucucuagguuaauggauccuggaugaggcccuguuaauacugcaucauucaagaagauuuaacuuaaaccucaugacucaguaaucccauuccuauguauauaucuaagagaagugagugcauaugucuaccagaagacauguuuaagaaugcauuaguaauuuuaucuacaguaaccccuaauaguaaauauuccaaagucaucagcaguagcaugaauaaauuuuuguauaucuguaguggaauacaacacaacaaucauuaaagaacaggauggggaaauaagagaagccaauacaaaagagaacauuuuuaugugguuacauuccuguaaaguucaacaauaaggaauacuaauucuuuagaagucuaaauagugguuaccuuuuuugauaggggaggggguuguuacugacugagaagaggcaugaggacauauaaaaauguucuauaucauuauggguuguaguuacacagguguguauauauacaaauucauugagauacacacuuaagaauaugaugcgauguauuuuuuagucaggaagaaaaauuuaauuagcaucagauaagguaggagcucacaugacucacugaauuuguaaaguuauacauagccuucagccagaaauaguuagagucuuuuccugugguuagcacauuauccagaaagcucuggcuauuggaaauuuguuucaaaaauuuuuuuuaaguuucuuggcaguaacuuugcagguuccuccuuugauuaauaacuuacguucuucucaucccguuuuuguuuuaaagcagguuuuaugccagauauuggcacuggcuuuuuauagauuuuaaaucuauaaauuuauuuugccuggagaugucaugcacaaauauguuuuuaucugccagcuauggguuuuuuaugauguuauugacaaauagugaauuaagucuaauucuucauaacuaauuaaauuugaaucauauacauuuuucuaaacuguggauguguagguuuuauuuagugaacacuaguuauaauuucuaaauguggcuaauuaaucaguuguucaguaguaucaauuuagaaacaauuagaucguuugugagacauuuauauaauuccagguugguuuuauaguuuuaaguaucuaguucaguuuccugggaacuuuuucccuccaacauauuguaagagaauuugucuuugcaguugcucuauaugcaaucagugcugucuacuuugcuggagugauggugcgacugauguugacuuugacuccagucguguguaugcugucugcaauugccuuuucaaauguuuuugagcacuauuugggggaugacaugaaaagggaaaauccaccuguggaggacagcagugaugaggaugacaaaagaaaccaaggaaauuuguaugauaagguggggaaucuaaaguaaggccuuuaaauugucuauguccuuucuuaauuuuuccaccacaguaagaacuauacauaucaagaaauguuauuaaaugaugauuuggacaaacugugacuuuucuaguuggucuccacuguuugccucaaaauaugaauccuggucaguccuuuagcucagaguuagaaaauagaauguaaucagagaaggaauuccucuuuuugguaauuuguuaucuaaauacuuaagauauauacccuuguuaauauacccuuccauuuuugagagcaaaaacuuuaugcuguacuaaauuacauaacauuuggcacuguaaaccccucugaaaccauguggacagacaggugcuuauccuugagguccauacucagugcauacuuucaaaauauuuuggaagugacauuugauugguugaacaguaaaaugaagggagcaaaaugccuuuuuuaaaacccuccaguucguuagcaauagguaacuggccaauacagguaauuuauuuuuaaucuauaguuucucaguuggugcaagugugaaaaggacuuguaagaauuagagcacuugucuuggaugacauauuaaacuuugcuauuugaauauugccuggauuuuaaaauacuaauaaauuaaacuucccaguaucaguaauaacuuugaaauucuuuccuucuauaagaugaauguaauucauaaagauguguguuaauaaacccacauuccugauuuuuguguuuguuguuauuguugggguuuuuuuguugcuuugugguuucuuaaccagccuugaaauuuagaaguugugacuuuuucuauucucucuucccuuuucuguuggggaaggugauuuuuuaagguaaucguaguuuuaacaagucuguugguuuuaggguuucgaaaucggaagacugauucuguuaaugcaguuuuuuccuauacuaaagugguacauggucaaaauuauagcugagcauugccauuuucaggauguggaauucagauuuuauaagaauuuacauauuaagauuucaccagaauggggucauuugguuaaucuccuuuguauuuaauuaaaguauaaggacaacuggguuugaaagcagcuucuuacuggagauaauuauuuugcucugugaccaguuucuggauugguauauucccaggaaaccuuauucacguuugacuuagaaaacacuccaucacccacauaagaauaucugaugguuauacauuuucugagucauagaauuaaauugauagauaaacagucucucaacuuuuuccauugaguaucuuaaugaagcaagucaaauaaugaauuugucuaaccaauuuuuuuaauaucuuuaggcagguaaagugaggaaacaugcaacugaacaggaaaaaacugaagagggauuaggcccuaauauaaaaagcauugucaccauguugaugcugaugcuauugaugauguuugcuguccacuguaccugggucacaagcaaugccuacucuaguccaaguguaguccuggccucauacaaucaugauggguaagaaaauaacucggauacaaaaacauuuuauacuuacacuucuuuuucguugucucaaaggauauaauuaaaaaauagaauguuguuugugagauucugcauuugcuuguuuuuaauuuuuuauuuuaauuuugguagguacacaguaaauacauaauuuuaugggguacauucuauuuaugucuuuugauacaggcauguguaauaaucacguguaaaaugggguuuccauccccucaacuauuuauccuuucaguuacaaacgaucaaguuacacucuuaguuauuuuuaaauguauaauuaaauuauuuuugacuguaaucacacugugguguucguacccguuaaccauccccgugcacucucccccgccccugccagccucugccuugugcuccugugaagcucuguauuugaaucuaccuuucuuuguccucuccuccaccuuggugccauggguaguaaucauuguauuucaugcucuuuuccagaauauuucugcaugcauaaucauauacauuaguuuuucucaaauguguggucuuuguacacacagcaucaucauuaccaugaaacuuguuagaaaugcaaauucuugaccucacccuaauguuacagaauuagaaaccuggggcuggggccuagcagucugugguuuaauagaccuaggugauucagaugcagcuaaaauguaagaacagcugauuuauguauugccauggcuuucaacuacucuuucacuugggagcuuauuaggcuuguacacuauuaggcccuaccccagaacuacugaaucagaaucggcuuuuuuuuuuuuuuuuuaaauacaagauaugcaggugguuugugcacacacacauuaguuugaauaacaccagucuagcucuucauuguuucacuuuuuuuuuucucauugguagaggcuuuuacuuaauaacuaccauccuuaaaaucugaaaguauucagugguuuaauaccucaagauuuuaaguuagccucuucacauuugugacaucucauuuaaaagaguauugugauucuuuucagcaccaggaauaucuuagaugauuuuagagaagcuuacuuuuggcuaaggcaaaauacagaugaacaugcacgaguaaugucuuggugggauuauggcuaucagauagcuggaauggcuaauagaacuacguugguggauaauaacaccuggaauaacagccacauagcacugguaaggauuuacuaaauacaagguuaaaaaaucuuuauucacuccuuagcaaucaggcuucacuugugacuaaauaggaaaaaugugggugaaaaguacucugcugaauucucaaaauacuuuuuuacacauauguucaauaaagugaguucaaggugugcuuauuuuguuuuuaagaaugauacuaaguaucauucagaauugcaggcugauuucugguagauuuuaugauaaauuuagcuuacugaagaauuagacaaaaucugaaacuuaaaauguuuggcuuguauuuuucguguuauaaacuaaaaauuauuugcaaauauguaaaguaaaugcacuguauuuuauggauaggcaaacuguuccucuagcuauuaaacaacuaaucugcauagauuaauguaauccccucuuuguacuucaaagauuuuuaaauacaaagaguagucuuaaccaaaugaauucuauuuguauuacuguuguagcuaauuaucagaugcaugcuagacuggggagaagaaauguaugugcuagcaagaucacuggccagcccuggccugcgguugugagaaguuguuuuuucuaagcuugccugcuuucaucauaaaauguuaauguuauagaacuuaauuauuagcaaaauauuagagcauguauucugauuuuugacuguaaauuaguuauaguaguugagagguucauaaauuccaaugcauuuguugaauucauaguaaaucauuucugcaaaaaaauuccauguaaaacaaacucuugaugaauuccauguuguaguaaaaaauauacauugauuuuuaugaaugugggaauaaucaaaaacauucucauuuuuuuuuaaauucugcaggugggaaaagcuaugucuucuaaugaaacagcagccuauaaaaucaugaggacucuagauguagauuauguuuugguuauuuuuggagggguuauuggcuauucuggugaugauaucaacaaauuucucuggaugguuaggauagcugaaggagaacaucccaaagacauucggguaagaaacuagauaauuccagguaugugaaagauagcucacuguguccucguaauucucucaucuugcuaauugcauuguauuuguuucaucauccuaucccucagauuaguuccuuacccuggcuuuacuauuuauuaaagauaguagaggcauuuccuauauuaaaacuuuuugaagucaaaauggaacuaauauaccauucuucccuaugaagcagucccuugccaagacuucuuacuuuuacgucucuucacagccucucaugucaucccuuucuuuccauuuccauugcuuccacucuaguacuuacccuuaugcuuguaaaccugaaauaggauaguaaccuugaaauugcuaucuuugccuuguuuccucccucccaguguaagauaaaauugaucguguuacuuuuaggcucaaaagacuucaauagauuaagggaaagggucuuaaaaccauauagacaugaguuaaaacuaaaacugucaacuugggcaaguuauuuuagcaagucaacauaauaugcuuugagcacuaggucuaguucuaggaucuggaauuaaaauggugaccgaggccgacuagguuaucuuuugccaaaaauaacuaauuuauagugccguuuaaugagaauuuauaguaaaguaguugaagccccagccuagggacugguacaaaauagauaaccucugauaaaacauuaguauaaaguguaaacucuuuagcuuggaauguaagccucuuuauguuuugccuuccuuugcuggugucuuguucuucugccaccuuugucuacucugccaguauguucuagccccugaaacuugcuugugcuuucuuuccuugacucaccugacacguguguuuuuacuguucucuuuccuggaauaccuucccuaccacagacuugcccccucuccaaaagcccuuuucugguauacucacaucuguacucaucaccaaauuauuuauaccuguuuugcaggaguccccagaccccaggcagcggaccagcacugguccguggccuguuaggaaccaggccacauagcaggagguaaggggcaggugagcgaucauugccgccugagcuccgccuccuaucagaccagcggcagcauuagauuuucauaggaguacaaacccuaucgugaacugcgcaugcaggggaucuagguugcauguuccuuaugagaaucuaacuaaugccuguugaucugagggggaacaguuucaucuagaaaccagcagcccuccgccauccguggaaaaauugucuuccacgaaacuggucucuggugccaaaaagguugggaaccacugcuuuuuuguauuagauugugucuuaccucuuucacuaaauugugagcuuuuagaagauggacauccagcauugugcuuuuacaugaugaaggcacaaaagauaagaguaauugccacugauccagaauaaaggaaucuuuugggaaaaauguaugcaggugucgugugaugcagaugaaguaaagccucagauuuccuggucaaaugucaaugcuguaauguuucccuuaacugugauuaguaaacauuauuuuuuuguauuaaucuucugaaauuuaauucucccaguaugguuuuuauuuguggauuugcuuuagcagucaguguuaaaacugugacaugugauagaucacuguuucuaaauguaugcuuugaacauuaauauuacagaaguccuaaauuucugugcaucuuaaauuauuuuuaaacuuugugaauagauaauacacucauaugguucaaaaguaaaguauaagaggauauacaauaaaugucuacccccuucacgugauucaaaaauaaaguauaagaggauauacaaaaaagucuacccccccuaaaaaaaaaaaaguuccucuauagguaauaacaauguauuguguacuuguaaguugcuaagagaguagauauuucaguguucucacuacaacaaaauaaguaugauugaugcauauguuaauuagaucgauguagccauuucacagugcauauuucaaaacaugguguacaccauaaauauacacaaauuuaugugucaguuaaaaaugggggggcgggcgggcgguggagucccugguaaucacugguuauuuucuugugauucuuaacuucuagcaaguuauauacccuguucacuucauaauaugucuuggugauuuuuccauguuagaauauggagaacuucuuuauuccuuuguuuacauuugcacaguacguugcauuuuuugugugugugcaugauuuauuuaaccugucaccauugauggaauuuagauuguuuccaguauuuuaguuuuauaaacaauggcauaauaacuuucugcauucauuauuuuggccauauacaaguaucucuguagcguuaauuccuggaaaaggaauuucugacucagaaauuacauuuuuuaccuagagugccaaaauuguuccucauagagguuaauuuauaaguuaaccccauaaaaauuaccacaggagucuuuuuaacauuguccuccccaaauaaagccgauuuuaaaguucauguggaaaaauuuagcuagaacacuuaagaaaacucugaaaaggaguaacggagaugaggauggguaauugagagagccagccuuaccugguauuaagccaugguguugguaccagucucuuuaaauuaugaaaguggcuaugugcaguggcucaagucuguaauccuagcauuuugggaggccaaucacuucagcccaguaguucaagaccagccuggacaacauggugaaacccugucucuacaaaaaaaugcaaaaauuauuugggcguggugccgugggccuguagucccagcuacuugagaggcugaaaugggaggauugcuugagcccaggagguugaggcugcagugagccacagucacgccacugcacuccagccucgaggacagaacgagacauugucucaaaaauaauaauuauuaaggccuuauaacaugguucgaagucuggugggauuaauuuuuuugagguguaacugaauauggcuuuauaaagauaccucagaagcuuauucuuacagggaaaugaaaagaggaaacuguagcuuugaauauguuaacuugaacuaacauagaacuugugguuucuuucuuguaggaaagugacuauuuuaccccacagggagaauuccguguagacaaagcaggauccccuacuuuguugaauugccuuauguauaaaaugucauacuacagauuuggagaaaugcagguuaguuaaauccauuuuucucuaauuuucauucaaaauaauguuuaaaacaagucuuauuugccucuagaaaacaggauaaugauauuuugauugugcugaagagaaaugugcuuaucuaaauagucuuuuuuucauuaaauuuagauuucugaaacuaauaugugagaaauuagaaaauaaaauuuuagaucaaggacuucuuucuaacauauuuauuaacaguagccucaaauccaaucuuugcuugccaucucaccauuagaacucaugcuuuuggaaaguauuguucuccaagaagaguucuccuagcuaggaaacaguguggugucuuaggucacuuugcugcuugguggagaaaagcuuaaaauuaaagauucgaaguaaauagucacuucagauguucacucucuccccauucuccguuaccacaaauagcuagagcugccugggucagaguuuucuaguauauuagaaugaugugguacaaaagcuuaagggucuacaaaaugagugaaugugcaaagaggcauuguggcagaaagaagaaacaauggacuugaugucauaacaccuguguuuucgaucagguucugucaagucauguaacucucagacaauuuguaucugccuuggauuccacuugguucuuuucuuguuuguaaauaauggggcuuggauugaugacuugauuuuuaaggaaaccagaauaugucaccccaaaauaugccucuuugacaugaaaguuaauuuugagcugaaggcaauuuagaagcagcaaacagagaaaaaguucuaucuaaccucuuuucugccuaaaggcagaauauaaauucuccuuuacuggagacaacucuaagacucuuaucagcccagagaaagcaccagaggaaucugcaaacaaaauuuacuccauuaguuucucccauauauguacccuucuacuaguuucucccauauauguacccuucuacuuucccaucuugaaggccuaagaccacuauccuuuguccuuucuccacaaauguauuguucuuuguuaagcaugcuauaaaagccagaguucuaagccacugcuuugaguuccuuuucauugagguuucuccugcauaaugugcgccgaacgucuuaauaaauuuguuuugcucuuguuaaucuguccuuuguuauaagugucugucccaaauuuuuaucuucauacuauuaguuucacugaaaacugcuuauuucuguauugcucucugguuaaguugguaagaaagcagaggaaaaauugcuugcuuaauuuuauacuaucacuggggaucaagauaacuaucaaaacuaaagggguguguuuggaccucaauuugugaaucaaguuuuaccguguuuuuuugugguguuuuuuuuguuuuuuuuuugagagggagucucgcucugucgcccaggcuggaguacaguggugugaucucggcucacugcaagcuucgccucccagguucaugccauucuccugccucagccucccgaguagcugagacugcaggcggcugccaccacaccuggcuaauuguuuguauuuuuaguggagaugggguuucacuauauuagccaggauggucucgaucugaccucgugaucccccugccuuggccucccaaagugcugggauuacaggcaugagccaccgcgcccagccccaaguuuuauccuuuucuaaaacaccaucuuuguggcuaauauggacuagaauauucacuugguuucagaauaguuagcauauacuguguuccuguuuguuguguugcuucaaguaauuccaagugaaucauauuuuaucauuauucacuuggaauuacucuguagaugacuuaaaaaacagcaggugauaaucuagauuuagguuuuuguuuguguuuauaauuucuuuugaaggccacacuuggucuuuaaacgcuugcuaagaaagaagcacacuggccauaauaaucaguuaccccagaaaacauauuuucugauuggcuuguuucugauuaguuucucugcucacuacugaucacguugaaggaccuuuuucuuccucucuuuuaaguuuaucaauaguuuuaagccauguucccagcauacauucauuuugaugccuaccuuacucaagaauaauauaugguuaaaauaugaaguguaacuuuugcuaucauauagauaagcaagaacaaguaauucacuauuugaaggagagcugguuuucauguuuguuuuaaaguugaguuuggccaggccugguggcucacaccuguaaucccagaacuuugggagguuaggugggaggauugcuucagcccaggaguucgagacuagccuggccaagauggcgaaacccagucucuguuuaaaaaaaaaaaauggaaaaaaaaguugaauuuacuuaugcuagauuuguaugucaacauaaacuuagucugagcauuuuuuuuuuccccgagacaggaucucacucuguggcccauacuggaguacaguggugcaaucaugguucacugcaguguugaccuccugggcucaguugauccucccaccucagccuccugaguagcugggacuacaggcacauaccaccacguccaguuaauuuuuguauuuuuuguagagacaagaucuugcuauguugcccaggcuggucuugaacuccugggcucaggccauccuccugccucagccucccaaaguacugggauuauaggugugagccaccacaucaggacggucugagaauuucuuaaagucuccuucucucccuauguuuucccuuuuuaucccucauaaauccuuucacgguuugguuuuuuuauuuggccuccuuuguaguucccacuuucagaauguaguaucucuuacuugugcauuuauuuaacaaauaauaauugggauauaaagcuacacuuugaauaagacaaagacauguuuacaucccaaucgaagauacagguaauuuuuagcguuaaguaaagauguuaauaauauauguuaugggguaaaagaacaagaugcuaugaggaaacaauaaaggagauuugucagucacuaaucucaagaaaauauuucccugaagggggugguaaaggagcuagccaugcaaaagagcugaaugaagaacacgccaggcagagaggauagauagugcaaggcccugaaacagaaaagaagccccuuggguguguucugucuguauaccuauaaaaagggcuuugauagauuucauuucuauguuuugguggguuuuuuuuuuuuuuuuaaugccuuuagaaugcucauuuacucuaaggauuuugugaaauucuuacucugauguacuuaguuucucucuuccugauuuuuuccugucuaguuagcaauacaugagaacuauuaagguagauagauuacuugauuguuuuccuaguuuaaagggagaagguauuacuguaaugauaacacuuacugucuuauaacacugaauguuuuccaauaugguuaacacccaauaauaaugucacuuuugcagcuggauuuucguacacccccagguuuugaccgaacacguaaugcugagauuggaaauaaggacauuaaauucaaacauuuggaagaagccuuuacaucagaacacuggcuuguuaggauauauaaaguaaaagcaccugauaacagggagacauuagaucacaaaccucgagucaccaacauuuucccaaaacagaaguauuugucaaagaaggugggugccaagugaaggcauuaaaggguaacuuaagguguguugguuuguaugaaaaagaauuucuggaaauugcaauaaauuuccaucugccagauuuauaaagacuauggcuucuauauuaauacgaaguaaauaucagccuagccugcuaggagcauuccuuucaaacugagcacuucagauaucccaagcugagauuuuuccagaggccuucuggcuuugguuugugcuauugccauuaguaagacuuacuuguaaaguaagauguagcuguggccaucgcuuuccaaaccuguaugaaaguaaaaaugcuaaauucucaucuuuugagcagagcaaauuuauauugcaucuucauguuccauucuuaguaugauguuacucuauuauucauugaauaaagaauagguuuggguugggugaguccuucugaagcccaaaaaaaucauuuaucuuaagauaauuauuuuuuaauguaauugugacaaagcuuauaggcaggaauuaugagacuacugcaauucuuuucuaauauuauauaagauaugaaguauuucauugggggucauuauugcucacuuaagccaaauagauuauaauuuuugcuauaaaagauggcuaaaaauuaguauuuauauagguuguccagcaguaggaaaugggaaguaaugaacagucagauaaaauguuaagguucauuauaagguacuauccuuauaauacugauuauuauuagacugacuuugaaucucauuuuuuaaggaugcuuagguuuacauagcucagaucagcuaucuuauaucauugaaacaacugucuuaacucuuuguuacuuaaaauauacaucaaauauauucaaaauacagaugauuuuaauuuguacuauaaaagugcugaauauuaacggugugauauguaaauggaagcuuuuuauaugaauaugugccagauguaaauuaccaugucuagacuaauguauuuaaaaaugucacauagagcugacauucauuguguuagucauaugaaacucauuaucuuuagguaaaauaacauuaaaaaaucagaugauugucacaggcaugagguaggagaaacuggugagcagcaaaugcugcuauucucaaagcaguuacuccuaagauauccaaguauaacuaagguguacuuuuucugcaaaaagagggcuguugaacuuguugucugaugauauagaccccaaaggcagugaauuuucuucauuugaccccuuuucucuucccaucauuuuccccaaauaaaugugaauggauaaauaaaacauaaucugucuugugugcccaaaacauauauugugguggccaauaacauauuuugacauucugguuuccauggcuuuagauguuuuguacuaacacuaugaaggaaugcuuuuuauacuucccuuucucuauccugguuuugacuuuggaggaggaggguauacauaacagcauccauucugagaguuuaccagccaucgcaaagccggcaugacuaaggcacuagaaauuguaguccaggcugcagaaaaggcuuuuuggcacaugguucacugccaguaggagaaaagcacccugagggcuauuacacacuuggauauuccuggggcacaucauaagaucucauagaaaaaguauccuguuagaaucuggauguaauuauaauaaagaaacuacuagaucugguuugaauuuuuaaaaauuguacccucugaaguuucuuacuuugugccuuaauaacaucaguuuaacaauaagguaauauaaugggguuaacaaguuagcaguagcuaauuuuuaguaccuuaagaaggauugcauuuugccuuguguucucaucccuguuagaaacuacuauaaauuaucuugaauugaacaucauggauaaaggaacaugaugcaggauuuacccaguuucugaaaccucugagaguuguauuuaaaugugaaaauugaauugaguggucagucucuugagucuucugccucuguuaacccagagcuuugauggugcauuaaauuacuuaguuucaaaaaauauuugcugucuucaauaucuagggcugugugucagauugaaagacauaugugccuauaauuuauccugugggguucuaacauaaauauuuuagcaguaauuuguaccacugcauuuccgguaauuuguuucuaauacuaggaaacgucuauugaaaguauuuuagugggauacugaauuguuaagaaaaauauuuuauuuuuaaaagauguaugaaacugaaggaauauuguuuugcuuuacauuuucaauugcuuauuuuccuaccuaaaggauuauuuuuagagaaugugccaagugauuauaucucucauuuuuguagaugguuacagucauccucauuuuacagaaaacagggacucuaagaguuacuaaguuaacguguuuuucuggcacacaccuaauuuccuggaggcuaaaucaggagcagcauuaccauuucugauuccuuagucuaguguuacauauucugucuugccuggaaauuuuaauaauuacagcucagcacuuugugguugagaagagggcugaagauucauucacuugauggugaggaugucuaggaaccuaguccuuucacuuugaauguguuaguguacucagguaagaaacaccacuaacaguuuagugguguucacugaacuauucaaggaauccagucacaagaagagcagagagcuuacuaagucaucauaguucaguaaaccauguguguguuuauagauuuuuuaaucaguaagaaaccugcauuaauacuauguguuuuguuuuuuuauagacuaccaaaaggaagcguggcuacauuaaaaauaagcugguuuuuaagaaaggcaagaaaauaucuaagaagacuguuuaaaugcacuguucugguuccuaacuugaagcaguuguccuugugagaaccggucuuugccuuuagcucaugucguguuucacagcaaagaggguacagaaccaucacugguccagguuaauguacaaaauuuucuggcaaugccugauuaaaaaaauaaaauuggcuuguugagaacagcuguuuucgauuucuaaugugaagcaagacagagcacugcuguaaaugucuagcagcagauuuuuuuuuuauugguacauauuauccuucaaaucugagaauuuggacuaacugcaccaaagaacccucuaauuuggucccuggcacaugcauacuugucaauguuuuuauucuuuuacaagaccugcauuuuauuugaauuacccgaauagcaauauguaaaauacaagugacaaaaugugaugagagcuucuugaaccgguaaacuaguacaggucugagaaagacauauuagaagaaucauuauacuuccuugaauuauauuuauuuucauguuucucuaaugcaaagaauguuucaucaaauguauauuuucuguugcuuacuguuugcucugagaagaagcugcuguuucaaagauggaccucugaguagcuaauugauucaaguaguuuuuuuauguugacacauuauuacugcuguuagcagucguuuucaccagguacuuacagagcagauuucauacaucauucauucaagggcuaaauuuauauuuuuuggaaaucauggcaacuacacaggauguugcuuaccaggacggaguuuugguaucuuaguacugaaguuagcacuauguuuacaugcaaaagauuaaggaaaaaacccuuaaaguggacagguauccaaaguucauuuucugugacucaucaaagugacaaaagacuuguaacaacuuugccuggacuuuuuucauuuuacaacaguucauccauucacaaugauuuuguucucugcuccauauuuuuuaaucccuuaagcauuugaugaaacacucuuuagugcuauaugcauuuucuuacuuuuguuaaaaaugugacaguugucaaaaaaugcacuaaaauguaaauggagauugaacaaguucacuuuccagcuuauaggcaacuuuauacagacuugaacauuuucuccaguuguuuaguaaaagugaaagagaaaggguuuuuccugccacaggauauaacuuuuuuuuauauaacaagcauaacacaccacugcuuuugguggaaaagugcagaauaguauguaccuuuuaugaagaaaaauguaauuuacaauauucagugagaauguuacugcugauuuucuuuuccaagguguagaauauucuuugauuuauagaauucauuuuugacccagaugaugguuccuuuacagaacaauaaaauggcugaacauuuucacaaauagaguguaacgaagucuggauuucugauaccuugucauuugggggauuuuauuuuacuuuguugcuuuaaaauucaaugcagagaaguuguugacuguaggggaaauaaaguuaauucaaauuuuguguuaaguguuguuuuuuacaaaucuuuugguuuugaaaggaauugguacugaacacauaccuccuucuuccuuguugacuuucacaaagguuuuaaagaaaauguguggaaaaaaauacguuagauuauuucaucuuagaccaagcuauuuuauuuggccuucuuuuacccuggaaugaaaaucucagguuuuuuuguuuuuguuuuuguuuuuguuuuuuguuuuuuguuuuguuuuuggaagggauuuggggagggggaacaccuagccaacuaggaauuuuaucucuguuuaauaaggauagggaccuaacaaaaccauccaugaaguucugguaaugaaaugucaagucucaguauagaauuuucucauuagaaaaaucccaaaggaaagaccccucaccuuucucaggaaacaacauuuugguucaguguaucuugucaguaaaauaccauauuguaacuguuugagcacuuguauuguagcacaaaagugaaauaguaguuugaauacauuggaauauaggauaauugacuuaaaauauucuuuagaucucuuaauucauuucaugugugaucacuaacauuguacaccaaaggaacuuaaagaucguggccuugaaguuuuagacuauaaaacagcuuuuaggcuguagugcucuguaguauaaauaaggcagugaggcagcaacuccaaagaaaauucccuuucaagacuuacauuguaaccuacuugaguuuauaguuguggaguuuuaauucauuugcauucuaggccaugaccaagugaccagaggacuaaaauaguauaaaagcauccuguauugaguuuccauagccaaggggguguaagaucaugaaauuuggagcuguuucucguuuuuaaaaaau

SEQ ID NO: 16160 - RNA, 520 nt, Homo sapiens
cccauauuguaugaaauuaucacucuugguuaaauuuaaauaaugaucauguagauacacaaucaucuaugacaagugauuuaaauauuuuugaaggcugagauaagugaggauguaaugcacuaacacuuggcugacauaagaccauguaaaauaagaugcuuuuguaugucagaaugcccugcacccaggagacacucuaucuugaguacuuuggaaaugagaagcauaaguaaacacaaguaaaauuguuaaugcccuuugaaagaaagcucuuuauuuagguucaccacuaggaaacauauuaauaaauagguauucuguguauuuuaggcaaugauucauugguucauugauuucauucauucauucauucauucaauaaaugcaaauugguggcuaacuccacuguguggaccacuuacuugcagaacauuaauagaugguuuauauaguuuuguagacaaguuugaaaauccuggaacaagcaagaauaaacaagccuuuuuaaaaacugaga

SEQ ID NO: 16161 - RNA, 31533 nt, Homo sapiens
cgaccgaaccuggcuucgcuaacgcccucccagcucccucgggccugacuuccgguuuccucgcgcgucccuggcgccgagcccgcggacagcggcagccccuuuuccggcugagagcucauccacacuuccaaucacuuuccggagugcuuccccucccuccggcccgugcuggucccgacggcgggccugggucucgcgcgcguauugcuggguaacgggccuucucucgcgucggcccggccccuccugccucggcucgucccuccuuccagaacgucccgggcuccugccgagucagaagaaaugggacucccuccgcgacgugcccggagcagcucccuucgcuguggaagcggcggugucuucgaagaaaccggaagcccguggugaccccuggcgacccgguuuguuuucgguccguuuccaaacacuaaggaaucgaaacucggcggccuugggggcggcccuacguagccuggcuucugggugagugacucgccagggacggguggaggauagggaugcgggcaaugccgcggccaaccuccguagcuguugccgguccaaaaagacacgucauuuuuuucucacucccucccgcgcccccuccuuugacuagggagcggcccacuccugggcaucccuuuccccagucacccccacacccagcuguccacacccuuuccccugucacccucacccccagcuguccaggcccuucuuggucauucacuucucuaauuacuccuuuucuuuucguacucuuacuggggcgccuucaguuuuuuuucauucauugagacugcuaaaugcuucuuuccgauacaaauuaucggaaagaaaagagggacauuggcuaggacgguacucccuggggcaucugaguggugaauaucgacccccugcacuugaucgagggcuaacagguauucgucguuucuccaaugucuaaccuguauacgguauucauuccagccuucggcuguuuguugaguaacuacuacuacgugcaagguaggcugacacccucuacacaaaagaaaccccaauacucgaaagcgagauaaaauacccacgaaaacucuaguacaaaucaaaccaucaguugcuccaagaggugauggaaauuugcuaaggugaucaaagacagacguaccagaauuaaaauugacccuugcgccuuauguguagaagacauuuugguuuuuagauuggaauuucaaauuggauugagcaagaucucaaggcagaauuucauuucucuaaaaacgccauaucucauugcccaaucuugugaucauuucaucaucuguaaauugagaacagugcauccuuuacaggauauuuccaaauuuuaaugugauauuguuuguaagccagacaucuuacgcaaguagaagguuuuaauauuaaagagacagcauaacauaaugggaaaugacacuggauuaggucagaacaccaguaucugaaugcugauuuuuccauuuacuugacaauggguaagaggcuaaacuuuuucuucauuuuccuuaucucugaaauggguguaauacauacucuaaggcaccaaagcauaguuucuaagaguuaugcuggcucuggagucagcugccugauuuucauuucuggcuccccuacuuucuaauguuuucaugucucaauuucuccaccuguaaucugaggagauucuuuacaaccucagagguauuacauagauuuacugaaugcuuaugaagaacaaaugagauaguuucuccaaaaggugaagcacacugcuugguauaccauaaacgcuuggcuacuauuaauuaccaaugcagaaccuugucauuauuauuaaguaaaaugcugaaguuuuuuuuauaauccaugaaguaauagaaccaaucuuuuucuuuuuuauggcacuuauauucagagugcaaguauaguugccuuaucacuguuagaaaauaauuuucaauaacaccaguaacauugaauguauaguagaugcuuaguugcauuagagguauuacuguaugaaagggaugaaaagaaguagacugcucuucauaccuaugcuaacucuggaagagucuugaucugugcaauacaaacugauuucuggacuaacgcaguuuguuggauaacucaagagucauaaaaauggaacuggaguuuuucuucauauuguauaucuaauguugaguacauuuuuggacauuuauugaauuacagggcuuuuuauugcuaauguacacagauuaagagaugauguuuugaaaagagguacuugaugacccuucuuuauaaacuaguuaggcuauuuuacaaauugagaaaggggaauaagcauuggucuguucgucuucguaagacuuaauccuugcuccauaguauuuugacugauuguacgaaauagguucgggaauauccuaacuuuucagagguagaaagguggugaaaauucuaaauaugauuuacuucaggaggcaauauggaauaaagagccuaccauauaggccuugauucaaacuucaguuuugucacauacugcuguggugaggugaauuuaccucaccucuuugagccucaauuuccccauuuaucauggugcuaauaccuuucuugccaaguuugguguggacuugagauaauguguguaccauaccuuuuaugcaguuccuggcauaaaugugaauucccuucucucuguuuagguugccauuguucuguauuuguauuaaacuuuugccuucacaguuuaguaagguggcaucuuagugauguagucuaacccuaucauucuguauaggugggaaaauuuugaucuagagagguaaagcgaacuaaacuauaaucaggguugcaaauccuagacuagaaucuguguuucugaauccugggaaaguguucuuuuugacauaguuaugccuuguccauauucuuaggauaaccagaaucccuuuuguauugccucuuugaauguuguauuaagaccauagacuucugacagcuuacuuagguucacaucucaccuuugccacugauuagcuguguagcuauagguaagguauuuaacuuuucuaagacuuucuucauaacaguacuuagcuaagugguagaaaaaugcaugugaaagcacuagugacuggcauaugguaagugaucaauaaauggcagauauaaagaugaugaaauaugaaaauggcagauauaaagaugaugaaauaugacaggauaaucauauuuauuccuagaaaaaagaccagucugauaucagcagauauguuuucuaguaucccaaacuuugacauacguagcauaugaacaacugagaguucucuugguguugauugccaugaugaagacugaaauuuaagaucuucuaaaauaauucuaauaaauaauguuugaaucuuuuuuuuccuguguuucuccccaagcuucagguaguacuguucuuauuucuaccuacuuuaucugacaaauugugcccuuucuuuuuuaucauucuuggaaauuucauuguucucaaaaauaauugucaauaguguuuaccucaaucuuuucuaauucgcuuuuuauauuuaaguaaaccucuaaggagaaacaaaauuuaauugccaaauauauaaaauguuugcaugaguacauauagauacauuugccuauaaaugugcuuuauuuaacaccccacuauauugugaugagaugaugaaugugaaauuacuuucuauaauauuaaaaauaaaaucuaaaggguguuuacuaauucauaacauagaacuaacugugcccacaaauguucaaggauacuaagaauuggaauucuguaaauuacgugguaacugcuuggcuuuguucuuucugaugagugguucucaaauuggaauaugacuuaaaaucaccugggugcuuauucagagugcacuuugcaguuuuucaccccagauauucugauuugcauagaucugcaguggaagcuaggaaucaguauuuuuuaacagaaugcagaggaauucuaaggcagugguccacaccuuugucaaacacugcccucagucaucuccagcuucuuagaaugcccuuggaaaagcaaaauuuauuuauggaaugucccuguggaauacauuuauuacugauuuucaucacugagagaaguccacuuaagcuugucuuuggacaguguuuugauguuuguuaaguuuugaaaguucaguuucugcuagacuauuuaaaauacuaucuagucuuugguaauuuuaauuuuugauaacaauauucugcucauggcacuuauuuuuuaaagauuaaugcuaacaaagauuuauuauuuuaagagcauuuaaauuaugauaaauaagacucaguauaauguuaaguuucuucaaauguuaaaugauauaacuagcuuggucuaguuugucaaauagaauaauagccaguuacacuuuuaccauuuaucuagaaaaucagacuucaugggccagcugauuuggauacacacacacagccauuucauugcaacaaaaguguuuaaaacugaaucuuuauuaugagacugauuaccacagcucccuuuacuucucuguagaaauacauuuuauaaaggaugcuugcguagcaauaacaccaaaggcaacacauagccuacuuuuuacuuugcuaacaguuuuccuuucauuauauuaauaaauauaaugggauaucugccuuguauuguuuccuuucuaugaucucauuuucccuggaccuguagcuuuuacucuccagaagucugguuuguacagacuaauaugauaaguauuaauauucucaugcuugugauuucauauuaauuuuugcagggauaguaauuaaaauuuuaauuuuccauuuuauaacaaauuuaaaugacaguuauuuuaaaacaauaaaaguugauacauauauguggugcuagcacauuguguguuuuaauauauggcuauuucuuacauaacuuuuaggacagauaagcaauuugaugcugcuuuuccgcguauucuaaguaauguuuauaguguauagaauaaauauauagaauaaugguauaaaacuugaaaaauccuuuuaugccauuguuuucuuacauaauauaugcaacuuuugauuuauaaauaaaaagguagcauaucaauagguaaaccagucugacuacucauauugucuuaaaaaugacuagcuaucauguuguauaaaaugugacauuauuguaucaauauacccccuuccauguaaaguacuuuuguaagccuucugagggguuccuagauuuguaggaguguaagauuuuguaaaagauucauuggagaggggaaaauauuaauagcucaggcucuaaaauccaaguccugguucauacuaauuaagugauccuagcuaagcuucuuuaccuuuccaggucccaguuuucucaucugugagaugaguuugauaagauuuuguaccucauaggguagucuugagaauuaaaugggauaauguuuguaaacauuuagcauaaugcuaaguaguucacugguugugaauuaaaaaaaaaaaaucaacauuguaaguauucacacccuuuaaucauguccaggccuguguuuuuaaaauucagcagaauaagcaccaaaauccacagugccucuaccaggaaggaccaucucaguuugucuccauccugccuuuuuaaucucaucuccugccacuccucuucucaaccuuucuccccacacuuagaucuuugaacuuguuccccugcuggaaguuaacaaacuguaaagguguaaguacaauaaguacaguacaaugaaaauaaccauccucuucacaugagaguacagucuuaagagacauuugcucuuuugugguaucuucuuugaaaaccacuuuuucuccccaucccucagaccccccauaacauucuguuguuucaaauuuauuaccuaccuuuaugguauaauaauaauuuuucugcacaacucugccucucuggguuuuccuugcuguguaaaugauuguuucaugauaaaaaugaacaaguaaaucccagcugagcuaguuagaaguuuguguaaaacagaagugcgugagcccaauccuuaaaauacacaaacugcaggguaucuguuuuugacuucgcagagcaguuuauguuauuucuuguuuucagcugucuuuagaaaaaauccacaucgaauaaauccugcccauuggguugaguauuaaauuauuuaagucaaaugucuacuguggguacaauuuuaccucuccuuaaaccaggcugcauucuaccacuuaccuagccgucugugacuauuuuacuugcucuacuuuuaaggggagugugugugugugugugugugugugugugugugugugcauguguaagagucuuauaugaagauauauaugcauacuuucaguuugcaauaugagaauaaccugcacuuuuauuuugaaaggaaauaaugagaguuucagcuagcaguagcaugacuggaaugauguuugcucuuauuuuggaauaucauugaaucuggagacugaaaaguaaacucuuuuagaggaagaaaaguuaaacuuuucaucauuaggagaaaaugcagcuugcaucagaagcagcaugaguaauuaugguucugagaauccgccacuuuuuugguauacuguagauagcauagucuauucuuguucuuggacuuuauugaaaaacugggaaagauuguaccuuaagagugggaguuguccuguaugguuagaaaauguuaaauugauguuaaugaagauugacuggauggcagguuuuaccuacucaagacuuguaguauacacauuuauuuuaaccugccuuucuuauaauucuagauacaaauugcuuagaugcucccagcuguugcuuuaguugacaauuggaaguuuuuaauuguacaauuagaaaagcaaaaauauaaugauauaagaccagacccagaaaaacacaaaaccuuuuguuaguauucaugugaucugaaauaaggcaaaagaaauguuaaagggauuaguugacacaggagggagauuagacauuuuggaagaaagcaggcauagugaaacacggguuggaaacguggcuguaguuaaauugccuauguuuacaucucaacucuccacuuacuauguuacuuuggaaaaaauacuuaaauuccuccuaccucaguuucuucaucuauaauguucuugaacagugacugauauuaguaaguaaccaaauuuuauuucaagcaagggauaguuaaaaacucacuuucuaguaauaauuacugaucuaagauacaugaaauucaauugauaaucuuuauuuagagugcuauauuuaguuuuuuauuuuaaacuaaaaaauauuuaaaaggacuuuuuagguucucuugcauggucuaaagucccucuuauucuguuuuucccaggaggucuuaaaagguuuuagccacaguuucuccuuccaucauguuuuucaggaaccuaacucucagagaaguaaugcugaaccuaacagcaaaaguagauguucagagcaagucaguuuuucguuaaacaaugaagguaacgagcucuucucuuagguuuuggagucagaguuugauuugaauccuacucuacccacucuucauucaguaaucaauauuuauugagcaacuucuacacagugaugaguuggggacacaaaugaugggcaaaacagacaaagcuucugcccucacagagcuuaacauucuucuagauuuaacagggcuaauucaacuuucuaagaccuaccuauaaaauauagaugauacauauuucauagaauuguucagauaauuaaaagagauaauauuaaaagaauguagugcauuauagugggacauauuggacacucaaauguuaauuaauuugucuucuauucuaaauauacaacaaacauagccaauuacugguauggaaagauagaguaugcauuaagacuucuauaauauaauauuaauauguuguuguaaugaauuauacucaaagaacuuuugaaaauuuauaaauugagaagcuaugaaacuugcuacuaauagaucuaaguggaaauguuaggagaagauauauuuggggaugaaguauuuuaaaaaauuuugauuguuuuaaugaaacugauauuucagauuuuuauagaacauacuaauaauuaugguuuuaagugguuuauagauauaauuuaauauucuuaagacucuaugagguauuugcuguuauuucuuguacuuuauaaauaaggaaacugaggcauagagguuaagcaacuugcccaaagucagacacuaaaugguagaguuuagaauacaacccaggcagucugguuuuuaaacauuguccuaguauuuacauuauucuuaacuauaacuuuuuuuccuuuucacuuauucagugagacauuugucacucauauuuuuuuucuuuuaaacaguugucauggaugcacugguagaagaugauaucuguauucugaaucaugaaaaagcccauaagagagauacagugacuccaguuucaauauauucaggagaugaaucuguugcuucccauuuugcucuugucacugcauaugaagacaucaaaaaacgacuuaaggauucagagaaagagaacucuuuguuaaagaagagaauaagauuuuuggaagaaaagguaauuuuuaucuuuuaccuucauugcguuugugacauaaggaauaauucaaaauacuugaaauuuugaauacuuuuuguccugucuuccaugauuguacuaaauuuccaagaauaacucacugcuaaucugaaaacucugggcauuauacuuauccuguguuucacauaccauguacuugguaaauauuuguaggagaggauuuaacaacuuggaguuauauuccaaauauuuuucuuucauuuucagguuuacuuaccuccauagcuguauguauuuuauucagaauuuucaaaucugggcaaaaaaaaaaaagauauaccaacaaaggaaauuaaguaucaaaggaggaagcuucuggaacauuguccaauagguuuaauaauaucuuuaccaaggcugaaaucuuuacuucaacauucuuucucuucuuuaacacauguaauaggaauaaugcuuuuaauugaucaacugauguuuucuguuuaccuuuccauguauaauugugacacaucuaacuguuacagaauauauaaguaagguagcugauucaauauaaagcaccaaucuacuuggcuuuauguaugaggaauauucuucagucauccuuuuauuuuugaguuuuaaaguuuuaacuuagcuuaguuuguauuuuuucagcucagauaagagcauuuuuauccuacaaagagcagcuaccacaaaggguaaagaaugcauuguccuguguaauauaaauuaauuauccaaggaaaugaauuauccuauauaaaaaaaacuugaagauggggcuugguagaguuugauucauuuuuggugggaaguaagagaaaaggagucgguuguaaaauaauuauaauuucuuuguauucauaugaauuauauuuacuuuaauguugauuauguaaauuuguaacauauuggcauacagugagagaagguaacauuuuggggcacauagcuuuauuuuaaaguuuaguagaaaaaugggauuuuauguauaguuaacauuggaaauauuucuguacuucaugaccaacaauccuauuaauuccuauccuguaauauaaaggauuuaacaaauuaacacacacaucuauuucuuaaaaagucaaguaugccuuggcugggcacgguggcucacaccuguaauuccagcccuuugggaggccgagguggguggauugccugaagucaggaguccaagaccagacuggccaacauggugaaacccugucucuacuaaaaauacaaaaauuagcagggcgugguggugcaccuauauucccagcuccucggaagcugaggcaggacaaucacuuaaaccugggaggcggagguugcagugagcugagaucgccccauugcacuccagccugggugaugagagcgaaacucagucucgaaaaaaaaaaaaagucaaguaugcccuaaggugcugcuuuuucugauuauagaaauuagauacuuuuaauuuaaaaaacaucuaagcaguguguaucacaucuauacucuguugugauuaugaugauuuaauguuauaaaacagacaccaugaauuauaaaauacugauuauguaaaagcauagaaggcuucaaaaaauauucuacacauuuuugcuuucuauguaaagauuaauuuguggaaaugaaauacucaccuaaugaauccaggcuuuauccccuuauuacgauugaaguaagauauggagccaucagaacacugacuuauuuuuuaucuauagaauacucucuuaagcuuucucuucuaauuucauaccguuagcuaauagcucgauuugaagaagaaacaaguuccgugggacgagaacaaguaaauaaggccuaucaugcauaucgagagguuugcauugauagagauaauuugaagagcaaacuggacaaaaugguaaguugauuugaagcgaaugacaucugcauuuuggaaaugaauuuucuccuucaagagguuuaaaauuagaaguaaguuaaauauuuacauuuaguaauuaaaauuuuguauacauguucaaggcaaaauggaaauuuuaguaauauuuuaacuuauuuuuauguaaaauauuuaguauguaaugauguuuaggacuuaaauacaucuaacaccaccgacuuauuuugaaaaacuaugacaugguagauuuagucuuuuuuuuuuuuuaagccagugaauaaugauguccuaaauuaggaaaagaaaaaaagacauuucugagaaacugaguucauuuugucaccuugcuuuuaaagacaagaauguguuuuuuucaguaucuuccugaaaauuacaauauaccaacguguagauuuuauugaauguaauuuggcauuuucccuacuuaacuagaauaaagacaacucugaaucuuugaaaguauugaaugagcagcuacaaucuaaagaaguagaacuccuccagcugaggacagagguggaaacucagcaggguaugccaguuacuuguuauaaauauucuaacagaauuaacauauuuuuccauuuauuuguaauaucaacaguuuucuguauccauaugcuaagaccuuaacuuauuuuuuaauuuuuagguuuauguuaauuucucuguucuaccuucacauaauaucaacuuccuuuaacuuuuccuuagcuauauauugcacuuuuccuagagaaaaugugaugguuuuuauucaggucuagguugugaugaagcagaagaggaaaagaguagaagcccagaagcaagaaguagaagugaaaucaucuagcccacugguuguccuggcuucucuuucuuacugaacaucuugcccacaguuaaacacacugcugugaaguuguuacaauuucuuuuucuuuccaaagguuguuaaaaggugcagaugaaauguugggguggaaaguuggaucuggggcauauggauaaauagccugcucccaugaauauucauuaugaugagacaagcuaagaaggucugagagaccuucugauaggagauugagaugcaaucucuuagcauagcuaguuggagcuuuuuguagcuagagagacugaggugcuaauuaaagaauaaagcaguauccaguuuauugaguuucugcaguggaauguuuaaggauaaauuguuuugacaucaugcucugagcuuguuggucaaacuucauaccucugagaggacuggauggaaugauuagcugagccucaguuuauucaguuuauuauuuuuaucacuguuuuaaccuuaugcagaauauugaucugucugcaauuuuagcauaugcuuauuuuaguguaguugucuuuagaaauucuaaaacaagauugcuagauuucucauucuccuuagcauagauauuugaaaguauuaauaauuacuguuuuuaaaaaacuauugaucauauauguuuuauguuaguuuuucuauuaucuacauuuuaccagaauaaccuauuuuuaagaauugcagucaauguagaaggaaaagauaacaauuucaguguccauccuuuuuguagugaugaggaauuuaaauccaccuucaucaaacugggagguggaaaaguugagcugugaccugaagauccaugguuuggaacaagagcuggaacugaugaggaaagaauguagcgaucucaaaauagaacuacagaaagccaaacaaacgguauuacagaauuauuaaauugagaauuucaguauuuuuuguguaucauauguaggauuuauaacuaagauuguauuaaaccauagaguuaaaauaaauuguaauuauuuagagaauguucuauuccuuaaaaaauucuuguuuaucuaccucuuuaagcauuucugcuaaaauuugacaugccauauacuuuuagucugucacaaaauuauacaauuuuguuuuuuaaaagguugauuuuuaguaagcuuauuaguuuauuauaacuguucuuucagacucucuuuccuucaauuuccuuuucucuguaaaguuuaaagagaacucagguuuuaaguccuauauuauuuuacuuaauaguuucauuaauuuagauaucauaagggacaacucgauuuuuauaauuaaaacaacaacaaagaaaaacacgaccaacaaagaaaacaugacagagcuuacuuauuuucaaaagacuaauacuuugggggcaucuuuaacuaccagcaaauaucugagaauucaagaauuggaaaaaaauaacaaaaaccugccaaguugcugaaguguguuuagccugaagucaaccacuaaaacaagaugccuuuuagguccucaccaagagucuguuugcccaguauuuuacaucagguucuaacaagcuuggaucuauguuuucagacaucaugacagugcugagauuaaaagaagaaaugauaaagaagcaagguagugugagagcaaugcaccaaaugcagauuuuaaauaauuauuacaagaaauugaaaagcuuaguagucuggugcaaauagccauuuuaugcauucauguaucucaaacuaagguauaaccaguuauauaauguuucuccacucaaccauuuugccuaccaaagcauucuaacacuauugaggaauuguguuucuucuuguuccucugggaugccaccaucugaaaggggaacuccaucccauacuuccugacugcuuuccagauucugcccugaaucucaaguguucuuagauggagcugauacuucuuucuucucuaauguaguuuuuaugagaggugaccacucgauaagaaugagccagacauuaagaauaauauagcagucugccuaguccuuggccaaaugaauuccucugaacugggcaaugagaacucccuuuggcacccccaucccugauaaaaggaaacacuacaaaaauuacugucaacucccguuagagucaaagugguuuuuuuccuacuuacaaaguugauucccccagcuuugagcuuguggccacacaccacaauuccuucaaagacucagcauccuguucuacagcucaguuaccaucaccacugagaagccucuuuucaaaagauggguuuacaggaaaagauauggaccuugaaauucugaauuauaauugucauuauuuauauucuguuugaaaggaaauuugauagccuuuauacgugauagauauuuuguuguaguguagcaagcaguaccauggaaucggaaacuuagcucauaauuuugguguugcuuauuaacuguuaacauuaggaacaccauuuuacuuuugggaaguuguuuucuguaaaguagacauuaaauaccuuuuuucaugaagguuaaauuaguguauauaaagcaguuauuagggacuuuagacgucuucuaaaccaacuucauuuacugauccaguaucucuuuuacuucuuuggcccaagagucuguauuucucacaggaucaacuguucugaauauaaauggcuggaauauuaggggacacaguuuuaugcuccugaucaaacauuacuaucaugcuuacaggacuuaauauauuaaucacagccaguuaucauaguggccauuauauaguauguucaguagguaaaugcuuuuuuaaaaaauuugauuagaguaauccagaagggcaguacuuuuagguauuuauguguauugaaauuucuauucuuagcauuuuaguuauucuuuuccacuagauggugcuagggaauaaauuugcuuuuaguuuaaauucaucugucauaaguaaccaaaucacagaaacagacuuuuagagguagaagaaaucacuuucuuuaacugaugacuaaguuaaaucugagagacaggaaacuuuaaacaguugaagaugagcuaagagaggaauauugaaaaagaaauauuuauaacauggcccccaccuucacaggcauuuauuagggguagggugaggcugugaaguuaaaaagggcucacucacaacuaaaagaaaugaacaaagaaaaggaagaguggaaauaaaaguuuaucaaggauuccaaguugaaaucuugaugcauacuuucaaaucuuguuucagugauguugcugaucagaauccucuuggagacaggaaucugagaggaagccaaggagagaaauuuauguucacaauacucuagccauauuacucuagcucacauuagucuagccauuuuaaaaaaaauuuuuaagaugaugcuuucagugaagcauuuuauaaaaccuucugaaguauguaauagcauccuacauggauauaauaguguuguuuuaguuuguuuguuuguuuuuuaaauauuuagugagggaacucaguucauuaauauuucauguuagugagguuucaggggcaguuccacuaugggccuuuuagacuuucuguguccccuaauauuccagccauuuauauucagaaccauugauccugugagaaauacagacucuagggccaaagaaguaaaagagauacuagaucaguaaaauuaaguugguuuagaagacgucuaaagucccuaauaacgguagcccaguuagagauucacaguguacuguaguauauuaaagguucugcuauaguauagaaaccuauauaacuugaacauuauuucccaagauuuuguagccaugggccucaccuuauaugaaacucccacaucauguggcacuaguuagggaacagauccauuaccaccuuuaggacauaggugaucuauuacuagccaacaaaagggucuuugaauacuagauacagucucuaugagcuuacugcugauguacauuagagucucugaauuguuagauaguaguuggaaaaacauuuucccacucaaacugucaaauuuuuuuauauuguuggcuuuaaaaaugaggaagguuuucaaugaacauaugcauaaguauauacuaauuuuuaaaaaaaaaauuuuaauucaugauacaaggauacuaaaagugaucugaucagauuccauuauuuccuguaaggcacaggaaaaaacaagguccaaggacaugugucucguuaguggucaaaccuccuggaccugugggccaguucuguuuccccucuccuuagggcucccuaagauuuaacuuaacuguuagaguauuaaaaucagagauccagaaauguuuuaacuccuauaagauuagguauuuuucacauuuuacucucaaguugagaguacucaugaaguccuuguguugcuuuuuaauguuucacugcaaauuauauaauuuagauuguauuaguaagaaauaauaaaauuaaaauuuguauucugagcuuauacuggccacaucugccaggagaauuaguaccugugauaaucauuuucauuuguuacagauccuuaaaugagaaugcauugcaaacaaguguguuagaguugucucaaacauacuaagucauuuaaaaauaucuucugaagguucugucauaucugcaaccuaaaucaacugaauuuaaaagcauauaaggacuuuaugauguccuugccaggucauuuuuaauccauguggaaggaggaaauguaugcugauguuuuacaacaguaaccuguuaaaauucugguguguuuuugguaauacuacgaaaaagugaaauaccaaaaaaacuuccauuuucccauagaauucauucacccauaccauaaguaaacagaaaugugacaaauguguaacacuuuuuugaauauacacuucagauuggugucuuuagaaauauauuuuguaagauuacaaggucuuuuacagaaugagagcaauuuuauucuuuuaaagaaaauuaaagcauuaauacuuuaaaccauuggacgugauuuagagauauuuguuauagauuggagguauuucauuaaaauugaguauaaaaucuaauuguauucuuugcacuuacagauauauucuguaaaaccugaacaugucucugguaagaaagagcugagacuaaauaaauuguaaaaauuacaacuuuuaaacuucuuuuuuuuaaacaaaugacaggauccauaucaggaagacaaucugaagagcagagaucuccaaaaacuaagcauuucaagguaugaccacucuucagcauuaagacaauacguugucuucuuccauaagucacuuuguguagguccuuagauuucuuuuaugacuuaaccuuaaaaacaaaaaauggauauuguuuggauacugauguaaccucugaucacaauaaauuuguagaauaaaauuuaauuguuaauaacagcuuugaauuuaaguaauacaaaaacaggaugccuuaaacuuucugaacauuuaguaauauuuuagguaugauuuuagggaacuagcuauguggagguauucuguaauacugaauuuguacaugaagaauuauucauuauauauaauaacauuccuuugucuuaagagccuacuuggccauuguuagucuuugggauagcaugaaauuuauuuuuuuuuguuuuuuguuuuuugagacagaguaucuguagcacagccuggagugcaguggcgcaaucaugggauagcaugaauuuugaggacuguucccucuucgcauaagaauagaaguagccaucagaguucauauacuuuuucaacccuuuuuccucaaauacguaucauuuuuacuuaaguaacuucaauucuguguuuuaagcuaucuaauaauuguuguuucuacuauguuaagauagccucucuacauuguuacccuccauccaauaaaaaauacugaucugacuucauuguuuuaucauuuggcuuccaaaguuuacugaccuaaguaaauaaugugaauugugucaggccaauuucuaucaaaaaccugcuuuagagaaaugaucaauuaggaaaaacaauuugaggaaaugagauacagccacucuucuagaucagggguuggcagacuuuuucuauaaagugccagcaguaacuguuuuauucggcuuugugagcuggcaguacagucucuguuguuauuuaacucugccauuugaacaguacuucaauuaugccuucgaauuuuaucuaaguuuacugcaaggaaacuuuuucuuuuuuugaaaaaugugucuaguauaguauccauguaaacuauuccuuaaaauuaucuuguuaucuuuucuccugucaaccuagguuuccccuuauuuuucuguauuguccuuuuuauaagccacuucuaaucaguuuagaaaggaguagagaaugaauaauaucaucaaaagagaucaaauacaggggcuauauaaauaguacauuugaagcaugugauauagaauggaauuucugcuuccauucaugggagauuacauaauuugggucauauccacuaagaauuucuugaaaaccugacucccccagaaaauaccuguuugaaggcaucagauaacuaacaaaauacugaaaaaaucucugugccaggauuuggggaaaguugagucccaaggagauauuuucaaggcugcaaagcuguaauuguggcuccagaguauagucucgcaauucuuuaaagcucaguaucaauucagaggacaguuuuuagaaauaauugccuuaaauucaguuuaaaaguuacuucacguuaaagccauaccaacaguauguauguaaagaauuguguaauuacagcauguuccaguggcucucuuagugcucauauacacuugugguuuuuugcaaauugguuugcauuuguaucagguagacaaugugaacugcaaaacugauuagguuucucucuucugguuauguacuagaaaacuuauaaccaaauuuguggccuacuguuggucaacuuuuaucaugcauuuuuauguuaaccucauucuccacugcauuuuguuuuguuuucuauuuuucgccucaucauuucugccuguuugcaguuuauguucuuguguuuuguuaaucuuuguaaguuacuucauccacuuuuaagaggaacaauucagaugacagauuaguuuacuauauuggagaaaguauauagggauauuuccauuaaaccauuaacuaaagguuuagauauuuuuaaggaauauuuuucaguuauuuagauaacuugcuuuuuuggaacucuccuuuuuuguauuucuuccaucauauugcuaggcaaaugagguguaguauacuguuucucuaucuuaagauagagugaaccuuuuaauuacuggaggccuuuuauaugauacuccuuguauaaaacaucauuuaacaauaauagcccuaucagaaauuuaaccaaugucuugccaguguccuguuuugauuuuggcuuuagguugauggcuucaguuuuuaaaccagaucuagacagggagucgcuguacuucuuuugcucaucaucuguaaacuuacauuguggaacuguguuacagaugacuuccuaaaauguaaauuccagguuuagaaaaaaaaagauuagguuaguguuuaucaggcucuucuguguuuccuuagugcugugaaauuuuauuaguuauaauaagcauuauaaaaauauggaauaagucagaaagaacacaccaauaccagagugcauuacacacaauaaggguaaguaugguuucuuagaacuuguuuucuuuggguugcaguguaaaaugauucuugcugugccuugcaauaaaaaaugagagccacuuguuuggggggaaccgcaguugucaaaauacacacuuuuaagucuauaacucuuggcuaagaauaucccauaguuuaauucuacugugaugauggaggauguaauaguucaguaaauuuucaaaugcuaaagaaaaauauguauggcugaaguagaaacucaaguaaguggauuuuucuuauacaaggaauaguuauuuguguauuaaagaguuccauauauagugucaauuaagaaagcugggcuuuuagcuguuacacuuuguaagcaggacauguacucccuccuucaguuguggacaugcagguuucacuuaaaagucagagaugugaaguuuuauacugagaaguauaaaacuuauaagauuguguuggcagucagcauauuguaggugcuugguaauugaugaugauaucaaaaauguuacuccaaaagggcagugaucagucauuagaccggguuaagugaaagacagcuuugaacagcaacauggcagacuggaguagacuucucaacccauuuccucguguguaaaaugagguuacucacuuuaccaaguuggugugacaauguaggugaagugccuaguauauaauaagugcucagccaucauuauuugugcuuuaucuguuuuuagaguucucauuugagaaguuucaguguaacauuucaauauuuuaaguaguuguauaaguucuuuauagacaacuauauauauuacuagcauuuugcuuguguggcauuuaaagcaaaacuaaacuuuauacucccaguuggggaacugcggugaggauaggaaggucacaaucuauacauugucuuugaaauaccuagauaagagguuuaauuggaagccugcuaaaaauuagggaugacaacuugccuuuuccaauaucauuuaaauaaugguuuaaacauuuuguucaaguagauagaauuuaaaauaauuuuuuacacacuuugaagauuguagcacuuuuaauguuaacuguaaagugggaaacacuaacugcaguuauuuucuuauccacaagagggagagcuauacuuaguaauaauuuuagauuugucuaucuguaguuuuaaauucagguuacauuaagagcaaaaaacaagacuacauguguauuaaacucagugaccuaguuuuuaacuaaaccuaaguuuuaagcagucuucauuaaauugaacugaaaaguuuuuauuaggcacuguaaacguuacuagaauuguuuauuuccaugccuagcuguguauuuuaguacucagaacugucuucaguauuugcucuucuuuucucuaaaacaggcacugauuuacugucucgcaccaauaauaaacuauuuuuaagcuguauuauucauaccaugacugaaugaaugaauuagcacauguucaguguuuacacuuacugcuauauaaugugaguaacucuucggaaagcauacugaaugccuagaauuguaccaagaaaccaacaacucucuucacacuuaagacagguuccuaugugaaacauucauuguagcaaacaacucagauguuuuuuggugaaguagacaugguuaauuuugugaacuaauuauuugacaccuauuaaaaacuugcaaagagcucugauuucuaauauacuacaacuuaacaaaugauguuuacaacagacuaaagcagauuuuucugaaaagcaguguaaaguuuauugacaaaaagguauuucaccuuacagaauucaaaauauuuuauauauuauauauuaaauauaaacuauauucuguaauuugagauauuagauuucaaaaauguuauccuuuugaaguuuaaguguuuauggcaacacaaaaauugaagcauaaggugacacguuugucuaguuugauuucuguacuauuaaaauuacacuaguaucuaagggguaauaauuuuuuuuuaauguuauaagauuuagucuuacauuuaauauuuugugauauuccuguacaacaaaaugagaauaugugcugaagauuuuaauuucauuuaguuggcaauuaagcagcaaaaaaagaaaaucaugaaugucugaauaugaauguuuaauggaaaacaaaaucuauaaaaauuagauuuaaaaucacuaauuauaauuucuuagauaauugagguaaaauacuuuuaauuauaaaaacaggagaggcauuuuugaaguuucuauuucuguuucauauaaucuucccucucuagcuucuuuuuccuuaccaggaaaucaucuggcucuucaugucuugugcugucaugucacauugguuuagaaccaacauuaugagacagcccagucaaacauaaagaauguaaugcaugaaaccuaaauuuuauuuuaauguagacuuggauauauauucagcaguugauauaucauuucaauucacagugucaaaacaaucaaaagauaaauacaaauugauccauauuugaaugaauguaacuuuacucuuaaucagauuugcaaauaaagaauguauuucuuacuacuuacuaauuaauagcugcacauuacagccuaaaaugaaaucucaguucugagacucugcaagaagcucuuaucaguuauaauuuuauuuuuauuauaccguuuaauauaauaguuaauugcuacauaucagauggacaguguuauucuuucaagaucuuuucacuuauuaaugcccuaguuaaauaucuuucaauuguuuuuuucaguuuacaucaucucaaaacuaauuggagcagaaacuugaucugcauauuucuaaaguuauucccuuuugucuaaaaaagaaugaugaguauuaacuuuuuguaaaaaaauuuauuucagugauaauaugcagcaugcauacugggaacugaagagagaaaugucuaauuuacaucuggugacucaaguacaagcugaacuacuaagaaaacugaaaaccucaacugcaaucaagaaaggcaagucacuguuuaccggaaaccacugauuccagccaaacugccugaagagcaacuagcugucauaucuuaucaaaaucucaucaaaugagagauugauaagccaaaguauauauaguacauucgcagccuacccauucucugcuuuggcuucagucucauacuggucaacuucacacauaaagguguugcugauguguuuuuucuucaguacuguauucuuuuccccuuguggcuuuucucagccaaguguugcuuauguguauaagacugagguguuaaguuugcucuaguugaccuuuuaccacagcuacuucauauauuugaaaaaaaaaaaaaaaagacaccaaaagcaaauuuucauuccagugcuacagaauacaccaaacaccuagcuuuuuagguuguuuugaaaaagaaaacaaacuuugauucauuauuuggguuuuugcauuucuuauaagcuuuucuuuccauaaaggauauagcugauuacaacgaagacuagguguucuccccuuaugcccuucaaccaaacaaaaauuuucauugcuuugccuuucauauuuaacugcuugacugauuuaacuucuugaguuuuguguuaacuaguaguagcuacuuucgccaaagcuauuuuuauaccuuggagaaaaaucaguacauuuguaccuaguauuacauaacagguauauuucugaaaaguugugugauacaaauuugaaugcccuaaaauuuacuuuuuaaaaaugagauaggacuuuuuauaaaagauuaucaccaucuaguuuaaaauuacuuauuuauauuucacauugucuuaaagaggacacaagaggauugugucauaaauaguucuccucaggaguguuuauuagugaggaaaaauguuaaauuuugggaaggaaaauugaauguagaacuccuuuucauuuuuagagaguugguuacauauaaaucagggaaaauaguaugguguuuuagcaaguccagcuuaauuuuugguucacuuuguccuugaguuuuccaguggucagaguuauauaugagaccaaagguugaauguacaaauaagaucucucuauaaagggacucacagaguaauucugcauugaguuuucaauguagcuuuguuuacaugauaaauagaacuaccaaagaauaauaaaggagcaaugcucuuuucauacuuggacauggcucauccuuguguuccuuccuagcugauuaauauuuuucggugcuuuggaacauaaguuuucuagcacuuuuccuaugacagugguaggcucaaggucaccacuccuuacacagaacucauugcuuugaggaguacagagaugagacuagaaccaccuuucuccugaccuuuguaucaccuuuuuuccaaagccaaacacuacacuuccaguucuccuccauccauauccacccucccaggaaaaacaaugaacuuauuuuauaaugucguucaaucuguuucuucuaaaauuacaugaagucaagccuuaguuacacuuggccauccuucuugagcuaaggauaaacuuaccuuuccacacugguaggcugagcuggagggaguggagaaaccuguauuaccaaugugcuggcuguggugaaauaauagcuuuuaaguagucuuuuucuaggccauugcauuuguacaaaacuuuuuuuuuuuggcuguuuuuuuuuuuuuuuuuacuuuaccuacauugugaccacaguagcauuaacauuugcuguguuuuacaagaaacaagauuucacaaauuuuauuuaaacugcuuuauccauaaaagccuuugauauauaaaaacuucauuugggucucaccaauuaaaaaugcaauuauuucuaaaaaauuugcuuuuggacugccuguggacaaagaguuugagcaaaggaauauuauauuuaacuaaaaaaugcuaaaacuuaagaacugucucaguccccacugacaugugaacagucugcaauccuucuccagccacaauaagagccaagaacaggaucuuuauuuguauuuuaacuguauuaguuuccaacuuuuaaaaauauguaguucuucaucuuuuaaaagcucuaugacauaguugggacaggaauucuauauccauucugcagacaaggaaagagacaucaggagcagcuaagagacaaauaucuaaagucacaguaaauugcugauccaggauuaaaacucagaucaucugucauuuaucuccuagucacagugccucaaugaucacacuaacuuggaaaucuuaauuucaucaccaguucuagaauucaaauuggugaaguguuaucgaauuuuaugaucacaaauguaaugaaaacugacauuuagucuguguuuucuuuuuagccugugccccuguaggaugcagugaagaccuuggaagagacagcacaaaacugcacuugaugaauuuuacugcaacauacacaagacaucccccucucuuaccaaauggcaaagcucuuugucauaccacaucuuccccuuuaccaggagauguaaagguuuuaucagagaaagcaauccuccaaucauggacagacaaugagagauccauuccuaaugaugguacaugcuuucaggaacacaguucuuauggcagaaauucucuggaagacaauuccuggguauuuccaaguccuccuaaaucaagugagacagcauuuggggaaacuaaaacuaaaacuuugccuuuacccaaccuuccaccacugcauuacuuggaucaacauaaucagaacugccuuuauaagaauuaauuuggaagagauucacgauuucaccaugaggacacuuaucucuuucagugguccucccaagaaauuauuuaacaaacugaaaggagauuuugauuaaaauuuugcagaggucuucaguaucuauauuugaacacacuguacaauaguacaaaaaccaacauaguugguuuucuaguaugaaagagcacccucuagcuccauauucuaagaaucugaaauaugcuacuauacuaauuaauaaguaaacuuaagguguuuaaaaaacucugccuucuauauuaauuguaaaauuuugccucucagaagaauggaauuggagauuguagacgugguuuuacaaaaugugaaaugucuaaauaucuguucauaaaaauaaaaggaaaacauguuucuucaaauugcauaauggaacaaauggcaaugugaguagguuacauuucuguuguuauaaugcguaaagauauugaaaauauaaugaaauaaaagcaucuuagguuauaccaucuuuauaugcuauugcguuucaauauuuaagauuuaaagugauuuuuuggucacaguguuuuguugauaaaauuuuuuuagaauugaaguuugaauucuaagacuugaaacaaccugaucacugaagccaacuuugucccagcacauuccuuaaguccuaauugggaaaaaaaaaaaaaaaaaugaaauaguugaaaaacucugggguguaaacaaaugauuguaacccuacacacuauucaauaaguaguagaaggagcaucacacagauuucagucuaaucugcccuucugugggccauaauauaaacauaaauguguguaaugauaaaaagucauuuucuucaaagagacuacagcuagcugcacauuguguagagcagcuucuaaauuguuagacuuuguguugaaauguaauauucuauuuauugagaaagugauuuaaaauuauuauuuuuaaucauagaaaucaggguuugggcuguauugauauugucgaucaugaaauguccacacuuauucuaaguggccaauuauuuggaaauaaagaaggaaauaaagauggcuucacauggaaauuuaaguucuuucaggguggagauuuacuugguucauacaccuuuugccugaauuaaaguauuucauguaggaggacuuuuauccuuuuugauagacaguuucauauaucuugaacucaauaucucagaucucuucuacuguauuacugaauagcauacauacauagacaauguucgccauucacuagauauuuuuuucuauuaucuuacacuuauucaagcuugucugugauuaauggaauuggugucagaugcuggaauuuauucugaccaaugaacacagcugacucaggggaguacaaucuccugccaaguaauagaaccaaacccaauaugcauaaaagaaauacaauacuccaggcuuuagcugaaggaagcaacuaccuguguaauaacaaagcagcaaaaacuauuucucauguggcugcauaggcuguauauuauaucugaucucuaauguagcuuacugguuugccuuuuuuaaaaccaaaauuggaaauuuuccuuuguaaagaaaaaaagucuuaugagauaauugcuugauuaauguuuugaacaauaccaagaaauuguuuaauuaaaauaaauauuuuuguuugaaauugaaguggaugugaaauauuguccuugccuauagaucucaaaaucuaguacuaauuguugguuguuaauaugauucauacaauagacauuuguuaaaccagcuuuugaguggagaaaauuauuuuccauuuaaacaguacagugaugauagcuaucaaacagguauacuaaaaagucagugacugugacaguuuaaaguguuagacaaaugauguauaagguucuuuaguaaggaaagauuagccaaaaauuuuuuacccagcuagaagcuuuuaaaucuacacuugauaucucuguucuagguaaaauucaaacaaccaaaaaacaguggcccaucuguagcuuaugaaucuauuuaaaauugaauauuuuauguugacuucuuucauacuagcugaaacuugcucuaaagagcuuccuuuggaaucuuuagauuucuuuuuauaagguucaauucaguacauccauaaaucgacagaaugaagaaaacauaacaaaaagccaccuauuccuuccucuugcucccuuauuagcuaaaguaaaauuuacaucuguaagacuuacugaguugcugccaaaauggaacugaauucuuaaaagcaggaacaugccuaugugaaacauuagaaaaccaaaauaaaugggaaaauucagacuugaagagcugaaucaugugacaacaaaguacugaucuuaauucagaaaggcuacuuggagaagguguaucuuaagggguaaaaaaccuguggguuaccacauauuaacagggaauaauaucaacagaggcacccauaagcaagcaagacacaacugagacagauguaccaggugaaaaaaaucuucaguauggauacacauggguauucugaaggcuacaaugaaugguuuagucuuugacauaaggaggaugaacauauuauuuauacuguguaaucuaaucuggcuucuauggggaaagcaacauguacauaagugaauuuucuacaugaagugggcuacuucugauuuuaaucaaagcuauaaaauagauuguauauuucacuagcuucuuaaaguaacucuuccauuuucauuuaucucuaaaaacaguuaacuuccugugcucuaggaaaugcaccaauaccaaaggucaauguggaaauaugggcauguuugccccuaugcuguguggucucuagauuucuauauuugcuuugcuuuugucugcucuaguaaucucccuccuuuugaucuguggccugggaaaaugugguuucuuuguauuucaaauaaaaguaaaauaguuuuuugagugguucacucaagaguaaaguguggaacuugaauugauucuuuaguguccuauuuaaauucuuucuuaaaaaaaaaucucucagaucuauugcaugggauuagggaaaguuaaaccuugucuuaguggguaguaauuucuauuugugauuuuaaugaggacugugaaaauauacguaaaauuuacuuaucuugaaacuaguuacaauggcuguggaagaguuaacagcucauggggaaaaaauaacuuuuaauauaaaagcucaaauuauuaaauugggacauaaauuuuuuauacuacuuccugaguccauuacuauguuacagaaugguaauucacuuagaaauauaacuuuucaaaaugaaagauuaaaggacuaacaaguuaucagguuaagaacauuauguuuuagaaaauucuacaucaaagauguaaguaaaauuaauucauauaaguagguaucuccuuaucuaugguucugcuaugguuugaugugucccccaagaguucauguguuggaaacuuaguugcuaauuuaacaggacuaagaaauggagccuuuaagagguaauagggugaugaggcuggagcccucgugaauggauuuaugccauuauuacagguauuaguucucaagagagcgggcuguuauaaaaguuugcccacacuuguuuguccuucuauuuuuuacacccuauuauguuuugaugcaguaugaaaacccuugccagaagcugcuggcaaauaaacuccagaacugugagccaaacaaacuuuucuuauaaauuaccuggucuuggguauucucccauagcaacagaaaauggacuaagauaguuuccaaauaagccucuacuacuacuaacaguaacuaccaauauaagagcauguaccaggucugaagcacugucuuauacacuguacguguaccugcuauaugcaauacucaguacauccucacaaacuguauuagauuuacuuccacagcuguauagcuaauaagugguagaaucaggaaggauucugguucauagccauucugcuauacugccuaguuauuauuaacaccuuugaagguuguccauuccugcuuuucuuuaguuuuggcucccaugauuagccauuagcauauacacuggaaaaaaauaauauaaggaccauauugaacucuaaaaaaucaguaucacuguuauagaacuauaguugugggaaaacuuucaaaagguccagaaugaccaggaaaaccauaucccaauucaguaacuacuccuuucccauuuaagaaaccaaaacuuugaaauaaaauauuuauuucagauaaaguuaauauuuccauaauuaagguaaagcaaacauauaugcuugaguccauuauuuaaggacuauaaaaugacuuccaugaauauuagaguuccugaaugucauuugaguaucugccuacaugcuuguuggaagcuucuguagccuuuucuuuguaggaauuccaguuuuucugaauucuucccuuuccuucagguauuccauuuugcauucuucauaaaaggcuggaucauuauagcuaugagaaggaaaugaaaauauuuucaaguaaauaauccugcauguguuaaauguaagcuuacuuuaauuacuaauauucagacaucugguucaucaggcucaaucuuuagaaguacacuuuuaguaaugguuaaaaauucacuguuaacuuuaugcuaccaaacuaaagaccaaaucauucauuuuuauauagcacugucacagaauagagcaaugagaagcacagcuccuguccugggaacccacgguguaaaggacaaguaaagacuggauuaaaauuaaaucuacaaaauacugugacagagguauggcccagugcaccauggaaacaaggaagaaauggggagggcagagguuucaaggggaaaugcuugcguuguauuuugaaagaccaacagaaauccauauagaaggcaagugugggaagacacauggaugaggaaaaauuaaugcaggaaaaccugccaaguagauagguaccacuauagcagauuaugcacauaggagaaaaggccugaaaugaagauggaaugggcaaaagucaaaucaugaugugccauuuaugcuauacucagaaauuaaaaucaauccugaagaaaauggggcacaauuaauagagcaccucaccuguaagaucaguuuugugucuuggaugaaucugacaacauguggcagauaggacaaaaggaggcaagcaagguuagaggcaagauagccaauaaacuguuaaaauaauccaggcaaaaaugauggaaggcgcaggccaaaggaggagcuguaggaaugaaaaggaagagaugaugugcaggaaauuucagaaaucaauaggaaauaaccaauuagaguuaggagacaagacuguagauacuagacuacuguauaauucacaaagacacguuguaggacgagcaaaaggagcccaguucauuuuuggacuugaacaaagaaacaaauguuacuuucuauaguaaguaauugaauucaugggugcaaacuaaacuuccucagauuuaagaaugagaagagaacuuggggaaucaccaacauuaaggaguagauuaaaaacauggagaaguacaaagagauuuugggaaaaugggaaaaaauauuaucagggaagacagaggagacuuuuaagaagggauugccagagacagguccaguaaaagaaaaggaacaauuuguuggauuugucuaccaucagcccaucagagucuuuaaaaagagcagguucagugaugugaggacagaaaucagaucauaguguauuaaggaaaaaaaugaaaguaagagguagaaauaaaggagcaaaaacaauguuucaaaaugagagaggauagcaguuacguucauuucauggaaaugucaauaguaauuaacaaagcagaacaccuucuuauuuaaagaugaauaaauacuauuucuuaguguaucuggggacucaaagucaaguacaauuuucccuaauaauuuuccauuuacuuucaguuaaugucacauccacugcuuaucucuucuaaacaagcagaaacagccauccuuccuagccccucuccuccccucagauggacuagaaucuguuauuuucuucuuguauuucuagggggugagagagggaaggauauucaaaugauuaauauucagauaaauaauaacaaauacuaaucaaaaaagagcuaacauuuucugaauaccuaucaugguaaauguguuuacaugcaguaccucacaaucacuccauaagauauaauuauuccuucuuacaaugaggagccugccuaagguaacacgacuagcuaagcucucacugauacagaagcugaacccagguugcccucucugcagucuauacuccugucuacucugcucuagagcucccccaacuggagugaaggauaauaugucaaacuagcaauaacaauuaugaugacugaaucugagauauaaaaa

SEQ ID NO: 16162 - RNA, 776 nt, Homo sapiens
uauguugcauacaguuucuuacuguuuguuauuaaggaugcaaauuguuaacucaucugugaggaaguugaauaaaagaugcagucaaagaucaaaggcaaaaacgugauuuuagagaaagaaaagagaggaaagaagagccaguagaguauaaaaacaggucaucuuguuugaacauauuuggguaaacuaaugagcugacagcuagcugagagguuagaauggacauuuuguauuagaauaagccccacggaaguaucaaaagacacaauuuuagcuguuuaggguuucuccggaaaaccucgagaguuuagcuauggagcaugcaaggccaguaaucucuggucagugucugccuguccuuaacuauguuuugguuagggcagcacggcacaauuucuuacuuuagagucucacuuuagaauuuaccagcacagauaagaggaaaguggcuaccacuggaaaauucugcugugagcccugugugcaccucucugccaagagccuauuuggggaggagggggcaggccuguaccuauucaccucaaguccagugaggggcacuucgguggaacaguguaaccagaacacugguuaagaggauuguuuggauagaaggcuuguaguucugaguccccugcccccaccaugcugcuuuggggggaaauuagaggagaguuguuucuguuaaaccccaggcauaauaaugggucuucagaaggacuccuuggaaauccuugaacugugacauacuggggacuggugcuuggcuuaca

SEQ ID NO: 16163 - RNA, 2096 nt, Homo sapiens
uuuuaucuuuuacaguuauaaccucaaaaaauuaacacguuaauugauuuuuuaaacagauaagugauagaaacaacaguugugaaaaucuggaacauaaagugccacaucuuagugguuuuauuaaagaaauauuaauuuaaaaauuagauuuuaaaccuuaaauggcucaugccuccaucucuugaggccugccuuguguauugccaauguuugugucuucaaguucuauagaacucaaaaggaaaccacagaacaaccaccccaggauagcagagagagucugaccuaagcccacagaagccaaaaguagcaggguuggaguugaaagcuuacacuuugucuucagcucacacccugacaccuuuaggcuuugucuuuuuuuaacaucagggugccagccucgaauuuuuaaaccuuaacucugaauuucuugacuuuccauauguuuaagauacacuuuguguguuacuguuuugaaacagcuguuugucagagcuagggaggagggagggaaucaaaguuuaaugggaggugcuugucuuagaagugaggcugcugagcucgauucuuacaaguugaagggccucacucuaaaucaggguuucucagccuccgcacuauugacuuuugcggccagguaguucuuuguuguggacguccagguuccuuaaauauugguuagcagcuuucuggccucuacucaccagagaccagugacacugcuuuccucagcugugacaaucaaaaguaucuacagauguugccaaauaucuguaaccuucccuguggcaaaauugcucugauugagaaccauugcucuaaaugaauuaaaaagacugagaucauuuuguuguuauuguugcugucuuuuagagacgggaucucacucugucaccuagcauagagugcaguggugagaucauagcucacugcagccuugacuucuugggcucaagucauccucuugccccagccuccagaguagcugggacuacugguguacaccaccaugccuggcuaggacugagaucaaacucagaaaggaaggcaaaauaaagagaugacagaugaacauaucuagaaaaauuauccugguacuaguuagauggacuaugaaugcauuuuacuuuuuaaacaaaucuuauuuauauuauaaauaucuuaggaaacaaaaaaucaaauagaagggccauuacuaaaugaccguucucaaaaaaucaagcaacuugcauagauauacccaguaaauuaaaggugaacccuaaacuaaaacuugucucucagagcagguuauguauauugguguagugacuugguagacuaagagcaaaaguauucuugaucuuggaguucaauguccgcagagccagaaaaccugagagcucugcuauuuuuaagcugcuacauauugacugccucaauugcuucaggggcuuugcuuugugucuuacuauaugagguagacauuauuguucccauuuuacggaugaugaauaugagguauacagagguaucacuugcccagguucacggggacauggucaagaauuaaaaucaggucugccuggcuaucaagcuugggcucuucaaucauuaugguuucggcaucccacagcugggauaaggccacggauucauugaacuugacaaaguaaucaucacauuuguuaucucaccucacacugaacccaggccugcucuguccucugaugccucugcccagagcugaccacgcaagggcauucaaggagauuguugucacauaagauugucucauagaagucucuggcucaaauauugcaugauucugugauucuaaugaaugucguccagagaaaggaagaaugccaugacauuauuuauacugagcuagcaggagcuauuuggaaagaagcacccaagugaugcagaaaaguagaucuaguguuucugucaggaauuccauauuagugcaggcagugggauauuagauggugggauauuauauguaaccuuguuauaaugggugcagaagauauggaaacccucuaguagggaaggcaugggggccuaugggaccagacaaaaccagaugucauaaugaggggcuucuu

SEQ ID NO: 16164 - RNA, 8318 nt, Homo sapiens
uuuccaaguggucaacuugaccgaugcuuuggcaauugaaaaagggcagaaaggcgcgggcuaguggguggauggggacaaagaucuaagucaccuucuuccagcgugugagccugggaggaggguggggguccugaggagcaagagguacgaggaaggaaaaggagagggcuucuggguuaguuuccaccuccugcuuuccaacucacggcgcuuuccuuccggaaaggacgcuggauucagggcgcgccaguacgcgcaguagcggcccgcgagucggcagguggguagccccggcgcgggaggaaggggaaguuaccuuccccucggaagagggcgcuggcucccccauccugccuuuauaauaaggccaccggaggagaggaagcagccagcugccgucugcgcuuugcaaagcaugcaguuaggggagcagcucuuggugagcucagugaaccugccuggcgcgcacuucuacccgcuggagagugcgcgaggcggcagcggcgggagcgcuggccaccuccccagcgcggcccccucuccucagaaguuggacuuagacaaagcguccaagaaguuuuccggcagucucuccugcgaggcggugagcggggagcccgcagccgccagcgcaggggcccccgcggccaugcuuagugacaccgacgccggggacgcauuugccagcgcugcggcaguggccaagccggggcccccggacggccgcaagggcucccccugcggggaggaggagcugcccuccgccgcugcagccgccgccgccgccgccgccgcggcugcggccacugcgcgcuacuccauggacagccugagcuccgagcgguacuaccuccagucccccgguccucaggggucggagcuggcugcgcccugcucacucuucccguaccaggcggcggcuggggcgccccacggaccuguguacccggcuccuaacggggcgcgcuaccccuacggcuccaugcugccccccggcggcuuccccgcggcugugugcccacccgggagggcgcaguucggcccaggagccggugcgggcaguggcgcgggcgguagcagcggcgggggcggcggcccgggcaccuaucaguacagccagggggcuccgcucuacgggccguacccuggagccgcagcggcgggaucuugcggaggacuggggggccuggggguuccagguucuggcuuccgugcccacgucuaccugugcaaccggccucuguggcucaaauuccaccgccaccaaacugagaugaucauuacgaaacagggcaggugagcgcagcguggaggggccccuggguucggggauaaagggugacgugugguccuggggaagguccgggaugagggagcugaacccaguuguuccgcgcggugcuuagaguguuucaccgcgcgcaauaaaucuccguagacaccgcaucuccaaugcggugucccucugugucagugccccggcggcucuugcagggugccaauguuacggcuguacaccgcuuuucccucccaucauccucaccugaacagaccuggaggaggcggaaauggaaauuagggcauguccacaagcuggauucguuagauccuccugcucggcgguaugcuugugcaugccugcaugccggcaaggagccacggauagggaaggcucaagagcuggccaccugagcgcaguagaugggcucccgcaguuuuaggcgccagggucuccacggggcgucuccgggaggugggcaugaaggcuagagcgccggccucggaagcucggucggaguaggugguuagaucugcccuggagccagaccuggcucggguucggugcgcgagaaaguucugauauacauccaacugcuaacacuggcuacuucuggggaaagggaggggugggugcugagagaggggcacucaaaggggacuuuuagccuaaaguuuuaauauauauuuuuaacaagaauaaccuaauauuguucucugguacuuuucaaaauggugcauuuaaaaauuaguaguuuuuaacauucuaggagaaaaauuuuaagagcgucugaaagggccgagaauaugagccuucggaagcacgcgcgaauuuggaauauaccgauguuggggcaagcuuuuuuuuuuuuuuuuuuuuuuuuuuuuuuuuuuuuuuuugaaaagacggaaagguuccaagaguugccaacucaaaaauauuuuacauaguuucagaccacuugaucuaccagcauucuguucacugcaaacuuuuaaauguguuccgacccuaucccaggugucuggggaacccgcuggggccugggccuguucuaggacaucccaauuaaaaucgauuuuucugauucuauucccuugcacaggcgcauguuuccuuucuugagcuucaacauaaacggacucaaucccacugcccacuacaauguguucguagagguggugcuggcggaccccaaccacuggcgcuuccaggggggcaaaugggugaccuguggcaaagccgacaauaacaugcagggugagcagagaagaggcucgggccggggaggaacgggcgggaagaaaucguaacccucgacucacacaacucacauuuaaauguagcacuuuuuuuuuccccuuccauucugaggccuagagguguuaguaugagugucuuugaguugcuuguuugacggagaggagaguuugcuaagucagauuucuugucugccaauauguagauauuuagaaccuuuaacuaagacaucaccccaccccccaaucccuacguuuaacaaaucaguagucauaagcucuccaggugggaagggcuccugggauucuaauguucacuugagaaagcccagccaaaguuuaguucacccauaaauauccaacugucuuccaucggauguugcccuuacagcuuuagaaggccccaaauugaccuucaagagucaucucuuguuagcuccguuucuaaauucugaaaugccauucaggggagucccuagugcaaggaagguuggaagcacaggggccugggagggauauggauguaguccugcuggucuccacuggccucuuuaagcaacuuuuacugggagaccaacuguaagucuagcucuuauaucuugcucauagcuaagagacaucccuccgcuuucuccauuuguaaacagcccuauaugcuuggguuuuguguuuuguuucauuuucucuuaggcaacaaaauguauguucacccagagucuccuaauacugguucccacuggaugagacaggagauuucauucgggaaauuaaaacucaccaauaacaaaggcgcaaauaacaacaacacccagguagagugacagagcaggaggggauaucuucuggcuuugacuauaaggcuuuuuucuaauaagagucccuacucuuuucacuguauuuauaauauuugcauuugugaccuguuugcucgccuauuucuaaccauuuuuguucuuuugaccuuucucaucuucacuuucuuauuggauuucgauaacagugaguugacuauuaagaacagaaauagcgaaguauuuugggaauuuaggaaaccaagaggaaagcauaucuaucacaaccacauacccagcuaugauuuaaauuucaaaaaaaaagggggggggcaauaaugagaccuuuaaacuugcaauaaacaaagcuguuagugaggagcauuuagaaguccaauaccaaaauacauaauuugucaaaaucuaauuuuguugaaccacuaagaggcuuuuuagauuuagcaauuuuuuucuguacucuuuccagaugauagucuuacaauccuuacacaaauaccaaccccgacugcauauuguugaaguuacagaggauggcguggaggacuugaaugagcccucaaagacccagacuuuuaccuucucagaaacgcaauucauugcagugacugccuaccaaaacaccgaugugagugucccagacaucucaagaaucucuaaagcuaagguccagcaugauaaaucacucaaugacuguuuuucuccccuaucuagauuacucaacuaaagauugaucauaaccccuuugcaaaaggcuucagagacaacuaugauucguaagugcagcuuuuauccacacuugccugaucaucucugagcaggacauacaucaacaggcacuuugcugauaauguauuuuaggaagagcuuuuaccuuugggauuuuuacauauuuuucuuuuuccaaaauuuuuuccuuuacuaaucuugcuuuagauuuuucucagaaagguuguguuaauuucugaagaaauguuaaggacuuaaaaaugaagagguuuuuuuagcauuugagugaagauuugaaauuuuaagaaucugcauuuauauauaccuuucuuuucauuugauccauuuuuuuauccucccaagagcagauauuauuacucucccccacccccacuuuuuuuuuuaacauaagaaaaaacugaaacuaagaggauguaauuucacaacacgaaauagcaaggcccugcucuuuuuaaaaucugaguuuucuaccgccacagccaguguuuuuuccaucacauugacaaaggagguuugaucugaguuuuucguguucuaggacuaguaaagguagauuuucuauaguuuaaauacuugaugccuaggaggaaacuuuuucuugcauggugggaaauuuuucccaauaagccaagaguccagcuaaaaugggccagugcaucuccugccucuguucuuucagcccaacagaccagcacuuucgguguagauaaccaacacaagccuuuuucauuucugggaggugguuuguuuggggacaacauuaggguuuuuuuuuuuuuuuaaguguuucucuuuauauuguagcauguacaccgcuucagaaaaugacagguuaacuccaucucccacggauucuccuagaucccaucagauugucccuggaggucgguacggcguucaauccuucuucccggagcccuuugucaacacuuuaccucaagcccgcuauuauaauggcgagagaaccgugccacagaccaacggccuccuuucaccccaacagagcgaagagguggccaacccuccccagcgguggcuugucacgccuguccagcaaccugggaccaacaaacuagacaucaguuccuaugaaucugaauauacuucuagcacauugcucccauauggcauuaaauccuugccccuucagacaucccaugcccugggguauuacccagacccaaccuuuccugcaauggcaggguggggaggucgagguucuuaccagaggaagauggcagcuggacuaccauggaccuccagaacaagccccacuguguucucugaagaucagcucuccaaggagaaagugaaagaggaaauuggcucuucuuggauagagacacccccuuccaucaaaucucuagauuccaaugauucaggaguauacaccagugcuuguaagcgaaggcggcugucuccuagcaacuccaguaaugaaaauucacccuccauaaagugugaggacauuaaugcugaagaguauaguaaagacaccucaaaaggcaugggaggguauuaugcuuuuuacacaacucccuaaagaguuauuuuaaccucaaaaauuagcuaacuuuuugcagauggacuuggugguguuuuuuguugucuucuuugccuagguugccaaaaagauguuugccuuccaccuugaugcauccuguuuugugcaauucucuaaaagaaggugccaaagcuuuuugauugcugcagguaacugaaacaaaccuagcauuuuuaaaaaauaagauuaauggaagacuuuaagguauuuuaaaauucgaaggguauccaagguucuguauuuauuuauuggggagacacuaacccuucaaagaagcaggcugugaacauugggugcccagugcuaucagaugaguuaaaaccuuugauucucauuucuauuuguaaauucuuaagcaaauagaagccgaguguuaagguguuuugcuucugaaagagggcugugccuuccguuucagaaggagacauuuugcuguuacauucugccaggggcaaaagauacuaggcccaggagucaagaaaagcuuuugugaaagugauaguuucaccugacuuugauuccuuaacccccggcuuuuggaacaagccauguuugcccuaguccaggauugccucacuugagacuugcuaggccucugcugugugcugggguggccagugggacucaggagagagcaagcuaaggagucaccaaaaaaaaaaaaaaaaaaaagggagaauuuaaaaguguacaguuguguguuuagauacacuauagaauaaugugguauauauuguacaaauagucuacauaggugucugggauaauguaaaacuggugcuuuggcuuuguaaagaauuugcaaaucacuuaacagcugcaggggcaaggggagaguuucaucauccccaugauauuugggaauauucuguuuacuucuuagauaguuaagaauguauucagcuacuauguacuaacuugaaccguguuuaaggaaaacuccuauuucauccucuucuugcgccauccccucucccuaacuugguaaugugaagaaacuaaaaccugauaccacagcuccuauaggcauuuuagagaucuuggauuuuuauguacagucuuagucauuuuuaauaaaugugguucaguaagggaacggacauagcucugucuucugugcuguugggguuuucaucuuugcuuuaaagaucucauuuugcuuccuccuguaucguuuucagcuuuaacagugccucacccauccccuaccuccacggaaggcucuagaaucucuaacuggauacuguagucaugcggggguggggauguuuuguuuaucuucuuuuuuccuugaaguggaauggggcuauuuccuuaccccacugggaagucuggacaauggguguuggcggggcgggggaggggggcgggggaacgggggagggaagauugcugccgauugcccacaucagacuuaaccaagccucgaaaaccuccgcuucuggcucuuggagaccaggcucugucagagcgccuggccacuaaguucucugggcuuuuuucuaggcuuacuuggggccacccauccuuaggcccaccuaggcucccugggaacccccguggcccuuugagcgcccaccaguucagggucccuggggcgcggcggagcggggggcugcacacagcucagcuucugcgcccaccugcggcuuucuucugaacccagacgcugcgcacccgccgccgccggcugccggccucaguagcugcagucaaacuccgcccggacucggucugaggcgcaggcuagggacgggcguggcacuuacaaaggaggauuccagucguuccgugcacugccgcucugcaaacagugaccuuggagcaguucaccuugcgcuuaguuccguuuauuuggcccacgcuccacgggaagacgaaggacagcccauccccuggcugaacccugggagguccaaagagugggguggaggguccccuuuguccccccagccagacgucccgccaggcuuaucugcagacggcuucaggcccagauugcaaaccuuuccagcccccuccuggacccucccgggguaaaggucuagcugggaggaucauucugcuaacuguguagcgcggaaaugcagcugcuaagaggauuagcugcugggaggcgagcaaucagccgagaccuccuccccuucugcgcccaauuaaggccgccaggaccuuguaccucgacuguccugucucccuuccccuccgucccucuggggcccgaguucuucccgcgccacccgugaccuugggggcucgaacuccugcuccgcguuuccgaacggccuacucaaaacacuuuggcaaaggcgccccgaacuuuaccggggagccaaggacaaaagcguugaagaugugcuuuuuaagauauauguacuguggaugacugauuuagauuccggaagggagacucauagccccccuauccuggucagcgccuuccccacacccccaacagcccccuuacaucugcauccaaccaccgaauauugggagaugcgauggaauuucgaaaacagugcucuccuauuucugcccucuagaaagccccaaagugcuaaucacugccgggauauagcagauucuggcccuagucuauuucggguccuguauguuuuugcaucguacaguaaaaaagaaccugguacuuguga

SEQ ID NO: 16165 - RNA, 671 nt, Homo sapiens
ggggguccagucacugagccaccaccgaggacucagcagccucccuuuugagcccccucacuuccugacauuccgucccggcugccugccuucucccgccaccgcugccuuccgcaggccguuuccaccgaggaaaaggaaucguauuguaaguucgcuauccagaaccuccacucuuucgaccccuuugcugaugcaaguaagggugaugaccugcuuccugcuggcacugaggauuauauccauauaagaauucaacagagaaauggcaggaagacccuuacuacuguccaagggauugcugaugauuaugauaaaaagaaacuagugaaggcauuuaagaauuuugccugcaaugguacuguaauugagcauccagaguauggagaaguaauucagccucagggugaccaaugcaauaacauaugccaguuccucguagagcuuggacuggcuaaggacgaucagcugaagguucauguguuuuaagugccuguggcucacugaagcuuaagugaggauuuccuugcacugaguagaauuucccuucugucccuugucacaacuuggaaaaccuccacagcuuauguaauguaaccguuuggggucugcucuuaacuuggacuaguguaacuccuucaugcaauaaacugaaaagagccaaaaaaaaa

SEQ ID NO: 16166 - RNA, 22159 nt, Homo sapiens
caccgcgguccauucaggucccugcaccgcacuccgcucggaccccaggccgccggugcugucgcuacucaagugagucccgcggugccccucccgccgcgccgcccgucgggcauggacucgggccgggacuuccugacccugcacggugagugccuggcccgcgcgagcgggagacccugcagggguggaccccuggaaagcuguuccgggcccuggacagggagcccccagcuccuucggccgccuccacaccaccccgggcccgccucucugccccuucuccggacugggaaaaucucagcccgcggcucccugggugggacugccgggcacgacccugggcguuuccaggcuuguccgagaucuagcccggggggugggugggcgggcgguacgggucuaaagacuucccuccgccucgcggacccccuuguccuggucaugaaagucugggcuccacgaucccgcucgcacggaggggcggcgaaggaaggaaacagcauccaagaacgaccaaaauucuccuugccccauccgggccgccccagaggcuccccaaagccugggcgugccuggaccgcgucaggccgcgcggguguggcggagcaggggcuaagcggguggggagaggaggugugcaagguuaaccguggucgggccgugcagccuuaacugcccagcgcagaauagucagcgaugcucaggcugaaagaagcagcacgauccccucaucugcgacccuccucgggggacagggccaggucucagccggagcugccugcuccauccuuuguccagcggagcuuuguuuccuccaauaugagccagcucuuugcccuuucgcugucccuccagcagcgaggggagccugggcucccgaaggcagaucuggaggccuucugggaggcgggagguuggggaggguaacuuugggcgccucuuugcuccaggacaggcacucacucacucuuggugggggcuugcccuccugcccucccaggucacuugccaucucagcaaacccugcuccuuucauaccaaucacugcuuuacuguauaucccucucuuuuuuaguacccuugggguuggaggcuuuaguggccaccacccauccaucuaaacuguucauggacauaauagaugggaaagagaagggcagaguccucuagccuuccacuagagucccccuggaauuuagagggacuuagagauguucccaucagccagccuccagucuaucucguguucugcaguuggcacagaccugguccuccuggcccagagagaccuugcucugugcccagagcuguugcuuuuacaccaauagccuaggcuccuuaaagccaccuugucuagaugagucauggagucccugccccuuccagugcucccucuucuuucuucaggccagaggugucuuucgugcgccugccagacuagcaagaagggaggcugggcagcugagaggacacaguggacaucucugcuuucucucugacacagcgucauuccuuggcuccuguuggaacaggcuucauccucagugucugugccuuuguccaguuucucuccugaggcagccuugauaucuuuuccauggaggaagacacauggaggcucagucaggaccucccaguccuguggcauaggcuuggcugcccuggcccaccccauuugagaccagccucccaaaugccuaacucaguccagccuuuccugaaggguugacaugaacacugugaccccaagcuguuuucccugaaggcccugccacuucuagcucaucacccaaaauuaccucaacugccuucuguccacacugcaaaccagauggggaaauaagaaccugucaaggagaauuguuggugggagggggugaucacugugcccugugcuguuccagguugucuacacuugcauuggagagucugcauccguuucacagugugggugccccagcacuggaugugcugcaggaccacacucucuggccuagggcuccacacucucuggaaggagcccagagggacuccuucuguuggccuggggagcuaugcggcucaccuagaugugacaugucccuucuguccucaccccagaugcaugcagaaguaauguaguuuacuggcauagauucugaaagcaaaguaccugaguucaagucuuggcuuucucaucucagaugaaucccuugacuucccugugugucaguuuccucaucuguaaaaugggggauaauaccaucuaccucauaggguugcuacgaagauugaaugagauaauaucuacacagcaguuagaacagugccugguacccagugaguacuauguuccugcaggaggcccccuccccaaauuucuaugcccuaugaguugccaucuguaguucuuugggagaugaugggggcaucauaagguaguuccuagucauggaaaauagggccagaacuagauucaagagcgagccagccagcucuuucuagugccucugaagcccucagacugaugcgacagcauccauccuccuuccuucaccuuacuucuuccacucuuuauucuggcuaugccuggacuggcuucucuagcaggucccccgaugugccccaaaggacauuaccucccagggcccuccccucacugaacaccccccacauacacacuaacuuuuccuacacccaaucccuuuugcccccaccccugcaagaggugccguuuguaaaaacagaaaauagaggggccucaucuuggccccaguagaccugggcuccaguccuagcuuugguucuacuuacugugggucugagaaucauccaugggauagcaguacauauuucacaguggguguugugaacauaaacgccaaugggcauagaaauucuagguugccccaaaaaccaguccuccaagagaugaugauuccagagcucuuagcaaguugggguggccagcuccucacucaccuguguuccaaagcagucugccccugggcuuccaggcccaugcuacacaggcacacacugauccacaccaaucuuaacuuuuugugccacagaccacuuuggcagucaggugaagccuguagaccccuucucaggauuauguuuuuauuuauuuauuuguuuauuuauuuaugagacagaaucucacugucacccaggcuggagugcaguuugcgccaucucggcuuaccgaaaccuccaccucccggguucaagggauugucuugccucagccucccaaguagcugggauuacaggugccggccgccacgcccggcuaauuuuuguauuuuuagcagagacggggugucuccauguuggccaggcuggucucgaacuccugaccuuaagugauccuccuaccuuggccucccaaagugcugggauuacaggugugagccacugcgcccggccaggaucauguuuuuaaauacagaaaauaaaauacauaagaauucaaaggaagccaauuauuuugagauguuauucuaucuacagguucuugaggggucuuuggucugguuaagaaccccugcgcaguuucuccauaacacaggcucccuuugcacucugcuuccccucuccaaagaauagcuuuuccguguucauauuucagcucaucuaccuuguccaucuacucaccuugcucaugauuuauucucucugauaugaccuuaggcaaguuacucugcgcuucaguuucuuguuauuacugcugugcuugucugugccaauaacuggcuuugccagugacucacugucaaugcuggugacuggagcugcagugaagcgaacugggggaacuauucagaggcugagaguaagagucaggccucugggugguguccugacauuggcacacaguaggggcucaauaaauaauuacugggugaaugaaagggaaguugugauguacaugaaaggacccacuguucccgagcauauuggcagcaaaguuuugugcaaaguuacagucguucucauguauuuaugaaagccacccuggguuaaugggcuuauuuuaagaucagaauuuuuucaagaauuucguuugcauccgucaccuuggggauuaucacuuugguggucaaaccgagagaagcaaacaggcccaccugagguucacaaaugaggcaacagcaagcugagucgcaaugaauuaguugagcaauugaaguaaaauacuuggggggggcucggugucuggcccaggcuccauccccggucccgccugaucucgccccacucagguccccgcuagacugccauccaccucccacugggacuccccucagcuuuucuccccagacucagcccuucgguucugcgccagccucaaagguggcguuagaauucgccgcuccggcuccuuggucagaccccgcccacacugccucccggacccuggcuccgcccccgcaccgccuccaaagccgagggaccgccccucccugccuggacaccgcccuuccagugcgggauccucccaggcucgccuccugggcccuggccccgcccccgggcugcuuccuggguauggcucugccuccacgucgccucuggagcagaggcucccggccugagcuccgccucugagccuggccccuccuucgccccgcugccuuggcucuggccccgcccccaggcuucgacacagauuugcuuccuggguuauggauuugucccacuccgccuccgcggggcccggcaccuccucggccccgccuccuggguucuggauccacccccauccccacccacgccucgacaccacucucgccccaucuccaggggucguuagucccaccccucuuggauggcccagccuuuuggggucugacucugcccuccuuagcccagauuuucuucucgucccgccuccuguauucugacuccccccacucauuuacuuugccucgguuucgcucucgccucaccuucagggggcauaggucccgccgcucguggacuagcuccgccuccuagcgucugacuacccccucagcccagauuucccucucgucccgccccuccgaagugcgccccuccucucgaacucuagcuccucccucccauuccuggacuccgccccugcuccccuccaagggcgacaguuccgccccccggaccagagcagaggguguugugagcauaaaacacuggaggcggcacugccccggacccggcuccgcgcaggcaggggcacuguggagggccaugcagugccuggggauccggagccggagccgcuccagggagcucuaccugcaggagcggagccuuaagguggcggcgcucaauggacggaggcuggguaaggggcgcagagcacuccgagaucugcgggggaaugggaaggcagcuggagcaggacgccgaccacuugucccuuaacgcggggccauuugccuuggagccuuuaauuggacauguuuaguacuucugugaguguguggcccacuguggggcaguguuugcagugguagcacgucggggugaguacuagggugauuaguuaccccuucucauuauuuaacucagcccuuccaacgcuccccaucccuugucacccgacgccuuccuguuuacaaauuucugaggcaccguguauguggccuggucuguguaaccaaugaggugaucugcaagaguuugugcuucaauaugauccugugcaaaagugugccuguaugugaugggugugacaguggugaucuaguaugggacccagugccgacugaguaguucugucaugccuggggucugugguggggccacuguacaguguguaaugauggugaugguguguaauguugugaaacaaagugugugacauuguggcacugagguggcugcuuguaacccagugugacagcgugugaucuguugugauacuguucaacugagugugacuguauaaccaaugugacagugggugaccuagggugacugagugguucugucauuccauuaugguguguguguuauauggauuuucugauguucuuacucuguggcaguaugucccuucacaguggcugcguaaaguuucauaccgcugacccuguggguaagcuaccugcuucugaguccugacuccaccaugcaacuuccuugagccucaguuuccucuuguguaaaacaggaauaaugacagugccuuccucagaggguuauugagagaauuaagugcaugugcuaagaacaguaucuuauuuaaauauuaacuauuauuaugggagccucuaucaucaucaucaugaugcucuggcacuauauguuguguggcuaugcaugacuaagugugacacugugcaacucccugugacaguguguaauuuuggggggcagugugucauuguguguggcucauugucucuuugagguugugugagugguggucuagugugugacuguguauuuguguggccauaucuguguagcuguguaucgcugugggucccaggcccagugugucuuuauuaugcaucacccuugguauaggaacaggacuccuggcaccucccucagcuucccacuggcaccugcaacacccuguaugccccaccacauggccaccucacugugcacagcuagccugggcaggcugcaaggucaacccagggucagcucaaagucuccucgccacgacccucccacaggaggagaagcucuuagauugaugcaaaaguaaucacaguuuuugcuauugaaaguuuuugcuauuacuuucaauagcaaaaaccgugauuacuuuugcaccaaacuaauauuaugacuggguugaguagggcugggugaggggugccacagacuuucugggugcuaagggagcaagggugguggggcaggaaguccagaagcuuugggaacagaagggccccaaaugaggcuaagagaugagggcaccugcccagguuuccuaaugguccagagggcuguggcuaucaccuuucuggaauuaucacccuggaacugauguccaccuuuuagaaaccauuguuggcagcuggggguuuaucucugccugacuguagauagggccacagccuggcuccaggacaggaugagcaugucaucucuucaugguguuuuccagaacaggaggguggugcucaacuucuacuuccuggcucccagcuccauucccauacaugcuguuggcaguggcuugcccugauguaugcccagcuugugggguggggugcuggcagaggguaaggagaugucccucucagcuuuagagggacaucagccuuagaagggauaguggaauuccccgccggaggccggagguggcccuguccucuggcagccugggaacucccuucugccuccucuugucucaggcuccucagacacagccaguaguugggaauauucuaucagagcccccuucuuuuccacugggacuccccuugggcuaagagggagcugcucacgcuaaggcacaacagcucaucaaguggguggacagaccugggagaaagguggaggaaggucacaucagacugucaccccugaggaggcccagggaugccuccccuacacuguucuuagcccagugcugaugggggaacaaaagcagagagagggaagggaguugccuaaagcuauaggggguggauguuagcacugaccucuauccugauuggaagcaggagacuggggaaggauaaagagugugugagcaacugaagccuggggaagugguccagaggguucugugagcccugaagauaugugggacaggcuggcugggggaggggguauggauaaaaugggagaggccaucuguuguuggggaucugggcucagaaaagaaaaggccuguggcuucaugagggcuuccccacauaggcuuaggcucaagacccucagacuagacccuugaagucccugaggcugccacugugcuggagcagcaggacagagauugcugaugggccacauaguucuagggagagaagugaaguggccgauuggcucucaauagagcuggcugcuggacuauguacguggcuagggugauacacgcacacauacgcccuuauagauguuucuguauuacaccaguggguuacuaaggguuggggucacuuuuaucaacuuuaucaguugguacagaaccugcuggguggugaaggcucuggcguccuuuuggugccuccugucugggccugguaggacugagggcaucgcaucuuugggagcccacaccucugagagcagcaaaagaguggggcaggacuggggcaagcagccagguuccucucucugggcucugggacaggaccugcucagcuucggaaagggaugcacugugccuuaaagcugcuguauccugaggggucccagacccugggcacucugagauggggcuggggcagcgaaggacagggccaucccagcagaccaaacacaggcuacagugcacucaucugucucuucuuggggcaaagaucagagaucacucaugugggcucaagucagaggugggggggacagcaaggguaaggguggcagagaugggcauaggggucccacagcaaccacaauguugacaccaagaaccccaacugccauuaucuuggggccugcacagauucaggcaucaucucauugaaccuagaacuucccuuugaggugguugcuguuauuaucuccauuucauagacaggaaagcagaggcccagcagcaugaagucccuugcccaggucacacagcuuguugggaagggcaccugaaccuaggcacaaaugauucuggagcuauuggaguugggacguuguuuggcuccaugacgcucugggguccaucugugucugucccccuuuuaucucccugcuuugccuaaccuuuugaucccagcuuccuucaguucacucugacuccuaagugugaccaggaggggcucaccuaaucuuucaaaaccaucuuucagaacauuucuuagggggcugguccucuaggaaccagggguucuugaauuagcugccuuucuuuuguucauucagcuguggguggcacgucacaguguguaaguauggucuugggugggcaggugucccguuugcauggucaccuuagcuggcaaucagggaugacuuccuggaggagggcaggcucugggagcagguuggagcauggguggaggagggaggaguaaacagagcugaggaugaggcuggugaaaagugggcucugagagggucgaggugggcauggccagugugaggccuagggcaucagggaaacuaguggagaagguggcaucuuacuggcuuugauccccaggccuacaggaugaugaggaucuacaggcgcugcugaagggcagccagcuccugaaggugaaguccagcucauggaggagagagcgcuucuacaaguugcaggaggacugcaagaccaucuggcaggagucccgcaaggucaugcggaccccggagucccagcugugugagugcccuggggucacaggggaggggauagaguguggaaucugcucagggcuggguaaauacaaaggucagucauggaucaaaaccacagauggggaaacugaggccuggccugguggggcauaggucauuuauauaaccugggcuggcaguggggaaacugaggcuggcugggguuggggagcagggccaguuaaauugccaucgggaaauugaagccuagucuggacuggagagggcagucauggaacgaggaccgcagauggagauggcaaagcuuuugagggauggggauacuuaaccaugaccacagauggggacagccaggcucagaagcagggagggaguuggacgguggcccaagguccaggcagauaagguacuuccgggguugaguggccaggugggagcuagggcugcaggaggcagcuccucccugggacuggagccacaggagggguguuagggcagagcaggacugggacacacagacagaggccacugcuggggagcccuugugggucugagggcauucuggaagcuucuaaaaagaccaaggaacccaagucucaggccacaaauggagagagccuccugcaaggccucagggagaagaaagcucugcucacuucacucaguucucucccuuuaagggagagaauucccuaaagauccuguaaagugagaugucucccucuaugccuuuacuugguggggaaauuuuagaccgaugcuguacaguugaacaaugauggaaauguucuauaucugcacuguccagcaugggagccacuagccacuuguggcuauugauugagaccuugaaauguggcuagugugacugccgaacugaauucucaaucuuauuuaauuuuaacuaauuuauauuuaaauagccccagguggcuaguggcugcugaauuggacagugcauauagaucauugcagccuggguuucacauagccaggccccuggagaucccucgcccauucuccugccauuggcugagguguggguggggagaugggggcaggucuauggggagugagacuggacaugggugauaagcgcagguaggaggagagcauaaggaaggggaggaucaccccaccgagggugccuuucacccaggaagggucugccuugccucaggacacuggacaggacccugagaagguauggccugccaaccuguggccaguggaggggcugaagguaaggcaggacaggagcagggccaguugcagagagccggcuggguccuuggggcugugagccauggaagauuucugggcagggcagggucugagggguaggggcuccagaacauucugaggaaaccacacggagccccagcucagccugcugccacacuguacaggagugaccgccugaccuuuucucuguggcgccagacaggcuccuucauggggcucuugcccugauaugggauuuccuguuagaugcuggugggugggagcacagugagaauggggaucuuauacucugagcccuggggauucccuggagcccaccuaccuaccgauacguauggaugacucccagugugugccuagcucuugggaagcaugagaggggagauagaggaguggaagacccaggccuuuccccgcaggaaccacauuugagcuggcgagaggaggaccuuguauugggacagcugugagcagaugggcaggaaggacauugcaggcaggaggcccagugugagccaaggugcagggugaggaggaggaacaggcaugagugggaggcugaggggcugcguccugccaggaggaggggcugcagggagccagguccagggucagggagccaggugugcgcagguauggagcaaggccugagggggcuuucugcuggucagacgccugagacgggucucgugcugagccugcuuuguuggcugccucccuucucugggugaguggugagacuguugucuucaauugcucuuuaaccuggaaaacagaggccaggugagggaggccuggaauagccuccccuucugcccaguuuucuuuagcucugcuuccugcuuuuuaagucuccccaauccugccacuacuacccacccccaugacucugguucccagaggccaaagguguuaucagcagugaaggcaucuggacuuucucucugugugggugagggcgcuggccuugggugggggucccauggcucaggcuuccuguuuucauuccugacccaggcagcugcagcugcacccugugugcggccgugugggucaccaggggcugcaggcagagggauuaagccgugcuauccucugucccccacauggcccugggcucaugugucccacuccucaaagccugcagcccaggcuggcacauguuacaucugugggcccugcagguggcuaggaggccccugggcacucagagugggugggcacagggagggacagguggacuucagcuagaaccgucuaggagccaggacagauggaugaggauggcucaggauggagguauggcaggggcagagccuggauccugcugcugggaggcacagcaugagccugacuggaagaacuggcuccuggccaggccauggagggcacauuggaagcggggguagacagggccuggcaucucccugaagcuuggaaggcugggugugaggggagggcccuccccuuggcuccccuaagggcagaaugauguaaucucucagaacccugcaggagacccuccaguuugccucuugggacuggggaaggcagagucuuccuguacccccugccaaggggcucccugaagucaggacacacacagcugcacacagggcacgacccugucuccucucccaugcagggcuucucccucugucuucggcccucugcccauagaccccagggcuggggcuaacugagggugguuccagucucuugaauguucaggagaggggccugguggcucuuguggcuuuaucgggucaggacagacccaaaguccaauacagucagaagggugcauggcccuucucugucaugggccccacacuccagaguggucuguccgcaucucuaagagccuugcccugcuccaguccucucccuggggcccugcaccccccaucaccgagagagcaggccuggggucccaggugccuuuuccgcccuaaagucugucuuucucucacucucugucucucccugugugucuccacugugccugcaaugacugugucucaugcucugucucccccucaguuucugucuuccuuucuccuuuuugucccccacuuguccaaccuccugccccucuccuuuccuucuggacucaaggccugagcuccggcccuggcucugugucuccaagccaugccccucucuacuguggccuuggccaugucagggucagggacugaccucacagcauucucucccucucuccuccaccaucccccucucgcagucuccaucgaggacauucaggaggugcgaauggggcaccgcacggagggucuggagaaguucgcccgugaugugcccgaggaccgcugcuucuccauugucuucaaggaccagcgcaauacacuagaccucaucgccccaucgccagcugaugcccagcacugggugcuggggcugcacaagaucauccaccacucaggcuccauggaccagcgucagaagcuacagcaguauccuuuugguggcaguggguccaggccuggcuuguggacacuggcugugguuauccccagggcaacuuggguauggaagcugguuuagguacuuugggcugccauaacaaaauaucauagguggcuuaaacagcauaauuuauuuucucacaguguggaggcuggaaguccaaggucagggagccaguauggucagagccuggugagggcucucuccuuugcuggcagaugacugucuucuugcuguguccucacaugguggggagagagagacuagguucucugccaucucuucuuguaagggcacuaaucccagcgcgggugccccacccucaugaccucaucucaaccaaguuaucuuccaaaggccuuaucuccaaauaucaucacguugggcauuagggcuucaacauauaaauuuuggugaguuggggggugggguauacaauucagaagggaaggagggaagauacaugaagcccucuuuggucuagucugaccagagcccaaauagcucugcugcucccugauacucccuguguccccgucugucaccagcauggaguugggggucuggggagccugaggggagcagccugcugcaaugggagaccagucuuggauguuuuaaucauguuuucuagaguuaccacacgauuucccucugggaguugggaggccaugguacccuccugugccauucuuuggggagugaucaaguuccccugggccugguguguaggccagccugugagcucaaaacaaauuaacuucaacauuuaguuacacaaugacacacugguuuaugauucgaaguggucgggcuucuggcauguauggauuaggguggagccagcucucuccauuuuuuauggcagcuuuauugagguguaauucacauaccauauaauuaacccuuuuaaaguguugaaccugauucagugcuuuuuaguauauucacagaauugugcagccaucaucacaaucaauuuuagcacauuuccaucaccccagaaagaaacacuguaccccuuagcagucaguccccauuucaccucaacccccagcccuagacagccacuaaucuacuuucugccucuauacacuuuccuguucugggcauguuacagaaacggaaucauggagucuuuugugacuggcuucuuucauuuagcgugauguuugcaauauucauccauguuguagccugugucaguacuucauuccuuccaauugucuaguaauaugcuacuguauggauagaccacauguaucucuucaccagaugauggacauuuagauuguuuccacuuuggggcuuuuaugaagaaugcugauauuaacauucguguauaaguuuugguguguauauauguuuucauuucucuuggaguagaaucgcugggucauaugguaacuauguuuaaccuuuugagaaacugccaaacuguuuuccaaacaggcugcaucaauuuacauucccaccagcaguauacgaggguuucaguuuuccauguccuugacacuacauuugucuugauuauagacacccuguggguaugaagugguaucucauugugauuuugauuugcauuucccuaaugauuagugauauugagcauuuuuccauguacguuuauauaucuucuuuggagaaauaucuauucagguccuuugcccauuuuuuggaucauuugucuuuauuauugaguuguaagagcucuuuauauauuauagauacaagucuuuuaugagauuuaugcuugcaaauaauuucuccauucuguggguugucuuuucucuuucuugauggguuuuuuuaggcuagaaaagugaaacagugagaguggagaaggaacaaagaaaucuggaacugcuugugaucaauuaguuguaaacaccccugcacucagaucagccucuugauauucuuugaagcacaaaaguuuuugguuuugaugaaguguaauucauauacuuuauuucuuuuguuguuuauuuuuuuuggcaucauauucacgaaagcuuugccuaauccaaaauucugggauuacagcagugagccacugcgcugggccugaguucucaauuuuauucuguuugucuauaugucuguccuugcaccacuaccacaauauuuugcuuucuguaacuuuguaguaaguuuugaaauaaggaaaugugaguucucuaaauuuguuucuguuuuuuuuuucaauauugcuuuagcuauucugggucccuugaauuucuauacgaauuuuaggauuagccugucaauuucugcaaagaagccagcaagauuuugauagggauuauauugaauguauagaucaauuuggagcauauucccaguauaauaaugucaagucuucugauccaugaacauguaauucuuuccauuuauuuaugucuucuuucauuuuuuuucaacagugccuuaugguuuuccagguuuugcacuuaaacaauuucuuuaaaagcauuuuauucacuuugcugcuacuguaaauggaaauguuuucuuaauuucacuuucaaauuuuucauugcugguguauguccacuccuuaggggacacauuuugagcccuguuaauuuccuuuucugugugcuuuugagcauuugaaagacuuuuaaguguuauuucucaauggcacaucugccugauugugagcuuuuuaaaaagcccaauucuauggcauuuuugucauaaucccaccuuuggcagagccuugaccuuggacagucucaugcccucugcagaguccugcugccuagaccuuaagaucauaaagccauucuaauuuauagugcauacacucaguggaacauuauacagucauuaaagcuguuuauggagacuacacuaacacagggaaauaauuaugauauaauguuacacagaaaauggacuacaaauguaugauuuccauuauuuuuggcagaugcaucauuaggaaaauuaaaauccgggcggggcgcaguggcucacgccuguaaucccagcacuuugggaggccgaggcagguggaucaccaggucaggagaucgagaccauccuggcuaacacggugaaaccccgucucuacuaaaaaauacaaaaaauuagccgggcgugguggugggcgccuguagucccagcuacuugggagguugaggcaggagaauggcgugaucccgggaggcggagcuugcagugagccaagauugcgccacugcacuccagccugggugacagagcuagacuccgucucaggaaaaaaaaaaaaaaaaaaagaaaauuaaaauccagaaaggcugggcucggcggcucacaccucuaguccuagcacuuugggaggcugaggcagguggaucgcuugagcuuaggaguucgagacuagucugggcaacguggcaaaaccccaucucuccaaaaaauacaaaaauuagccaggcauagugacaugcaccuguaguuccagcuacuuagcagacugaggugggaagauuguuugaggcugcagugggccauaaucaugccacugcacucaagccugggcaacagagcgagacccugucucaaaaaaccaaauaaauaaauaaauugcagaaaaaaauauuaggaggaaaaugcaaauaucagaagcuucuggaggagguagguagaucuuuaaaacuucauuauaggccgggugccguggcucacacguguaauccccgcacuuugggaggccaaggcggguggaucacuugaggugaggaguucaagaccagcauagccaacaugcugaaaccccgucucaacuaaaaauacaaaaauuagcugggcaugguagcauacgccuguaaucccagcuccucaggaggcuagggcaggagaauugcuugaauccagagggcagagguugcagugagccgagaucgcgccaguguacucuagccugggcaacagagcaagacuccgucuccaaaaaaaaaaaaaaaaacuucauucuaacauauauauguuuuccaaauuguauauauauggguauagauguggaaaagaauaauuaugacagaaagccaggugaaaaaagucaaguuuagaaugguccagccaagcacgagauucgugugcugaaggcuauucagcagguggaauauccauuucuuuaguguuggauauuuauuauuauauauuauauguugaaaaccaguccagauggcucauaucuguaaucccagcacuuugggaggucaaagcaggaggauugcuugggccuaggaguuugagacuagccugggcaacauagggagacccugucucuacccaaaaaaaaaaaaaaaagccaggcgugguggugcggugcacaccuguagugggaggaucacuugagccugagaggucuaggcugcaaugagcugugauugugccacugcacucuaaucugggcgacagagugagaucuugucaaaaaaaaaaaaaaaagaaaaggaaaaccagaaggauauacuuuggaauguugauaguauuuaucccuaggugauagacuacgggagauuuguuugauuguuuacuuuucugcauuuucuaaauugucuacagugggcccuuuuguaguaagaaaagaaauguuuuaaaaauuuugaaagguuugaaaaccagcaaauagaaaaagaccccuuaacauuuuccucugaagaggccacugaaacauggauguguaguaagucaggccugcagggagcuguggcuauagguggcuucagcuggagccauccauggcucuggcugggaccuugguagguuccaggguuccuggguucuuuccuuacuucuugcccagcuggauucacuccugcuugcgaaaagcugacaaaaacaaggacaacaagaugagcuucaaggagcugcagaacuuccugaaggagcucaacauccagguggacgacagcuaugcccggaagaucuucagggugaggcaggaagugggggcuggggcugccuguccauggggcccuugaccccggcccaaggccugcucugagcccacucggcuguccuggcucugcaggagugugaccacucccagacagacucccuggaggacgaggagauugaggccuucuacaagaugcugacccagcggguggagaucgaccgcaccuucgccgaggccgcgggcucaggggagacucugucgguggaucaguuagugacguuccugcagcaccagcagcgggaggaggcggcagggccugcgcuggcccucucccucauugagcgcuacgagcccagcgagacuggugagagccugaccagggccugcuaccugcagucgcagggccgcacugggcugggagaccccuggggagacugcagccagaaagaagggaaccggagggaaggggcugccucagccagccccggggcccugcuccacacuuucugguccuaugaaagccggcagaugagagacagggcucuggcaucccuacccuucucugguccuguuucccucuuggcaccuccuucagggggcuuugaggaccccuucuucaagaaacaagagagauggcugaaaagcagaugcuacuccugcuucuuuuuuuuuuacucauucuuggcccagcuuugagaugugauagagcagagaagaugggucccugcccuggagggggcuccagucuggagguacagagaacggggagaugacacccuguccucaggggucuuagagugugcagacaggggaggaggaggagacagggccccacucuggaguagccacagucuggucgagagccucagacuuauccuaauuccaagagcucuggaagacuggcucaggacaggcaggcaagcggguucagagggcuccucuguccagaugggugggcagccaggagcgccugcuggaggcuggcucugacgggcaguggccuccucccucccagccaaggcgcagcggcagaugaccaaggacggcuuccucauguacuuacugucggcugacggcagcgccuucagccuggcacaccgccgugucuaccaggacaugggccagccacuuagccacuaccugguguccucuucacacaacaccuaccugcuggaggaccagcuagccgggcccagcagcacugaagccuacauccggugcugcucagggagccuugggucgggagucugggugggacccgggacaggaccuggaggguccuagccaccacccuccccgcagggcacugugcaaaggcugccgaugccuggagcuugacugcugggacgggcccaaccaggaaccaaucaucuaccacggcuauacuuucacuuccaagauccucuucugcgaugugcucagggccauccgggacuaugccuucaaggugggagugccccuggcaggugaggagugggaugcuagggguggcccaccacuccuaaugugcccuugggccuccaggcgucccccuacccugucauccuaucccuggagaaccacugcacacuggagcagcagcgcgugauggcgcggcaccugcaugccauccugggccccaugcuguugaaccgaccacuggauggggucaccaacagccugcccuccccugaggugugugguggggaugggggaucccugggggaggguggggagccuagccggggcgcuaggugugucuugaccaguugccccuccccaccuagcaacugaaggggaagauccugcugaaggggaagaagcucggggggcuccugcccccuggaggggaggguggcccugaggccacuguggugucagacgaagacgaggcugcugagauggaggaugaggcagugaggagccgugugcagcacaagcccaagguuugagggggagcugugggguggggcagcccgggccuuccccauccccucacccgugggaggucugccuugucucaguucucuguggcugccacucagacccucugccccgcucucucugucugucucccucugucucucugcgccuggguuucuggcuuucucagugccuacccuaccccaaccacugaaucuaacccgggccuccccguguuccccaggaggacaagcucaggcuagcacaggagcucucugacauggucauuuacugcaagaguguccacuuugggggcuucuccaguccuggcaccccuggacaggccuucuacgagauggcguccuucucugagaaccgugcccuucgacugcuccaagaaucaggugaggccuggcuccccaccacuccccugcucuguuacagagagaauuggcagggcagggcuugggccucaccaggaggccuccacugcugaccgaaccacaccuccccucaggaaacggcuuuguccgccacaacguggggcaccugagcagaaucuacccggcuggauggagaacagacuccuccaacuacagccccguggagauguggaaugggggcugccagaucgguaugggcuggcuggggcuggaggaggccuggaggaggguuucagucccaaggccgggggccuggagccucgaaggccaugcaguggagcucugaggacccaagcagggucaaaugcaggggcuuguggagcugguaauaucagucuggaaauaucugcccaccagcaugucacagugucugaaaccucauuagcacacuaguccuuugaauucucacaccaggaauggaaggugugguuagcauggugggucacugaggguggcaggagggcagcaggcauuggagugaugcugggcccugcuaacucaccaugugacccuaggccuuaguguacccugagcaggcugugcucuagggccccagggccagcccacagccugugacugcucuguccugccuguaguggcccugaauuuccagacaccugggccagagauggacguguaccagggccgcuuccaggacaacggggccuguggguacgugcugaagcccgccuuccugcgagaccccaacggcaccuuuaacccccgcgcccuggcucaggggcccuggugggcacggaagcggcucaacaucaggguacgcuggaccuaggagggacaggugcccacggaccucccuuccccgcuaccacuccugaacuguccauuguccucugccuuuccucaggucauuucggggcagcagcugccaaaagucaacaagaauaagaauucaauuguggaccccaaagugacaguggagauccauggcgugagccgggacguggccagccgccagacugcugucaucaccaacaaugguaggugcugggccugggcugggcuacuagggcugguguccaugcugcugauauggugccugucccccuagguuucaacccauggugggacacggaguuugcguuugagguaguugugccugaccuugcccucauccgcuucuugguggaagauuaugaugccuccuccaagaaugacuucauuggccagaguaccauccccuugaacagccucaagcaaggugagugucaagagaaggggauggccaagguggugggaagcagggccuggcgucucuugggcuggggcuggcugucccuugacgcauccacccccccuccgccgccgaaugaccagaacucucucuguguucccuccugccuguccacccaccaggauaccgccauguccaccucaugucuaagaacggggaccagcauccaucagccacccucuuugugaagaucucccuccaggacuaggcuggaggaagccagugggguccccccugagugggcugggcccucuguccacauguggggacagggcugguguggcugcucccagccucuugcucagagcuaggcccccaaauugccuucagcccuaacauagugucugcugcugccucccuggggaccaggagcuagcccagucccuggagcuguccuucauuccguuaggaauaacacugcagcccucuccacccuccggccagcgaguggucaaggauuuuuauaaaaaucacgauaagauuaag

SEQ ID NO: 16167 - RNA, 5910 nt, Homo sapiens
cagaaccacaucucagccuccaaggccucaacuccgcccacagcucugcgaacagacgcgagcgacccuccaaaagucccguccaccuccagccucagccaaccacaaggagagucggccugggaacccgccccuccccgccaccgccuaccaagcccucuauaggagggcccacaggcaccgcccagccgagcuuuccacucaaugccccgccuaccuuggccuaccgcagccaaccagaagguguaucuuuacgaauccccgcccagaaaugcagaccggaagucuuuccaccuuuuguagccaaacccgagaccugacccccaaaucccugucuccugcccgcagccaaacggaaggcugggcagccaggaccgcuuacugcuugggggcuggagauggaagccgaggcucuaauuccucuacccacuuccuaggaggcucugcuaucccuccggucccaguacccgagcugggggaccuaaauacuuccgagacgcccgaguccugcuccgacgugguugggcuuucccauucuuucgagaagacagggaauuugggcuuccgggcuggccgggagaacagauuuuacagacaugcggggugugacaagcucucuaacuggagaaugaacauuucacacuuuuaccaguuuuacacccaauuggaaugauuuuauuagugcccauuucccgugcuaggcuggggucuccaccaaggcagagagguaccauguauccggggagccugcgacacccuugacacuuaguagaugaucaauaaguacuugucgaaugaguaaaugaaugaaccagggcuccccaggucaggacugugucccuaaaccuaaagggcaaggccacgugcccccuugacucccaauagcagggccaugucuucaccugagacccuggagaguagugcugggcuuuccacagacaccaaaggacagggugccuugugcuccccaaccuagugucaugacguccccaaccauuucgagggcagggccacggcaugccucaggcuccagaaggcagcuguccguuucccacucccaccucggggagcacagcaggggucuucccauaccccuacuggcaggauugcguguuccccagagacaguggagggcagagcuggugccuucccacuuguccccuccucgccauccucgagggcaggaccguaugaaccccucagauuccuccguggaagaacuguggcuccaccagaucccaaaaagcaaggcccguuuccuacaacccccgaaggagggucguccucacuccgccgccaaccuacuagcaccaucaccagacccucgagggcggugccguggaccucuccagaucucaaaaggcagauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauuggugaggacguccccuuccuggccucguaccuggggggugaggaggcugacuuuccgcggccucagcauccugucucccauggagagaccccauuuccugccucgggggcccgaagaagccugcagagggagaaccaugcgggucccguuccuucuuaauaaccggucgcgguuauuaagaaggacuggagaaagguccggauaggcggagaugggaaggaagcagcuuaggcagaggcuuucagguagggccaggagucagaaucaggcuucugugggggcaucugggcuguuucaaguagagcaacaggacagguggggcgauugacaguggacugucuuagaaaccucaaguccuggggaaaugcagcccuucuuucuacucacuggcacuuacauaauauacaugcauaggcguuggauacagccgcccacagacaggcacaccuugcugaguuggaaucacugcaccauaaccagugggucuccugagccuuucuggcaugcccagccccuugcucacaucugcccuggaucccagaagaagcagaccuaccuugguaccauucuuaggaucccuaggaagggacagagauacaaaccugacuuugauggccuuccagaaagccagaacaccacugacaucccuuugggucaguuagagccagugggagcucaacuucucagagccguugagcuucgcguggcaccagugaacuggggaagcccucuagaacaacccagccagaggaggugggacagcggcuggauccugacuguggguaaagagguaggcacucccagggaggcugcuuuacucugucucuuccccacagaggaggauugccaaaaguauaucuugaagcagcagcaggaggaggcugagaagccuuuacagguggccgcuguagacagcagugucccacggacagcagagcuggcgggcaucaccacacuugaugacccccuggguaaggguccaauacuguucccaugggacagguggaauaggacauugugguguuaagagcauggguguuugaagcagaugggcugugagaccuugggcaagucacuuaaucuuucugagccucaguuuccucaccuaagaaauggagauaauaguccuaccucuggauugcugugagaugcucaugaaauaaugucugucucgugguuaauccagagcuuagccccugagguacucaucuuuccucuccuggaaagggcacuuucucugaggaguaucaucuugggaagggugcagggcccaggguugccuaggcaggggacucuuggcuggaucccucccaagccuucccauggagcucugaccaccacccuugugcucugcacccagggcauaugccugagcguuucgaugccuucaucugcuauugccccagcgacauccaguuugugcaggagaugauccggcaacuggaacagacaaacuaucgacugaaguugugugugucugaccgcgauguccugccuggcaccugugucuggucuauugcuagugagcucaucgaaaagagguuggcuagaaggccacggggugggugcguggaugcaugaagcccugcccugggguccagauacugggcaucuccuccuagcugugcacuguccagccugggcacagugggcccuuccugaagcuauucccaggggauaugcugaacuaaguugccacaggaccugcagccugcccacucuccccuaggugccgccggaugguggugguugucucugaugauuaccugcagagcaaggaaugugacuuccagaccaaauuugcacucagccucucuccagguaagcucaacccugcucuggcaagagaaugagggaauguguagguggggccucuggauugucagccuucccuccccaaggacuguggaugcaguaccaaagaacugcugaagaucucugcacaccugagcaugugugcaugugugugccuuuuugugugagugaaugugugccagggguacuuagaugggggauggcuguuguuaacccugggguugaagacugggcuugucccaccauggggcaagggccugaugccagcauggcaccccuuggcuugcaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaac

SEQ ID NO: 16168 - RNA, 12379 nt, Homo sapiens
uggcgucgggucgguccggguaggcgcagcgggacuggaccugggugccgagcggagccgcugccaugggccugggcgucagcgcugagcagcccgcaggcggcgccgagggcuuccaccuccacggggugaguugccgccgcggcgccggugaccuuggcgaggcgcccgcaaccccgcgcccgggcguccggucgccggcuggcuggcgacugcggcggggucccggcccgaguguuuccgccuggguggcgggaggugcccccugcccggugggagccuccugggagaggcggccucgcgggacucccggacccuggcuaguccgcggccgcggucgggcccagcgcccgccccaagugccagcagugccggaagcggagcguuuuccugguccggccgccgggaauggcgcuccucccgggugaagaaugcaccacuaccagucgggacgcacucgugcacuuagcacacauuuacgcucgccugccgcgggccgcucuccgugcugggccugggaagagagucagccacgccgaggacagucccgggggccgggguuaaccgaguggacgcagcugcgggggagcccgucggcgcgcguccugccagucguagggucguaagggcuuccgaggguagaggaccggugcaaaccagccacgggauaguggggagcgggagggccgggagagugcugcagaauccucgaggagagcguuugcagcuggggagggucccagccuuuagaugccgcuacauggaggucugggcgagcaggcuuccggagaguggagacggagugggguuccuagaacggagugugcugugagggugaggagagggucccgcagccggauggagauuugugccugcggugagggaagggcuauaauguaggugagaggggcugggggucucugaccccggagcgcugcggggaagaggcgucccugcacccccccuuucccuagugaaaggcagcuggaugcagagaugaguggagacaggcaagcuugucgguuuguguguuuugaagguagggucuguugccagcuaaccacaugagagggcuaaaaguuucuuaacgugaaaaccaggcuggcuuggagaacccagaguugacaggauuugugcuugggaaugggcuuucuuauggugagacaccaaacagcaagcguggacaguggaaugcauccagccaggagcgucuuccaacagguuugauuaaaggcaaaggaacucaggauauuggcaagaggagggguggggcgaugaugggagcuucgaagacgggaggggccugccugauggagagggacaaauuggagagggaccagggaucagagguugucagucacaaaaacaaaguuuugagcuccuacucuggcaggcagaauucuaaggcucuagagauaaagcagugaacagaacaaacauggucccuguucuggagcugacauuuggaugaugguagggaaagaagggaaaugaaaaaauacaugguaggugguaauuaccagugauaaaaauaaagcagguuaaggggauacagaauggugagugggugcuauuuuugauagaguggucaggaagggccucuucucaagucacauucgaacagaugcuucugaaggaaguaaagaguggacaauacagauauuuaggggaauaguaguauuccaggcagaaggaccagcuugugcagaggccccgagguagguugugcuuguguguuugaggaaaugccaggugaggcuggugugcuuggaugguguggccagugugaggaggagaccagagcagaccguguaggaccuugccuguuguccugaagauuuaagauuuuauucugagauguaaaaccaucaggagguuuuaaauggaggagugacaugaccuacuuaccuuuaacaacacugaagaacagcugugcugcauucuagaaauauuggcaccucgcugcgugcccaauacuuuggagaagucgcugcccucagcgagcuuagaguaguggcagauucaccaggaaacagcuguuaggagagggcagugguuagggggagggcucuggguuggauuuccuggggucaaauuacugaauuauugaguacuuggucucauuugucauuugagguuauuaaaaagguuaaaugacacauaaagcaggugagguggugccaugcccuggcacucagccaaccagcccuuaguaaguguaaguugugaucacugugaguuccauuagguucccugauugggaaaaauagggugggagcaugaggaaaagcagcacuauagggccuuggggcaggcugugaugggagccccugagggagcuggauggcaggcagugguuucugcagggggagccguacagugggcagcagcauagauuauuucagcugcggagccauagugaguagugaugaggccccaggugagagaaguggaguguagccaagcagaggacaaagccacaggagagggugguggagguauugggugggucaaggaggccaggccuggggccugacccucuggaccucauucaugauggagagcagcugacaugcaauacuggggaguggggagggaaguaggcaggcaccugacguggagugauuuggagguggcccugauuagggaggggcauuguccccaagcuauuccugaauaacuguccuguccugugguuuucgaaagauccccucaccugaaggguuagagggcagggcccagagcuccccugcagcggggccugggagcagcuugccuacugggccaggccaacuaggcccagaucugauuucugggccgcacucacucccuuuggaagccauggcagcuucuggaggugauaaggaggggcucaguuggugaugcugccagaagggaauccuaauuccaggggcaaacuggccuugaucucagcgguuuguucucagccuagucuucaugagcucuccuucagguuggggaauccaaaccuggaggggcugguauguagcaggagccacagggccuuucccaugaggaggcagcaagagccuagguccugugcccucugggcugggucuggcuggugucuacgccaacagguuaucaaaugcccgcagccaaagaccugagggugugggcccaucuucgggucuagggccuugggacaaagccugcauuguuuaagccaggcucuguauauggggcuuuugggauggauuucugccacagccugcaaagccugguuguugugcuuuuggagacagcagugagguggggaguucagggaggggcagggagcacccuggaaaugggaaugcuuccuggaggagguguccugcacaggcauggaggcuacacuaugaggcugguagggcagcugagccacuggggggcuccucaguccagagccaggcuguggggauuggcacugcccacucacugggcucccuggcucaggccuaguucuaccccuggggucugcuucucugccaguggcuuucauuaccugcuggacugagccugggucucccaccccagaggcuggggugcaagcugggaccuggcugcaagcugcuuuucccacucccucuuucuggguacagcccuggguguaucccucccgaggccugcccacuuccacugcacgucagggcccucccuucugguccagucuaaaccuuucugguaaacccuuuuggcuuuccggccaacccuagccuagcccucuagagcagcauucccacaggccugggccagccugucuccauauugccuccugggagccccuaaggauguccugggcugugagccauuucugaaagcaucuguggaucauaaucaggaaggagccauuuuccuaagaggaaaauuugugcccaggaagguagcaagaggccauggagugaacccugagaauguccggaacaguucaugccagacauguguucuggcuggcacacugggagugcugaugguuccugaaaugggggagagggcuacuuggagagucccaggguuggcgcagugacuguggucuuugcugugggauaggugcaggagaacuccccagcccagcaggcgggccuggagcccuacuuugacuucaucaucaccauugggcacucgaggcuggugaguuccccaaccugccucugcuuugcuugcuuauguguguuugugugucuucaucugucccacagggggccccagucuacccuucccucccuuuuuuucuaaagggagucccagcccugucuccccuucuuccagggcuguacucagagccugacuggggcccugcccagugcucagcuucugagcucugugggguggacagaggacauauggccucuuggagguggcaacaaggcccaaggggccugccuccuggggcaugagggauaugagggcccuggccaaggggcagcucagaguggggcagcacuggaaugcuguggaucugggaggcuuuuugcuugcuuuguuuuuucuggcaggcugaggaagguuuggcagugcuuggggaaggugggggucccaguggcugcaggcucaacccuggucugugaaccuggcccauccacuaccuuggcccauccccacagugacccugcugagggcugcugcccacuaaggcccuugccccaucucaggcccagacuugucugaggguccuagccugggcaugagguggccuuggagucagccccauugcccccacagaacaaggagaaugacacccugaaggcacuacugaaagccaauguggagaagcccgugaagcuggagguguucaauaugaagaccaugagggugcgcgagguggagguggugcccagcaacauguggggcggccagggccuacugggugccagugugcgcuucugcagcuuccgcagggccagugagcagguguggcaugugcuggugagugugggguauggcagggcagggugugucggaaggaugaguuuacuggggcaggucugggugugggcggggugugaggggguacaugcaggaguggagugggagccuuggagcaguggccagggaagacugagggcaggauguggucucauuccagugucccagagagggcagcucauuacuaccugaacaguguaucuugcuuccuguuagccaugacuuuggguacuuucuuaccuucuauaccuagguuacuuaauuugaaagguagaaauaucaucuacuggaauggugguuggacugcuggaaugcugcugcuuuuauuauucucugugucucuccguguguguguugcaugacaacguuucagucaaccacggacugcauauacaauagugaucccauaagauuauaauaccauauuuuuacuguaccuguucuaugccugaauguuuagacacacagauacuuaauuguguuacaguugccuacaguacucaguauaguaacaugcugugcagguuuguagccuaggagcaacaggccauagcauauacuccaggugucuaguaggcuauguguagguuaaguucuaugauguuugcacaacaaugaagucaacuaacaaugcauuucucagaauauaucccugucauuaagcaaugugacuguaaauauacuguuuuuucugguauauucuuauaugauuaaucgauaucuuaaccucagugaccaagcugucauagauguuagucuguccacagacacacaugcacacccaacaccugugcccauugaugguaucuaaguucuugaaugcucaguccuguagccugguggaaggagggugcucugaacuagaaguuggcugauuuguuuucuagccacuuauuuuucucacugacuucuugggagagccuggccaaguuucucaacuuucacagccugccuuaaucugcccaugagggaaaggggacugaugaugcaaauugcuuugcauuucccagggagacugggagauugggagugguggaacuuuccaagggagaagggaauccuuauuuguacccaguuuugcucauugcccucaccuccaaccccuaggagucuuuagccacaugccugcagcagaagcagcaauguagugggugcuccuguagccaaggugugcuuuucuucuuuucauauauuuauuuauuuuucucagcaacccuaucauuagguacuguguaucuuacuuuuaauuguggggaaacugaggcuaggagagguucaauaauguguuuauagucauauagcugggcagcuggagccagggguugagcccggggucagauuccagagccuggugcugagccuuaucaugguacugcccucugcuggacaggcuguagaccugggggagauaggggaauggaggggugaaaugagggaguaugggcuugaagcccugcuuagggauagaggacaagugucccacucacuaccucaagaggcaguucccccugcccuuucccaucccccaaccccaccucuaguagcauggccagugguuugcgguucuuuccccaggauguggaaccaucuucaccugcugcccuugccggccugcgccccuacacagacuaugugguugguucggaccagauucuccaggaggugaggaacccgcaauuugccccuccccagacccucuggauguggugugaagagaagggugcuguccaugagaagugucugguuuuguugaggcuuuagcccuggaagcaggccucaggugcuaugcguuucucacaguccgaggacuucuuuacgcucaucgagucucaugaggggaagcccuugaagcugaugguguauaacuccaagucagacuccugccgggaggugacuguaacucccaacgcagccugggguggagagggcagguacuucgugggguuggagggcugcagggccagguggguggggccugaccauugggcauggaccucagaguucuaugguggagauggaggaggguugggcccugggcccagggauccugaggcugaccgguauuucagaaguacccuuuucagcccccuuauugcugguaguagguggggauagcaaagguagggagggccgugggacaagccccuggauugaauguuucuggccuucggcagucugggauguggcauuggcuauggguaucuacaccggaucccaacucagccccccagcuaccacaagaagccaccuggcaccccaccaccuucugcucuaccacuuggugccccaccaccugaugcucuaccaccuggacccacccccgaggacucuccuucccuggagacagguuccaggcagagugacuacauggagguauguggggagaaucugccaacugggaagacagaaaacucuagaggcugcccuuggggagccaucagcaacccucaccaggggccuuugugaucugagaggcccauguacuucugggacccagugggagcaggcaggccaugccuggagcagugaaacucacuuuuggcuuuccugccccuugggucuagaagugaggguggaggugaagcaccaguugucaucuucauuucaugagugggaaacugaggcucagagaugggugcuugcugugccugugaguuguggcaaaacuggacaaagggcuaggccuucagagccacaguugggaugguugucuagccaagucugcagggaagugcuggcccugccuucacagcugaugaguggguccucugagagcaccuuugggcacugggcuggugccuugggucuaggccagggaguauucaaggauguucuccagguaugccugaauucaaggaagccccucucuucuaaugagucauugauggggcaaagggaauguguuggggccaggugggcaccugggauuccuugucugagugcaaagagugcucccucucagugccaacacugcagggaggccaggccaggccccucaggccugacuuccuaucaccaauagaagaaggggugguuuauuaaggccauuuccuuccuuuaggcagagcaguguuccugggacaaguggggacuggugguuagguuggacugcaaaauucuucaccuugaggcacuguccugauuguccccuacccauuucuucuucuuuccuaggcccugcugcaggcaccuggcuccuccauggaggauccccuuccugggccugggagucccagccacagugcuccagacccugauggacuuccccauuucauggagacuccucuucagcccccaccuccagugcagcgaguuauggacccagguacugggcaggcccuggagaggagugggccccaggcuuggggcuggacuuuggcagcuaugucaaaacuuuccccaggccuugcugaccccucauaucucauguauaccaagauauuuaauaguugcauaucauccaaucuaguauacagauggggagucuguaguccagagaagagagguagccuccuucaggucacacagcaaauuggacacagagcagagucuaugccuacugccacugugcuauucacaugaugaccaacuccaggccccuuucuuuccucagaaacaggcagugugggaaccucuuugagguugggugagggguaucaccaggggcugaggagauuacagucucacaggcugggccagaugcccuaggcaaggugagcccagggugcugcuuuccagcagucaggguuucuugcuggcaaagaacugcaccacccuccccuaggcuuccuggacgugucgggaauuucucucuuggacaacagcaaugccaguguguggcccagccugcccucuuccacagaacugaccaccacagcugucucaaccucagggccagaggacaucugcuccagcagcaguucucaugagcgggguggugaguggccaucaccuuccgaaguccucugggaaggaccccggguuguugggaaggcugcccucaauuccucagcugggcagaagugggccaucggguugauacagccacaccaaggcauuuguacacuccaucuccaaucccccaucaaaccuggaguggcaauggggagcggucggugggguuacuggcccuaacaccauggcccuagguucuugcagaccuccucagccugaucuucuguguugcaggugaggcuacauggucugggucagaguuugaggucuccuuccuggacagcccaggugcccaagcccaggcggaccaccugccucagcugacucuuccugacagucucaccucugcagccucaccagaagaugggcuguccgccgagcugcuugaagcucaggcugaggaggaaccagcaagcacagagggccuagauacugggacggaggcugaggggcuggacagccaggcccagaucucuaccacagaauaacacccugggcugugacaaggcccaugaugacauuucaugaggcccagaugugggcaggcagcccgggcugcacuaugcggucaggauuccuugcugcuuuggugggacaugaggccucaguggguggugagagggggccaugggccuugugggaggauaucuuuuggccguguacccucagguccagugcuugguccugcucuggucacuggggcuucccaggaggcagcagggucuggucauaauccagugugaagaugaggugaggaaggaagggguugcuguccaguguuggccuggucgcuuugauucuuccugcacagcucagcccaccccaucuguacuggaagggacccuggagcccugggaccacccccuuucaagucccaaacacugaguccucugucauguguccuugucccuaggcuacaaugcuacacuuggcucaggcugaucaccaugcuagucacaggagggagagagaggcaguguacuugcccccaucuccuggagggaggugcguuggaaauucuaggcccuucagcagagacccauuugugcccagaccacaauauuucuucuuccucagggacuacaugccacagaccuguauccccaguggcaacuccuguuagcucccaaacuuaaacagugaucucuucuaaauauacaaggcaucuacccagccccaauagugaauaaaagucacaaauuuaaguucaacacccuaagcaauuucucaaagccagucuaccugacuaggucuauccacgcacgguucccaaccccaagggggaauuaggggauuagauuaagaguagguaaagacccuuuuguucuuuccuguuguaggggaggaagcuguucuccccaccccaggugccuuuggagguuaaggcuagguuaggcccugcacuccaccuggggacggccccucaucaccugaaguccucugcuguguugacuggacccucaguucccacacugcuaauuacuaugaaagcugcucuggccucgucuucuagcuugugccuaguugaaagucucaccuuuacaggaucauuuguaaugcugguguacaugcagggaacucacaagcugugucagguaugcaggacaaggaaugucugcucuggggggcacaggccaacuauauggagggagggucccaaauuagcaaacccuucauuuaaagcaaacccuugucaagccuaccagagcagcugauacgugugcauaacagugaggcauuguguccuggaucgucugggagcccagugucaagucugcuggaaugcaggaaguagaacagaaucgccacaggacuguucuggggccagcuucccuuaacucuguagccuggcagucugacccaaaguugcccucacccaaagguucuggcucuucccucccucacuuuuacuuucccuucccccauaaguuggaggauaaaauggguaucaaugcuaauauuuccagggagaacaugaaaccagagguuucuuucuuucucuguaaucugcuaugaaagaaaauaacaaaugaaaauaaauguguacuacacuuugaaauauuuuaacuaaagccuuuauucuauacaacugugaaauacagauuuuuacccuuuuggcauugcagacugucgaauuuucuggaaacuguauuacgguuugacuggaggggaaagaaauacaaucaugcugggggucagaucuaugacaggaggggaaugcagccacccaaggcuuagcacacagggcaaaaugacccagcaaaacccauuucuuugcucaaaggccccucgggcaaacacaacugagggcugguaaauaauuuuuuuuuucuuugccauuaauucacaacuauugcuaaaaaaugugcaccaaaagcacacuguuguauccaacagauagaaaggacuuuuaaaaaaaaagaagcugguugcucucugaggaagggagaaagaccauuucaacuuauuagaaauguggccacgucuuugcucacuucuucaaagugcagguggcaauggccuguccaguuuccaaaagaagcugacuagcagugagggaacccugucucugcaguugugcgaucagaguaucuuaaauaguaagguauggccuuaggccuaucagcugcccccagccgaaccugugaagauguagaaaagaaaaaacguucccugccucccucccuagucccugcuaugguggaggcaggccacacacaagcuagggaggcaacuggacuggaaucaacugcccucugaaggcacuugugcuucuggcuucauacaggaggcuugucuuacaguuuuauggggguggaccacugauuuacucugaauacaaaugaccuuggggagaauccaaaguauuuucugccaaaaguugaaguguuuauccccaauaaguuacacucuauacaagauccaaaugauucuaugaaaguguuagauuguuagaacagugaaaagaagaucuggauacagguacaacaaaaaccugcauauaaaacuuuggaaaaacaaauauguauacuuccaggauaugaauaucaaauuaacucacuaugaucucccuuuauucugacaccauaaauuuuagguaacauuugaaugaaacugaaauuucaucauggucuuaaauuuugauggugucaugcugcucauccagagcaagaaccuguggucucagcucgcuuuguguaaauaaaacuggacacaguggaggaaggagugaaacugcugcaccucccugggguugccacaaagccaggacaucaugggaggugcagcaucgcuaggcaugggcugcacaaacuccggcccaacaguccaagugcuaugauccagcaccuggaauuucaacagaucuuccuacaagaacacaucugagaugcaauauuaacaacaagcccaacauuaaucuuuuauuaugaaaugggcugguucucaaauugugcaacagcaaauucccauuaaaaauaacugucuuaaacgguga

SEQ ID NO: 16169 - RNA, 12825 nt, Homo sapiens
augcagcgggagcaggacugggagggggagggucaggcucccacgaaggcucccuggaggaggcagugcaagcugagcccuuaaaggcauugggauucugguaagcagagagagggcaggagagcauuccagucgagaagaccggcugcaguaaaagcgugaggguggaaacgcucgaggugaugaguagacucguaccugcgguugggaaguggggcugagggugggcucccaggccaggacuugguugccggggcaugucguaccgggaggguuggccccgagucaggaaaggccuuggcgggagcagagaaggcaguggaccauuuuaaguggccaagaucuggcccggaagaaaccagccuuuuuauuuuuuuaagggaagguugaggugggaguggggaagcuaguucuaagaaccccuaguuuggaacuucugcagggaagggucucuuggcccgugggcaggaaugaaguucaggcccacugauuacauccauccuucccgcucccugccuccccgcuccccacacaccccagauuccucuccagccacaguuuacuuuuccggcggaucugggggugggugguagguugggggcggaggggggaacuuuuagauuggaauaaaauaaacucccucuagagggguggggguggagagcguacaggagacgucggcucugccacugucuagcccguggccuugcggaguuacgaggugcucccggccucggucuacccaucuguaaacuggggcgguggggcgagguggggaucucuacgcucggcucugccggcuugagucguccgcgccuuuagggaccgugcuggaagcggggcggggagggcgcuggcgggagagggcugggggcggagagcggcggaggcgcagucgccgggucacaguccgcagggaggcccccaggccgcugcgccaggcuccaggcgggggaggaggcggcgccuccggggcggggcugccgggcggccuggcuggaggcccggcgugcgucagcgcagugagccccggaguuuuccacugacgaggagggcggagcggcgggcggggcugggcgcaggcagucucccgccgccgccgccgcugccggacgcgcagagcgaggggcggcuggaccgacggcugccgggccgagcgcacagagucgcggcgcagggggcguccccggccgggacgcgggucgcgucguuguccuccgcgagcguccggauugcaggugagcgccgaggggccucgggcccggcaggacgggacuuuggggagggggcauucagcgcgaguggcacugccgcuccugccuccugccguucacuccccggcacccugagcgggcgcgggggcuggagcugcccggcucugacggcgugccgcggccggagucgggggccgggggcccggccggcgggagucgcagguuuucugcuccccucccccgcccgccgcgguaaccccgagagaagucacggcuccccgagcucggcgcgaguggggacagagccgggcuugcgcgcgagcggcgaggcgacgggggcgugcguccgcgggugaguuuccuuuugacccaguugccugagaacuuuucagaaguuccucgcguggccggagcaggugacauuugucgccuuccuccucgggcuccccccucggggaggcugcgggagcugcggcgugugccgggcgcccccggccggcgggggucagggagggaguggagggaugagcguagagggaggcgcggugagucacggaccccgggagggagggauugugucguaggcucaccuguuugucagucgccgucacucucagaggccacugcugugagucacgggcucagcuacaccggccacccgcaggcacacguagacucucucccacgcacuucuccuccuuccgcagcacguacuuccuccccuuccucaguuucuccuccccggggcccauucacaggcacgcacuguggagaugcccacaccacagccauagucacacacuuagucacucccgcucccggcacaaacacacacagccguagcccacacuccugacaccagaggguuccuccccgucuccugcugcccacccagcaccuccacccagaagucucaagccuuuuggagaguagcucgucaccucccccgauccaaauccuugacagcccugcccucuuccuucuccacaucuugguaucugccuuucuccuaugcccuugaccugucaucucuccuggcccuggcagcaccuccaaccggucacacccccuccacucccggugcugagccacguuuuuaaaaugcaaaucuggcauugucacucccuacuuaagccuucuguggcuugccgugcccucgagguaaagccugcccuggagcccaggcucagccucgcgggcugccccuccuccgaucacacugugcuggucccuccuccuguuccuuacccaugcggagccccuaucuggaacucugccuacauuccuuccucggagagaccuaccuucaccccagccguacccugucccacccuucagacccuccaucccagcaccccacucuauuuguccucccugcucaauucagagcuucaagagggcagcaguuguauaagucuugcucccugcaugcgcgagugccugccacaguguuuggcacauaugugagcuuaguguguauuuguugaaugaaugaaugagagagggaagaaggccccacuuagguggaggaagcagucauugucaggugcaguuucccuucugcaggaacaagugccucauguagccagcaaacauuuggcaccuauccagugccagguccuggaggccaaagccgaggagccguccccucccccagcucuccuucagagggaugguuggggaggaggugccaaggcuuucggucugcccucucagggccacccaggcugguuuuucagugggggcuagaggugcugggaggugcccuccccuucucccaggaaguuccugagggacaggggucaugugaccccaaguguuuuggggggacuggccaaggccuggggcucugagguuaaaggacacauucuucagauuccugaagggggauggaggcagcuaaaggugcccccucccuaagacuggcuuggguugaggccuggggcacugguaggacugcugagguggacagaggaguugcugugacguuuucaagccccgcccccacuucucaaaaacagccuuugguuacuuggugcccaggggugagguggccuuuccuggauuugcacagugugaccugagcguguggauaacuguggccaguugagugggggguugucagugccugugugugguggcaggagggcugccugauugucagggcucagaucccagaagaagccuggcucucagauucagggccugucucugggguuccucggcggugugguauuucugucugagccagcuccugggaacugcuuuuccuuccuccaggacccuagggagggggcugugcucacccugggaacacugccauggucaggaucuugauuccuggguagcugcugagggccccuccccccaccucugacucacugucugacacuuuucuuagauucucacuauguuucauucccucuuggccucuccuugucucuggcucagucuuuuuguuucaucuccugccucugccucuuagccucuggauuccgagguggaacagaggaacaugagaaccaggggcacuucccccgccucuccagaggaguaucagggaggagguaauuucucauuucauucccgcucugcagauuuggaggggauuguucaucacuagaaccugcagcaugaccguagcuucccugugucucuguuucccugucuguaggcuuggaggucauaaccuccucaccuuaaguucucuuucuguggcgaucccuuaggcagagccgcagugcguaucugagccugcuuuccugacaucucucuccaucuguuuccucuugggggaccagggagccuccugggauugccuacauuggcaccugccugcagccugagcuucccucuccugccaccagagccacccuuuuugagcaccauucuugcuuguacccucuggcacagcugggggauagacaugugacucuccuccugccccucuuaaauuaacugugacaggagcaggagaaggucacacugaccagucgcccucagcagccucauguggguaagauugccugugcaguugggucuauacccgauaugcagggcuggucugcuuaccucugguauuaucaggugccuucucuaugccagacucuguccuagacaugggcacaugggcagccagagagaaaugcccucagugugaggcagaugagcaaugaggcccuugcagucugaucagauauagucugugauagggaaauaccaggguuuuugggagcuguuuuccuuugggcugcuauaauggaaaguccauagacuggguugcuuaaacaaaagauuuauuuuucacacuuugggagguugugaaguccaagaucaaggcucuagucagccugaugaagucugccuucuuggcuugcagauggacaccuucuugcugggucugagcucacauguuggagagggagaccaucucuuuugugucacuucuuauaaaggugcuaauaaggugucauucaucuccugauuaccccaaggcccaccuccaaauaccgucacacuggggauucagucucaacauaagaauuuugguaggauacaaauauucaguccauagcaggagcacagaaaggcaggaggaaggagugggggauucaggaagccccuugaaagaugacuuucugaaagggaauaaggcuggguuguuccagcuuugcagaggccaggaggugagcagggacauggccauuacgggaacugccaguucagcuggaguaaagagagcaagguggggagagggaagcaguggccaggucagcuucagcuucuugaauucuggacuugauccuaaugccccaaggggagcuauagagugguucuaggcgugggaguggcagguaaaugugugguuuaagaaggucauucuggcugcaggaucaagaauggcuggggaaagagggcaggaguagagggacaugggguggccacuguggggacagagacauguuaagguuagugaacuuuuuaaauugauaguaaccuaaauaaaaugcguaaguauauaaaucuuaaguguccauaagacgaauuuuuacaauuuuagacauucauuuaaccaccaugcagaucaacauagaacuuuuacaggucccccagcccuuccuaccucccaccccagaaaauuucccucaugacucucuccaggguguccuucucccucuccuggggaaccacugcucugacuuauaucaucacagaguaguucugccuuuuuuuuugaacauuugcauguauuucgugucugccuucuuucacucagcaugaugucugugagaugcaucugugucgugugcauccaggagcuggagcucauuuuuuuuuuuuuuuuaaacaguguggaauaacacauucacugagcacuuaucacuaaucuaagaacaugugacauguguugauucuucuaaaccccccaacccuaugaggucuuaagacaaagaauuggaggcacagagagguuaaggaacuugcccaggauuacccagccaaguaacaguggagccagaguucaaaagcaggcagucugguucuggagccgaagcucuuaacacugccacguggccuccaugcaaaagcaggcagucugguccuggagccgaagcucuuaacacggccacguggccuccaugauaccuccugggucuguuccuggcucuguguggauuaaacggauuuacaugaacucccaggcauggcgugccuggauauagauggaggaagagagaggaaggaguugaggaugacugcagguuucuggcuugagugacugggugggugguggggcuguuacuaagauagggaacacaggaagaggaacagauggcaugggggguggggaacagacacaagggguucgauuuggggccugcagaauuuuauguuucuaggggaugguugggcggagauaacaagugggcaguggguccugggggaucucaggcuggauguguggugaaggaggcauucagggcccuguagauggcaucuggaacuggggaaaggauggggucucuuggcaggaugcgauggggacaggauguguggguguuguuuguccauauguguguuuccguguugucugagcauguguguacaugugaguaugccugccucugggucaugaaucccccaccuccugggagaaccugcuggucagcugggagcuggguuguuuuuguuugugguuugacccugggaggggggugccaagccugagaaacuacccacggagaagcccccggaaacaucugugagucuucccccaggcccagggugggggauuggcuggggagggagauuuucuugcuucucucacgcuugccuaggggaggcugucccugggguaaacauuauccaguuaguaagguugacagcaaacucuacaggauucggggacuuuguaggcggcugggaagagggcaaaggaguguuuggaaaggacaccugaguagaggagaccaagacagccuucugguugguuuuuccuguucucucucauuuccugugauggcagugggggaaggguuccccagcacuggggccucggccucagcuucaacuuccuuucccuuucccccuggugaccuccccgaaggcccagcuggagcaacagacacaagguagcuguacucagccuuugggauugaguccucuggggcuugccaaaccuugggaaggacccuuauuugcugaagcauuccagggaaugagccccaagucucuucugcuuggauaaggccagccagcugugggagucucugguuaugcuucugcugagggcugagacucucacuugggagacaguguuguguuguggggugcuccaugucacgaagccacagacaggagagacuuuggacauuaggaucaaaugagauguuaaagagacagccuuaguggcuguggucacacaggccuggaggcaggagacuucuugacaguggagcggggguuucuaagggaaagucugagaagcucccacaccgggaggggaagggcucagaaacuacuccgucuaggaauggaggccaacgucaaagccagccuguuccccagagugccuggcuagccuggagcaagggcccgcagcccugccugugugcagaguggcgugccuguuuggaugugcuggaggaggaggaggaggaagcagagccaccauaccagggccgugcgggcugugcgggcuguagggcguacacacacacacauacacacacacacacacacacacacaggcacacagaugcaagcugugugaaucacccagccugugagucagcgccaggauuccugucggggaaugagugagaccaggcugaggucugucaguccaucuguuggucugucugccuccuuccccugcugguguggaugcauguguguguguguguguguguguuuuguguauguauguaaguguguguuguaggagguaguggggaaggugccuggugccugggaaggcuuugggcagaggugggaguuugaagcaucaggcuguggauuugcacauuaguuuggagggagggaggugcugugucuugugcagagauccuccuggagacugugcccucccccacacagagcuccacaggcagggcuggagggcagaggccagggucugggaugccuuggaggguaagugggagggaugaugauccuggcuggaaguccaccugcugcugccugccugccacuuagagccuucucauuccuauuccaggcugucuguccccagaccccagagcacguccggcaccaccaugacugggcuguugaagaggaaauuugaccagcuggaugaggacaacuccucggucuccuccuccuccucuuccucugggugccagucucgcuccugcuccccaagcucuucugucucccgugccugggacucagaggaggaaggccccugggaucagaugccccugccugaccgugacuucugcggccccagaaguuucacccgugaguacucccuccccugggaacuccaucaccugccugccuuccugaaagaugaaauuuagaagucccugaccaaaugccuuuggccucuggugguuagguccccauggcgguagcucucaugagcuauaauauaguggucacucaguguccacuguccaggggcaccugagcccagcuaauucaccuuugaccuugggagugaugacauccgggaugcagcucugcagagugcucucagggccuucccggucuggccccucccuucuguuccaguuucguuucuccaaugagcacccuaccguccuacaaauggaacugcuggaguuccccgcccgccccaugcuucucugccacggggccugucaagccggucccucuccugucaaaaugcuguccauuuugccugaacauagugaaaagggguuuuuccugguuauuuucaagcuuguauaguugugauuccagacugaugaacauggcccuagagcaguguuucuggaccuuauuuuucauuauuguuccccaggaagccuauuuagacauuuucuccuuaauuaucccccaccaugaaauuuuaauacaauagaugugcuguuuaccuuuuuauguacuguagguauauaucugugcauuacacauaaaaagaauauaauuuuuagcacauggaaucuaacaguauaaacagaaaaccuuuuagaagggaauucccucugguagcuggguacaaaauuaauauaguaaguugaaauauauggaauuuccaauauuugaccauuacaugguaauuugcuaugguucaaccuaaugaaaauaccaguacauagcuuacuaaucaauaaacauuaacuuguaaagggaaagccuuuuuaagccuguugcaaaacacagaaauccuacaaaucaauaaaaaacaauagaaaacuguacaaaggaccuguacauggcuaauaaacauaggaaagauguuuaaucuuacgaauacugucauuuggacugguaaauaacaauaagccaguucugacaugggugugguauucaguuucagccgcuccagucccaaccacacaggcuccuaaauucacauuucuuuuuucaaaauggguggagagggaggagggaaaaggugggaggcgggagggcagucuggcaugaucuuuuuggagguaaguugugccucacugaaaacuaauccccagcccaucuuugccugcuuucuagcccugucuauccugaagcgggcucgccgggagcgcccaggccguguagccuuugaugggaucaccgucuucuacuucccccgcugccagggcuucaccagugugcccagccgugguggcuguacucuggguauggcccuucgccacagugcuugccgucgcuucucuuuggcugaguuugcgcaggagcaagcccgugcacggcacgagaagcuccgccagcgcuugaaagaggagaaguuggagaugcugcaguggaagguagagagaguccucuccguggcgcaccuccugaggcagcuccuggaguccuaaccuugaggggugggcguaccaggggugggugcugacuugcucauuaugguuauggggaaacaggccugugggccuggugauuggcuugauuggagccuguugccuggguugucugcaacaggaggcgcagaggagggcucgugucuauuugcugcaggggcugggggcaugauaccugaaucugaacuuuuuggagagggggaugugaaguugauaugaacuggagggggugcguaucugucugguuaggaaagggagucuguccaugaucuagggaaugccaugaguaggauaucucuuuuuuuuuuuuucaaaugcccugagggcaguuuucuuggcuguccuguucacugucugacacacagugcccaucgcagauuaagcacgaguaguggggggguaagcacuuggggaggguuugucuagugacaguagggcuaagcccauguccaugucugugcuucuuacaucccucuuuccuguggaugcagcuuucggcagcugggguaccccaggcagaggcagggcugccaccugugguggaugccauugaugacgccucuguggaggaggacuuggcagucgcuguggcagguggccgguuggaagaagugagcuuccuacagcccuacccagcccggcgacgucgagcucugcugagggcuucaggugugcgaaggaucgaucgggaggagaagcgggagcugcaggcacugcgccaaucccgggaggauuguggcugucacugcgauaggaucugcgacccugagaccugcagcugcagccuggcaggcaucaagugccaggugugguggcuggacugggauggggauccugagcguggggacuucuuugcacuccacagaacccucacuuguaccucuacuuuucucugcagauggaccacacagcauuccccuguggcugcugcagggagggcugugagaaccccaugggccguguggaauuuaaucaggcaagaguucagacccauuucauccacacacucacccgccugcaguuggaacaggaggcugagagcuuuagggagcuggaggccccugcccagggcagcccacccagcccuggugaggaggcccuggucccuacuuucccacuggccaagccccccaugaacaaugagcugggagacaacagcugcagcagcgacaugacugauucuucuacagcaucuucaucagcaucgggcacuagugaggcuccugacugccccacccacccaggccugccuggcccuggcuuccagccuggcguugaugaugacagccuggcacgcaucuugaguuucagugacucugacuucgguggggaggaggaggaagaggaggaagggagcguggggaaccuggacaaccucagcugcuuccauccagcugacaucuuugguacuagugacccugguggccuggccagcuggacccacagcuauucuggcuguagcuucacaucaggcguccuggaugagaaugccaaccuggaugccagcugcuuccuaaaugguggccuugaagggucaagggaaggcagccuuccuggcaccucagugccacccagcauggacgcuggccggaguagcucaguggaucucagcuugucuucuugugacuccuuugaguuacuccaggcucugccagauuauagucuggggccucacuacacaucacagaaggugucugacagccuggacaacaucgaggcaccucacuucccccugccuggccugucuccaccuggggaugccagcaguugcuuccuggagucccucaugggcuucuccgagccagccgccgaagcccuagaucccuuuauugacagccaguuugaggacacugucccagcaucucuaauggagccugugccggugugaggaccaggaugucuuuucccagccccaagagaccuguugcugcuuucuuguaauuauggggcuccccagagucugcguaacagucucccacuggcuggcucacccacaggugccaugugcacacuccugguuuucaaacaauucucuggauuuauuuauuuguuuuaacuuuucugugcugaagagaggacuggggggagggggcuuccccuuucagcugcccggccccccacacccacagcuugcucuucuaucuccacaacgugagccuggaagaggagaaaauguggcuccucuggagcuuggcagaccacuuuucggucuuugcgugauguuccuuagcccaaagacggugagacagggcugaaaucagguggcuucugccacccugagcccuagacccauggguggcuaaauccacuggacugugaagacuauaauuuauuuccauaauuuauuuggagauugaggaggcuuugguugcacuucuuuggcugguggguaaugccagggguggggugggcacaggcccucaagagccccuuuugccuuguaguccuacaccuugcccugccugggcuuuggugcagacuagguguggauuugagcucugugaucuaugucugcugccuggcuccuagauggcucugugggcaggugcuggccaaggacaucaucuaggcagggggagagccugggcugaacagcugugaccaaaacucccuucugccccacccugcccccuccacuuccugcccucuguuccaucuucccccuucccaaaggccacagccuuuauuccaggcccagggauguaggagggggaaggaggaaacaggaagcccagagagggcaaagggccuaccucggggcgcgaaccaugccccagacuauuaucucagggcuuucugggcacugcacuucagcguggcccaccugcccaugcccugaggccaguuggcgagggguggcuccugaggguuuuuauacccuuuguuugcuaauguuuaauuuugcaucauaauuucuacauugucccugagugucagaacuauaauuuauuccauuucucucugugucugugccaagaaacgcaggcucugggccugccccuugcccaggaggccuugccagccugugugcuugugggaacaccuuguaccugagcuuacagguaccaauaaagaggcuuuauuuuuagcaa

SEQ ID NO: 16170 - RNA, 1794 nt, Homo sapiens
ugggcuaguggcugacagcauucaucuaggacagucagaagaacccagaaugcagcgggagcaggacugggagggggagggucaggcucccacgaaggcucccuggaggaggcagugcaagcugagcccuuaaaggcauugggauucugguaagcagagagagggcaggagagcauuccagucgagaagaccggcugcaguaaaagcgugaggguggaaacgcucgaggugaugaguagacucguaccugcgguugggaaguggggcugagggugggcucccaggccaggacuugguugccggggcaugucguaccgggaggguuggccccgagucaggaaaggccuuggcgggagcagagaaggcaguggaccauuuuaaguggccaagaucuggcccggaagaaaccagccuuuuuauuuuuuuaagggaagguugaggugggaguggggaagcuaguucuaagaaccccuaguuuggaacuucugcagggaagggucucuuggcccgugggcaggaaugaaguucaggcccacugauuacauccauccuucccgcucccugccuccccgcuccccacacaccccagauuccucuccagccacaguuuacuuuuccggcggaucugggggugggugguagguugggggcggaggggggaacuuuuagauuggaauaaaauaaacucccucuagagggguggggguggagagcguacaggagacgucggcucugccacugucuagcccguggccuugcggaguuacgaggugcucccggccucggucuacccaucuguaaacuggggcgguggggcgagguggggaucucuacgcucggcucugccggcuugagucguccgcgccuuuagggaccgugcuggaagcggggcggggagggcgcuggcgggagagggcugggggcggagagcggcggaggcgcagucgccgggucacaguccgcagggaggcccccaggccgcugcgccaggcuccaggcgggggaggaggcggcgccuccggggcggggcugccgggcggccuggcuggaggcccggcgugcgucagcgcagugagccccggaguuuuccacugacgaggagggcggagcggcgggcggggcugggcgcaggcagucucccgccgccgccgccgcugccggacgcgcagagcgaggggcggcuggaccgacggcugccgggccgagcgcacagagucgcggcgcagggggcguccccggccgggacgcgggucgcgucguuguccuccgcgagcguccggauugcaggugagcgccgaggggccucgggcccggcaggacgggacuuuggggagggggcauucagcgcgaguggcacugccgcuccugccuccugccguucacuccccggcacccugagcgggcgcgggggcuggagcugcccggcucugacggcgugccgcggccggagucgggggccgggggcccggccggcgggagucgcagguuuucugcuccccucccccgcccgccgcgguaaccccgagagaagucacggcuccccgagcucggcgcgaguggggacagagccgggcuugcgcgcgagcggcgaggcgacgggggcgugcguccgcgggugaguuuccuuuugacccaguugccugagaacuuuucagaaguuccucgcguggccggagcaggugacauuugucgccuuccuccucgggcuccccccucggggaggcugcgggagcugcggcgugugccgggcgcccccggccggcgggggucagggagggaguggagggaugagcg

SEQ ID NO: 16171 - RNA, 3625 nt, Homo sapiens
gugaagaaggaauuggcaacacugaaaccuccagaacaaaggcugucacuaagguaugugcuacaagcauccuuggggaagaagggcaugaguaggcaggggcauuuuuauaucuuuagaggauaggcaaagggaagaccaaaauuucagaggucuagcacaagaaguaaaauuuuuuuuuaaaucuuugcauuuccucagagcccacaaacaugcaugugucuuaguggcugcccaugcucuggcugaggagagcaaaccgugccauauucucugcaggccuuuaggagagagugaaaacuccuacaagagugggaagguagauaagagaagauccuuuauaauaccaggcaucugggaagaucuguccuugugcuggguacagggcuucuaucagguaacugaaggacaccugggugcuguucuuaaggaaagaagccagcgagcaaacuuucauaugacuaaagaaguugcuggugggugccuguagucccagcuacucaagagccuggggcagaaggauugcuugcgcccagaagucagggcuuugugugagaucacaccugcguauaacuacuguacuccagcuugggcaacauagugagacccugucucuaaaaaaauaaauaaauugcuugcuugcuugcuugugcuuucaaaucauagaaaaguagcagaguggagaggggugucugaauguaaagcaaacaaaugccuuggaaaaauaugucuggauugaaauugcauugaauguauauaucaauuugagaagaauugucaaguuuuauaauuuuuauguaacugaauugcauuuuuauuaguuuuauuccuaguaaugcuaguaauuuucauugcuaguauaauugggaucauuuuucuauugcauuuauaaaguuauuuuuuuucuggugcuuaggaaagcaauuaaaagaauaaacugaugaauaucaugcagauauaucucuaaaacaauaagcaaaauacaaagggaaaaacaauauaucauuuauguaaguuaaaacaauauaucauuuauguaaguuaaaacacacaaaaauauauauuguuuauggauauauauaaauauguaaaaguacagggggaaauuguuuggaaugauacauaccaaauugguuuuaguuguuguuucuguuauggggauaaguuguguaguuaaagggaacauuagcuucaucucuauugcaucagaaauaaaaaaagaaagagggauggaaggaagagagggaaugagggagggagaaaagaagggagaaaaaaagaaggaaggaaggaaaaaaaaauaacccaaagcauugugagaauauguuagcagcugcuaauucuaggugauggaacuauggguauuuacauuuucuuuguaaguuuuggcuuuucucaucucagcugacucccuuugguuuacauaacaaaauacaauagacugaguggcuuaaacaacagaaaguguuguuuaacauacuucuaaaggcuggaaguccaagaccaagcugccaaugcaguugauuucuggugaggcuucucuaccuggcuugcugauuucagccuucuugcuguguccucacauggucuuuacuccaugcacaaggggagcaaaauuucuugugucucuuucucuucuguuaaggacacuaguucuaucagauuagggcccugccuuuuuugguuuuguuucuguuuucuuuuuuuugagacagagucucacucugucacccaggcuggaguacaguggcuugaucucgagucauugcaaccccugcuuccuggguucaagaaauugucgugccucagccucccgagguagcuuggauuacaggcauguggcaccaugccuggcuaauuuuuguaauuuuaguagagacgggguuuugcacuguuggccaggcuugucucgaacuccuggccucaagcaauccgccuaccuuggccucccaaagugcugggauuacaggugugagucacugugagagccagggcccugccuuuauaaccucauuuaaccuuuuuuuuuuuuuuuuaauuuuaauuuuuuuuuuuuuuuuugagacagaaucucacucugucgcccaggauggagugcaguggugugaucucggcucacagcaaccuccaccucuucgguucaagugauucuucugccucagccuccugaguagcuaggauuacaggcaugcacccgccaugcccggcuaauuuuuguauuuuuaguagagacgggguuucgccauguuggcaaggcuggucuugaaccccugaccucaggugaucugcccaccuuggccucccaaagugcuaggauuacaggcaugagccacagcucccggucuaucauuuaaccuuaauuacaucuuuaaaggcccaaauagucucacccacuccaaauagucacacccacaccggagguugagcacuucaacacaugaauuuggggaggacacaguucaguccauaacaucccccuaauuuuuaaaaaauaaaaauguuuuuaaggagugaaugucuuuuaugugucucugugaccaggucccgcugccuugauggauuauacacuugaccucagugugacaacagugaccgacuacuacuacccugauaucuucucaagccccugugaugcggaacuuauucagacaaauggcaaguugcuccuugcugucuuuuauugccuccuguuuguauucagucuucugggaaacagccuggucauccugguccuuguggucugcaagaagcugaggagcaucacagauguauaccucuugaaccuggcccugucugaccugcuuuuugucuucuccuuccccuuucagaccuacuaucugcuggaccaguggguguuugggacuguaaugugcaaaguggugucuggcuuuuauuacauuggcuucuacagcagcauguuuuucaucacccucaugaguguggacagguaccuggcuguuguccaugccguguaugcccuaaaggugaggacgaucaggaugggcacaacgcugugccuggcaguauggcuaaccgccauuauggcuaccaucccauugcuaguguuuuaccaaguggccucugaagaugguguucuacaguguuauucauuuuacaaucaacagacuuugaaguggaagaucuucaccaacuucaaaaugaacauuuuaggcuuguugaucccauucaccaucuuuauguucugcuacauuaaaauccugcaccagcugaagaggugucaaaaccacaacaagaccaaggccaucagguuggugcucauuguggucauugcaucuuuacuuuucugggucccauucaacgugguucuuuuccucacuuccuugcacaguaugcacaucuuggauggauguagcauaagccaacagcugacuuaugccacccaugucacagaaaucauuuccuuuacucacugcugugugaacccuguuaucuaugcuuuuguuggggagaaguucaagaaacaccucucagaaauauuucagaaaaguugcagccaaaucuucaacuaccuaggaagacaaaugccuagggagagcugugaaaagucaucauccugccagcagcacuccucccguuccuccagcguagacuacauuuugugagg

SEQ ID NO: 16172 - RNA, 5095 nt, Homo sapiens
uauaauccuacuaucaaucugccuccuaacuccagccucaacaggcuuuaaauccaaaggcuuaaauacauuugucaacaggucaaaaagaaccuuuauuacuuuuuaugauugccacuuaugcuuucuugccagaugccuuuggagcaggugcuuucugggcuggagcuuuuugacccuucugagcuuuuggagcaggcgcugcuuucuggccuguggcuuucugggcaggaaccuucugggcuggagccuuuuuacucgcggcggugaucuuuuuugcuggaacuuuagcagcagcagcagcagcagcagcagcagcaguacccuuaguaccaggugcuuuuuugggagaagcuuucaggagagcugccuuuugaagcuucuuaacuucauucuugauuauucuguuccucugaaaauuaucaauguaagaaagcacuuauuguguauacauacaauaaaauccaauuuaugcugguuuuagaaagggcauuaaguagucuguuucccuacaacuacaucugaagaaagguaacaauuccauagggacaucaugaaauacaaaugaagauaaauucuccuuuuuuacagaaagcuuccaagaagcuggcagccugaaaugggauuuggcuacugcucccuuauuauuuaaagcuaaguuacacaaaaauacagaucuuaaaucuuaccauuuucuuugccuucauaacuuuaaaacgaucaaaaucugucaucuuggcuuucuguuaaaaaaaaaacaacaaauaaaaauuaucccucucacacuaucuugaacccuccaaaaaaagaaaggaccagaauucaaaugacccuaaguuauuacccuuucucuggcuucaaucuucuuggcccaucguguggcugcccauuuuguauugaugucugccuucugccaggcuugucggacauacuucuggugggcacuagaacgagccaagaccacagauuaagaaaucagcuuugaagucacucauuaucaaagacacuuucuuuguuccuugaaaagcacucuuccuguuacacaacaccugguacacuauguauuuuacuuauuuuuguguucaguaagccagaauagguuauuaacuucaagcauauuuuaaucaaaacuguaauccagucccuuuuuuuuuuugagagaggaucuugcuugccacccaggcuggaaugcaauaguaugaucauggcucacuguagccucaaccuucuaggcucaagccauccuccugccucagccucccaaguagcugggacuacaggugcauaccagcacacccagcuaauuuuuauauuuuuuguagagacagggucuugcuacguugcccaggcuggucuccaacuccugggcucaagcaacccuccaccuuggccuccugaagugcugggauuacagguaugagccacugcacccagcccagcccauuuuaugaauuuaaaaacuaccucuugaccaggcgcaguggcucacaccuguaaucccagcacuuugggaggucaagauggguggaucaccugaggucaggaguucaagaccagguuggccaacauagugaaaccccaucucuacuaaaaacacaaaaauuagcugggcgugguugcaggugccuauaaucccagcuacuugggagccugagguugcagugagucaagauugcgucacugcacucuagccugggugacaaagugagacuccgugucaaaagaaaaaaaaaacccucaaaaaaaacacaaaaaacccaccucugacuauauauaauuccacucgggcaguggacguguugaaaaccauucuuuuuuuuuuucuuuuuuugagacagggucuugcucuguaacccaggauggagaaugcacuggcgcaacguuggcucacugugaccucugcuuccuagguucuagcaauucuucuguuccauccacccaaauagcuggggcuacaggaguacacuaccacacugggcuaauuuuuggacuuuuaguggagacgggguuggcuaggcuggucucaaauuccugaccucaaguuaucuaccugccuuggccucccagagugcugagauuacagguaugagccacugcacacauccgagccauucauucucguaacaaacaagguaauuaauauuaacuguuaggcuuuuuuuuaaaaaaaaauuuacaguaacaauuuguggccaaacauccuaaaaauaaaauccaggguguccagggauccaaggcagaauuacaagaguaccuagugaaaaaucuaaguuaccaaguauuuucuacugcuuugaacuuugacaaguauccucaagcuucaccccuaauugguaugucacaguaguagcagcauggcuauguucacucgagguuguucaaguggcauguuuucaacuaccaguacuucaaaauccauuauguguuaauacacgucccacagugccuguagugcucagcauacaguaaguuuuuuuuuuuuuuuuuuuuuugaaacggagucucgcucugucacccaggcuggagugcaguguugcgaucucggcucacugcaagcuccgccucccgggcucacgccauucuccugccucagccucugaaguagcugggacuacagguguccgccaccaugcccggaauauuuuuuuuuuguauuuuuaguagagacgggguuucaccguguuagccaggacggucuccaucuccugaccucgugauccacccgccucggccuuccaaagugcugggauuauaggcgugagccaccgcgcccggccaacauacagcaaguuuuugacuauuuuuuaaagcaugcaaaauuacauguuccacugcaaccaucauuguggguugaauuaacuguauagcaacacacuaaaguguuuuaauuuucaugucaaaaaagaacugcuauucacugccucacuuaaauguaagcuagggauaaaaccucuuauauuaaauacuguguaacugacacacacugagagcuuaucuaaugauagcuaguagcaauaaacacaagacuuaguauuguuguuuacuuuaagcuaaaaauuuggcagaaaccagaagaaaagaagauggcaaaucuaaacaaaggcaaagcccuaaacuaccaggauagaaaagugaccucaaggcauuuauuuuauuuauuuauuuuugagacagggucucacucugucauccaggcuggagugcaguggcaugaucacggcucucugcagccucgaccucgcuaaaacgauccucccaacucagcacccccaaggccccccuaccugggauuacaggcgcgugccaccaugcccaacgaauuuuuuuuuuauuuuuuguagagauggggguuuucgccauguugcccaugcuggucuugaaacuugggcucaagagacccucccaccguggccucccaaaguacugggauuacaggcaugagcuaucacgcgcaggcaagacauuuuaaaaguaaauaaucccugucuacuucuaugaugcaaaucccucuucaggauggcucugaaucuuccguauuguuuacuccaaaacaaacuuuuacuagcauaaacaaaucuggggaugggagggaggagugauuaguggacaguuaccugugcggaaacuugaggaugaaaucagugagcugcaugcacuugaaaggcauggccugucuccucacuugagugcaagguccaucgaccaaagccuagaacacaaacaucaagaacuucagugcaaaaucuaacagcaauuaaaauggucagaugguucuguaacauuacuuauccguucagggccaucaaacccacacuacuauuuuaauaaauugcucagaaaagacaaggauuguccuaucuggguuauauauauguaugucuuuugcucaacacaaacauuucuccacaucauuaaaugcuccuucuuaaacuauauaguaccccauagaaaccaaccacauguaauuuacaggcaacuuuaggacucugaucccugcugauuuauagucaguggucaacuccuuaguuugcuuguuucaaauacacagcaguaaauacaaaagugcuuucuacgugcuggaucuguucuaaacucacuuuacguauaguaacucauuuaaaacuaaccaacguuucagccuauaacuggcucuagcuuaaguggcuaauacugaaauucaauacuaauagcuaacuucaggcugugcuuaaaacccguaccauuaccuguuuccucaaugguaaaauaaagcgacuacccauagcauccucaucuuacacagccaucgagacaauucauuauugccaucugcagggcacauguccacugccauguuuaguaaaaaguugugacacuuacccuguucugaucaauaacaucuacaaucgcgaccaauuuuccggcaugagguccaaaggagacauaggccacccggccaaccuccacgaagcgccugaacaccuaaaauuggaggagaaaggacagugaaacuuacuuagaaauacucgcuacauaugucaccuucugcagcuaaagacaacaugguuaaauucagcgaaaaagaaugcugcagggaacaaacgcccgagagccaggcgccaaccuggauggacgaaaucagcaaacgccucaguagcuuaagcccgguucccaacgcccgccagcucccagguccgcaaggcccacacggcaggacaaggcucucggaccacgagccgcaucagccauccagcuccagcggcggaggcgcgcacgcguggcccaaggcgcgccaggccugccgggcccuccacgcgcucgccagcggcgaguccgggaagggcgcgaguccgggaagggcccgauuccgcugcacagccggcccggggacccucaccaugcgcuucccgggacccucugggagccguuuggcgccucagcuucccagcggagguggaggucgagcggcauggucgacggccccggagcccgcaacaguaagacucaccauguuggcggcguuaggcgagaaggaagaagacccgcccaacccugcgcauguguagaagaacgcaccgccccugcgguaacgagucaccgacgugagcaccgauug

SEQ ID NO: 16173 - RNA, 6980 nt, Homo sapiens
acgacagggcagaaugaaaucacuuuaauagcauaacaacauuuucagaccaggagucacagaugaagaaaacauuuugucuuccauuugcacaauucuggugaggugugugguugcacuggacaaucuuacagacacauuuuucacauugagaacuuaauaaauagauacauacaaugucaaacuccacagacaaugaguuaugagugugauuguuuucuuauucugccuccucuggguugggagguugcuucccguugggcugauggcggcuggguccucuaggagggguacucauacuccucggcacugcgacggccaaaauccauccagcccauguagucccggucacuuauccuguggcugggguccagguucugcagguucuuaacgauggacauucguccagaaggagcuacaaggagcagggaggaaggaaacagggacauugcaucuaaaagcaucucuaguucaauuugggaaggagagcaauggaaaaagccagacgcaauauaacagacaccaccuuaaagguaucaaagagcuaucaaaguaguggaacugauggaccaaaaucugagagaggagaaggaccaaugucuguguaacuggagagaggacaauauauuuacaaguuaggggugugcuuugcguucugcaaguauuuagguggauucauuuucucuagccuugcagucuggggacuugccuagauuuuccuuagucucccuaccguuugcuuucuuuugguagauggguguuuuccuuuuguagauggcaucagcagaaaccaaccaaagauuuuuccaguacuuaauuguuccuaaauucaucccuuaauauccaucaacauuccugacuccuggagagcucuuguuauuaagguggcacaauuauaauaucuugauguuggaaugguuaaaaaaaaaucguuggugggaguguaaauuaguucaaccauuguggaagacaguguggcaaucccucaaggaucuagaaccagaaauaccauaugacccagcaaucccauuacuggguauauacccaaaggauuauaaaccauucugcuauaaagacacaugcacauguacguuuacugcagcacuauucacaauagcaaagacuuggaaccaaucuaaaugcccaucaaugauagacuggauaaagaaaauguggcacauuuacaccauggaguacuaugcagccauaaaaaggaugcguucauguccuuugcagggacauggaugaagcuggaaaccaucauucucagcaaacuaacacaggaacagaagaccaaacaccgcauguucucacucauaaguggaaguugaacaaugagaauacauggacacagggaggggaacaucacacaccagggccuaucgggggguggggguuaggggagggauagcauuaggggaaauaccuaauguagaugacugguugaugggugcagcaaaccaccauggcauguguauaccuauguaacaaaccugcauguucugcacauguaccccagaacuuaaaguauaauaaaaaauagauaaauaaagcuccuuugcuacauaaauacucuuuuaaaaauaugaauuugaaaguuauauucagaaagcuuuugucauuuaucaguaaguguuuugaguugaugaucauuuuauuuuuaaugauaaaucaauaucaauuaaaaaugauauucagaaaaagacugucggauuaaaucuuggcaccucaguaagacucaaagaagggggggagagaggugauaacaaaggugauuuaaaucagcaauuuugaccaaaaugcaauaacugaaccugaaauugucccauugggauggaaguuaagucuucaggaacagugugauccuuuuguagagcucacacugagugagcagggacaugaagaggcaguuuauuuggagacaugagacaguccuagcucaaaguucauagacagaagccuccugggguaugaaaucagcagaacaccuucuccugugcaagcucagucuuaagaaaggcccuucagggacuucaauggacaaagcccaggccaaaucaaggguagaggaguggaggaccacucaaugacucccacuguguugggggccacuguauccccaccuccugucaugcuggucuauaucccuucugcaugaggcugcccuugccagcuccuacccauaggcugaguagagucagacuauggcuuauguguugauaaaugaaaaugcaaaggcaguuacccuggguaaugaaauuaagcaaguuuaauuaaaaacagaaacaacacagaacaacguccccacccuuucucuccccaaccccaacccuucccaguuuuggaaccaacagucaauucagcacauuucaggucuuuuugcagauauccucagccuacguagaagaaaaauagccccugcuauuuaauuguucaucauucaggugaaauauuacccuugaauucaggaaaaccuauagacccaguuaccuguacacagucacauggaaacaugacccauccuucugccugcugugaugaugagugcccacucuaaggccugggcacaacccaaauuuccaucuaauggaagcaaggugacagcuucaauacgagcaagcagccucaguuaacggugggggcaccauguucagucauggaagcugcauuuaucacacacccugacuuccccguuccacguacaguucuguccucaugucauguguauuuaccaggguccucacucacuuucccagugcugacauagaguaggggcuuacaucugauguauggaauugaucaaagccugauuccuaugggccacaagagauggacgggccucccucugaaucacacaaagaauuggaaggggcuuauuggaaagcuagccucgggacugucugcaugucacucagcuagugggcugcugaaucaccuuauuccuggagaaagacuuuggugcugagaaaacagugacuuucuuagcucuugcuaaaacugaaggguuuagcucuuuuaaacuuuaaaauguggaauaggcaguacagcuaggaagcugaauggcuuccaggcccuccuggggggagcaggacuagauagagucucagcccugcuguugcguagauaugcaacugcauguagguuacucaggcuuuuagagccccagcuuccacacuggcaaaauggguauaauaauauucacugugcagggcuguuguacugagaaagacaauauagauguagcauugaagcuuugcugggcaugggggaggcgcacacuaaaugccucuagauaucuuuacccacugcccuccaauagaauuguuucuucuugggccauugaaagugcugcagauauuuccuaaugauaaacucuuaaguacugcucaaagaaugcauugucuuguuuagaacuuuuaagaauaauauauacuauaguggagcaaaaaucugauaugaucucaaaauauguaaaauauucaaaauauguaaaauauucuauauacugcacauauagaaacugugcaguaucuauauguguaaguauuuaguccuaguucauguuugucacauagaagaguuugcuuguuuuuuagcuagaguugauccuagguguuggcaucuaaauuuccaagugauugcuauucccuccuggguuuguuuggcacaauuggcugaaggcaaagggagaggggggcugagaagagggacuagaaagaacuuuccagcuaagauuuaugcuauaagagccauugucuaguauugguucuaggaaauaauuugguaaugagcuuuuuuuuuuuucuuuuuuuucccuagagcaauuuuggaaccaagacucaauucggcacauuucaggccuuuuugcagauauccucagccuacauagaagaaaaaccagggucuuuccuaaauuggaggaggggaguccagguccacaguuaaaugaaaagccuaggauauuucagacuggucuggcugaaauucagccuguaucuggggacagauacuaaauuauuuucaggcagagaaucagcaggaacucaaaagcuuucagacuuucucucuccaucugagaaguauuucuaucuuuuucaauuuaauuagcaggaaagcaaaacacaaggugguggguggggcaauuucccaaagacaggaagaaauacaacaaaucacugauuuguucuuuccuucugaagccucugggucagaguuccagucuucccuucaugugaacccacagaagaacucugcagagccaaaacucuucaucuuaucccucucuggucaagccagggguuaagguucaaauccaggcccuggaacaccaguuggguaagagagcuucauggaaaaggcaacacaccuaccacaucccuuccagcaguguuugcuaaguucuuuuuuuuuuuuuuuuuuuuuuuagacaguuucacucuuguugcucaggccagagugcaauggcacaaucucggcucacugcaaccuccaccucccgaguucaagcuacucuccugcuucagccucccguguagcugggauuacaagcaugugccaccaugcccagcuaauuuuguauuuuuaguagagaugggguuucaccauguuggucaggcuggucucgaacuccugaccucaugugauccaccugccucagccccccaaagugcugggauuacaggugugagccacugcuccuggccugcugaauucuuuuaauguccagcuguguuuguacuguucagcacacugcuccacagccgguguucaucauuagugucacuggggauaaaguuggcagaaaaaagcugccccaauccaaagcaugauuccuaugggucacaagagaugaaugggccucccucugaaucacacaaagaauuggaaggagcuuaggggaaagcuagccucaggucagaauugccugcaugccacucggcuagugagcugcugaaucaccuuauuccuggagaaagacuuugaugcugagaaaacugacuugcucagcucuugcuacaacugugaccaucucugcaacaguaaaguaaaaacaaauaccucucuuguuggguaauaauuuguaagucauugcaaggagaacacaaaacugcugcugauucuuuccuucuguuacauacuuugguggaaauggacacauugucacugcuuuuuuaaacuguuguagccagaucucaggcauucucagcauugaccccuuccugcuagaggauuuccaaggguugguaucuggguggcuccaagguccuuugcguuuucaguagaggguauucacuguaucuaggaacccuuuccuaggcuucaauaauuaucuuuuaauggcuugguaaaaugguguugaacuuaaucagcaacacugcuaaaaauuaguucaaagaaagcuuuucaagaagguuccccuuacuuauaaauuaaguccuccauaccccuucucagauugcuacaaaggaccgccagaaaucauguugcuuguuuccuaccgagagaggucauccccaucaggcuagcgcuagagaagagggucagcaucgggagccugggaacaagggcagaagugagggauggggaggcagcauucuuaccuuuccgggccugcuggauguaucuugccagcagggcgcccaggugcgcucgggacucgccauccguucucugcgauacccucagcugccuacggggcgccuccucugcccgcugcagcccggagcccgcgggaucugcgggaggcaccggcugcgucagggcgccagccgccaguaccgccaucagcacgcacaggcacacgccgcuguucauggcuguagcgagcaaaggaggagggcgcguuaacugaaaggcugggcaacagagcuccugcggcgggccgggcacccagaagcgggcuuaggacaaacacaggugcuccagacccgccaggccgccgcaagcacgagggcucgccaagcgcugaccccagccgagugccauggcgcgcgcccccgggcgcaccuggcuggucuuugggaacuccucacccagcgccaaggggcagagacccuguuuucugccguguugagcagaaggaauguuuuugcuuuccuaaaguuugaggaaguguuugcagagugccucucuucuaaccgaaagaagaaaaauaaaaccccacgagauuaaaaauagugugaaaaaaauauccuaaagggaagacuccgugggagaaaugagaacccuggggaaagcacuuuuccagauagcuaacaagcuuucaauauggaaauacaguaaaugaugaaaaagagaagcacaguuuaaaauguaggagcaauaaauaaagccguauuuauaaaguuuuucucaaaguguacgugggaaauggcaauaagccacuacgcagaacauaggcagguuuuaaaaucagaaauaugugcccagcgcucaggcuucgaaagccccgugcauuuuagaucgcuaguggauaaaacacccucaaguuucuauccguaaagccucgaaauuuucugcaguauuuagaaaaugaauuuaaaucuuaaaacccucuaauauuuuauuagaaaagauugcaaagucccccgcaccgcuguguaacagcuagcaaacucaaucugcaugcgaaucuuagcgaauggguaguucaucccuuaaugaugcuggcguaugaaaggcucuaaagcagcucuacccacccagaccucacuuuuagacccagagccguuauuucugacuucaagaaaugucuuucgagcucucggagggaagacacagaaaauagaaaagcauaauggaaaugggcacaaagcugaagacagcauccuucaaagacacacgacacuuggaucccccgcugacgaaccgagggaccuaccuuuuggauuaggacgcagcuggcuuggcguuuccaaccggagcagcccggcagcugagccaaguucagggaggaccagcgggcggcugucucuuaaaua

SEQ ID NO: 16174 - RNA, 6980 nt, Homo sapiens
uauuuaagagacagccgcccgcugguccucccugaacuuggcucagcugccgggcugcuccgguuggaaacgccaagccagcugcguccuaauccaaaagguaggucccucgguucgucagcgggggauccaagugucgugugucuuugaaggaugcugucuucagcuuugugcccauuuccauuaugcuuuucuauuuucugugucuucccuccgagagcucgaaagacauuucuugaagucagaaauaacggcucugggucuaaaagugaggucuggguggguagagcugcuuuagagccuuucauacgccagcaucauuaagggaugaacuacccauucgcuaagauucgcaugcagauugaguuugcuagcuguuacacagcggugcgggggacuuugcaaucuuuucuaauaaaauauuagaggguuuuaagauuuaaauucauuuucuaaauacugcagaaaauuucgaggcuuuacggauagaaacuugaggguguuuuauccacuagcgaucuaaaaugcacggggcuuucgaagccugagcgcugggcacauauuucugauuuuaaaaccugccuauguucugcguaguggcuuauugccauuucccacguacacuuugagaaaaacuuuauaaauacggcuuuauuuauugcuccuacauuuuaaacugugcuucucuuuuucaucauuuacuguauuuccauauugaaagcuuguuagcuaucuggaaaagugcuuuccccaggguucucauuucucccacggagucuucccuuuaggauauuuuuuucacacuauuuuuaaucucgugggguuuuauuuuucuucuuucgguuagaagagaggcacucugcaaacacuuccucaaacuuuaggaaagcaaaaacauuccuucugcucaacacggcagaaaacagggucucugccccuuggcgcugggugaggaguucccaaagaccagccaggugcgcccgggggcgcgcgccauggcacucggcuggggucagcgcuuggcgagcccucgugcuugcggcggccuggcgggucuggagcaccuguguuuguccuaagcccgcuucugggugcccggcccgccgcaggagcucuguugcccagccuuucaguuaacgcgcccuccuccuuugcucgcuacagccaugaacagcggcgugugccugugcgugcugauggcgguacuggcggcuggcgcccugacgcagccggugccucccgcagaucccgcgggcuccgggcugcagcgggcagaggaggcgccccguaggcagcugaggguaucgcagagaacggauggcgagucccgagcgcaccugggcgcccugcuggcaagauacauccagcaggcccggaaagguaagaaugcugccuccccaucccucacuucugcccuuguucccaggcucccgaugcugacccucuucucuagcgcuagccugauggggaugaccucucucgguaggaaacaagcaacaugauuucuggcgguccuuuguagcaaucugagaagggguauggaggacuuaauuuauaaguaaggggaaccuucuugaaaagcuuucuuugaacuaauuuuuagcaguguugcugauuaaguucaacaccauuuuaccaagccauuaaaagauaauuauugaagccuaggaaaggguuccuagauacagugaauacccucuacugaaaacgcaaaggaccuuggagccacccagauaccaacccuuggaaauccucuagcaggaaggggucaaugcugagaaugccugagaucuggcuacaacaguuuaaaaaagcagugacaauguguccauuuccaccaaaguauguaacagaaggaaagaaucagcagcaguuuuguguucuccuugcaaugacuuacaaauuauuacccaacaagagagguauuuguuuuuacuuuacuguugcagagauggucacaguuguagcaagagcugagcaagucaguuuucucagcaucaaagucuuucuccaggaauaaggugauucagcagcucacuagccgaguggcaugcaggcaauucugaccugaggcuagcuuuccccuaagcuccuuccaauucuuugugugauucagagggaggcccauucaucucuugugacccauaggaaucaugcuuuggauuggggcagcuuuuuucugccaacuuuauccccagugacacuaaugaugaacaccggcuguggagcagugugcugaacaguacaaacacagcuggacauuaaaagaauucagcaggccaggagcaguggcucacaccuguaaucccagcacuuuggggggcugaggcagguggaucacaugaggucaggaguucgagaccagccugaccaacauggugaaaccccaucucuacuaaaaauacaaaauuagcugggcaugguggcacaugcuuguaaucccagcuacacgggaggcugaagcaggagaguagcuugaacucgggagguggagguugcagugagccgagauugugccauugcacucuggccugagcaacaagagugaaacugucuaaaaaaaaaaaaaaaaaaaaaaagaacuuagcaaacacugcuggaagggaugugguagguguguugccuuuuccaugaagcucucuuacccaacugguguuccagggccuggauuugaaccuuaaccccuggcuugaccagagagggauaagaugaagaguuuuggcucugcagaguucuucuguggguucacaugaagggaagacuggaacucugacccagaggcuucagaaggaaagaacaaaucagugauuuguuguauuucuuccugucuuugggaaauugccccacccaccaccuuguguuuugcuuuccugcuaauuaaauugaaaaagauagaaauacuucucagauggagagagaaagucugaaagcuuuugaguuccugcugauucucugccugaaaauaauuuaguaucuguccccagauacaggcugaauuucagccagaccagucugaaauauccuaggcuuuucauuuaacuguggaccuggacuccccuccuccaauuuaggaaagacccugguuuuucuucuauguaggcugaggauaucugcaaaaaggccugaaaugugccgaauugagucuugguuccaaaauugcucuagggaaaaaaaagaaaaaaaaaaaagcucauuaccaaauuauuuccuagaaccaauacuagacaauggcucuuauagcauaaaucuuagcuggaaaguucuuucuagucccucuucucagccccccucucccuuugccuucagccaauugugccaaacaaacccaggagggaauagcaaucacuuggaaauuuagaugccaacaccuaggaucaacucuagcuaaaaaacaagcaaacucuucuaugugacaaacaugaacuaggacuaaauacuuacacauauagauacugcacaguuucuauaugugcaguauauagaauauuuuacauauuuugaauauuuuacauauuuugagaucauaucagauuuuugcuccacuauaguauauauuauucuuaaaaguucuaaacaagacaaugcauucuuugagcaguacuuaagaguuuaucauuaggaaauaucugcagcacuuucaauggcccaagaagaaacaauucuauuggagggcaguggguaaagauaucuagaggcauuuagugugcgccucccccaugcccagcaaagcuucaaugcuacaucuauauugucuuucucaguacaacagcccugcacagugaauauuauuauacccauuuugccaguguggaagcuggggcucuaaaagccugaguaaccuacaugcaguugcauaucuacgcaacagcagggcugagacucuaucuaguccugcuccccccaggagggccuggaagccauucagcuuccuagcuguacugccuauuccacauuuuaaaguuuaaaagagcuaaacccuucaguuuuagcaagagcuaagaaagucacuguuuucucagcaccaaagucuuucuccaggaauaaggugauucagcagcccacuagcugagugacaugcagacagucccgaggcuagcuuuccaauaagccccuuccaauucuuugugugauucagagggaggcccguccaucucuuguggcccauaggaaucaggcuuugaucaauuccauacaucagauguaagccccuacucuaugucagcacugggaaagugagugaggacccugguaaauacacaugacaugaggacagaacuguacguggaacggggaagucagggugugugauaaaugcagcuuccaugacugaacauggugcccccaccguuaacugaggcugcuugcucguauugaagcugucaccuugcuuccauuagauggaaauuuggguugugcccaggccuuagagugggcacucaucaucacagcaggcagaaggaugggucauguuuccaugugacuguguacagguaacugggucuauagguuuuccugaauucaaggguaauauuucaccugaaugaugaacaauuaaauagcaggggcuauuuuucuucuacguaggcugaggauaucugcaaaaagaccugaaaugugcugaauugacuguugguuccaaaacugggaaggguugggguuggggagagaaaggguggggacguuguucuguguuguuucuguuuuuaauuaaacuugcuuaauuucauuacccaggguaacugccuuugcauuuucauuuaucaacacauaagccauagucugacucuacucagccuauggguaggagcuggcaagggcagccucaugcagaagggauauagaccagcaugacaggagguggggauacaguggcccccaacacagugggagucauugagugguccuccacuccucuacccuugauuuggccugggcuuuguccauugaagucccugaagggccuuucuuaagacugagcuugcacaggagaagguguucugcugauuucauaccccaggaggcuucugucuaugaacuuugagcuaggacugucucaugucuccaaauaaacugccucuucaugucccugcucacucagugugagcucuacaaaaggaucacacuguuccugaagacuuaacuuccaucccaaugggacaauuucagguucaguuauugcauuuuggucaaaauugcugauuuaaaucaccuuuguuaucaccucucucccccccuucuuugagucuuacugaggugccaagauuuaauccgacagucuuuuucugaauaucauuuuuaauugauauugauuuaucauuaaaaauaaaaugaucaucaacucaaaacacuuacugauaaaugacaaaagcuuucugaauauaacuuucaaauucauauuuuuaaaagaguauuuauguagcaaaggagcuuuauuuaucuauuuuuuauuauacuuuaaguucugggguacaugugcagaacaugcagguuuguuacauagguauacacaugccauggugguuugcugcacccaucaaccagucaucuacauuagguauuuccccuaaugcuaucccuccccuaacccccaccccccgauaggcccuggugugugauguuccccucccuguguccauguauucucauuguucaacuuccacuuaugagugagaacaugcgguguuuggucuucuguuccuguguuaguuugcugagaaugaugguuuccagcuucauccaugucccugcaaaggacaugaacgcauccuuuuuauggcugcauaguacuccaugguguaaaugugccacauuuucuuuauccagucuaucauugaugggcauuuagauugguuccaagucuuugcuauugugaauagugcugcaguaaacguacaugugcaugugucuuuauagcagaaugguuuauaauccuuuggguauauacccaguaaugggauugcugggucauaugguauuucugguucuagauccuugagggauugccacacugucuuccacaaugguugaacuaauuuacacucccaccaacgauuuuuuuuuaaccauuccaacaucaagauauuauaauugugccaccuuaauaacaagagcucuccaggagucaggaauguugauggauauuaagggaugaauuuaggaacaauuaaguacuggaaaaaucuuugguugguuucugcugaugccaucuacaaaaggaaaacacccaucuaccaaaagaaagcaaacgguagggagacuaaggaaaaucuaggcaaguccccagacugcaaggcuagagaaaaugaauccaccuaaauacuugcagaacgcaaagcacaccccuaacuuguaaauauauuguccucucuccaguuacacagacauugguccuucuccucucucagauuuugguccaucaguuccacuacuuugauagcucuuugauaccuuuaagguggugucuguuauauugcgucuggcuuuuuccauugcucuccuucccaaauugaacuagagaugcuuuuagaugcaaugucccuguuuccuuccucccugcuccuuguagcuccuucuggacgaauguccaucguuaagaaccugcagaaccuggaccccagccacaggauaagugaccgggacuacaugggcuggauggauuuuggccgucgcagugccgaggaguaugaguaccccuccuagaggacccagccgccaucagcccaacgggaagcaaccucccaacccagaggaggcagaauaagaaaacaaucacacucauaacucauugucuguggaguuugacauuguauguaucuauuuauuaaguucucaaugugaaaaaugugucuguaagauuguccagugcaaccacacaccucaccagaauugugcaaauggaagacaaaauguuuucuucaucugugacuccuggucugaaaauguuguuaugcuauuaaagugauuucauucugcccugucgu

SEQ ID NO: 16175 - RNA, 3161 nt, Homo sapiens
cuccuucuuugugccuguuaugaccuacccucauuaucagagacucauugugggaggggacuacacaaggguauaaaucccaggagguggugaacccuggaggcuaucuuagacuguaucacaauucucuucaguuuucauuuuguaauuuuucucuggcuauguaagccccacuucgauuuccgcccauaugaugcugacuuucaaaagucuaugucccggcuaggcgugguggcucacgccuguaaucccagcacuuagggaggccaaggcgggcagaucacuugaggccaggauuucgagaccaaacuggccaauauggugaaacccccaucucuacuaaaaauacaaaaauuagcugggcguguuggcagaugcuuguaaucccagcuacuugggaggcugaggcagaagaaucacuugagccugggaggcgcagguugcagugggccgagauugugccacuaaacuccaaccuaggccacagagugagacucagccucaaaaaaagucuguguucagcccagaccucuacauugaccugcaaccuguauaugcaccugcuguguugacaucuguauuagucaagguucuccagagagagagaaccaaugugauaucuauauaucuacaauauagaucuauaucuauagauauaugggaggggauuuauuaggggaacuggcucacauaguuauggaggcugagaagucccacaauagaccaucuacaagcuggagaaccagggaggcugguagacugcuucaguucaagacuacccugucuuagacuuggccucagaaccagggaagcugaaugguguaucucccaguccaaggcccaagccgggagaaccuggggaaccacugguacaagucuuggaguccaaaggcucaauacuugcuaaaugaauaaauggacggacucuacuaccuaaucuccuagaguuaggagauuaggggaacggggaauucugaugccaagggcagaagaggggugucccaacuccagaguagagaauuugccuuuccucugccuuuuuguucuauuauguggugccugcgcauauuagaugaggacagaucuuccuuacucaguccauugacuuaaaugccaauaucuucugggaacacccucauagacauacccagaaguaauguucccccagcuaccugaguaucccuuaaccuagucagguugacaucuaaaacuaaucaucgcaaaauccuaaccaagucucaaaggugccucaaauucaacuugucuaagauggagcucaagaucaaucuuaucuccucuuccaguguucuccauaucugugaaucccugcaccauccauccauuuauccaaggcugaacaguggcaucauccuugaagcugcuucaucgccccuucacauccaacucaucaccaaguccuauugauuuugcuccuacauuucucugcagccuucuuagaucucuuuuucuucacucucacccuaguccacacuccagcuccauucucucuugcccagaugacugcacuggcucccaggccagucccaccauagcucuguugagacuucuccauuuugaucugcacuuuagcagccaaagugaguuuuauaaaaugcaauuuugaccaguguucuaugguccuaaacuuuccacuaugguccauaaaauccuacaugguccugccccuucuauucgcucuaguggaucucacuccacuccuuuauucucuaaacucugaguuucuuuucuuuuugugguaaaauguacauaaccauuuuuaagugugcagaucuguggcauuugguacauucacauuguugugugaucaucacuacuauccauuuccagaacuguuucaucuucuccagcugaaauucuguaccuauuaagcacuaacuuuccauuucccccuuucuggguuucuuuucaucccucaaaggagcucugcugccuuccacagaguucuuauauacaugcuaaucucuccaucugaaacacacuuccucuccccuuugccuaguuagccuccugugauucccaacaccagccuagaagcuucuguaaauucucccaaaaccccugcuccucccugaagagcaguuuguauuuauacagguguuugauuguuugaagggugcucucacccugccuccucucuuaacauaguuuuucgugucaggaauuccucgcuuuguccacaaccccuggcacauagcaggugcucaauacuugcuaaaugaauaaauggacggacucugcuaccuaccuaaucuccuuccagccagucauccaucugugggugccucgguccccagcuuggggugugucccccugggucggacuuuggcgccccauccaggcuggcaguagguugugcucuuugguuugccuaucucgggccucccgcccagccgcgcggaccgcagaacauacgccccgggcguuaucacucugucacgcggagccuccccgccuccagacgucaguccgguugcuaccccggcaggaaucgagcuuagaucacgaaggcuccuucucaccuccggacgugagaauuacaggcuuggaucucaaaccgccgcggugagagccgggaggugggaagaaaguugggaggcgcgcgcccccgucacacucccucuccguuugggucgcagcccuuuaagaaccacuacguucgcgccuucgccgggacgggggcuguggaggcgcgccgggauuggucgguuugggugcgggugucgcuuagcagcagcgaaugcgggguaggggggaggugggguggcucaagacucgcgcacgcgcaccacggccuaccugcgccugggcugccggugaccugggccgagcccucccggucggcuaagauugcugaggaggcggcggguagcuggcaggcgccgacuuccgaaggccgccguccgggcgaggugagggcuggcgggcggaggcgggugccgcggcccguuagccaagagcaggcggguuaggguguggcgcagggcgggcccagagguggaggcggcccagggcccacccggcccucagucccggccuugaccauggggcuccccacggggcuucacugggcuucuuggaguccucuguccccuuucucccgucagccuguucccggaccccggggccacccaaggcacgcg

SEQ ID NO: 16176 - RNA, 58251 nt, Homo sapiens
accagcagucccugccccguccucaacacgcaccgaguaagggucagggcccucgcgggcauagaucuugggcaggccuggggugucggccuccugcuugaugucacaguaguagggcggcgcagcuggagugcagcuggcagccggcugggccagggccacagugcccggaccuggugggccuagagagcgggcguccagcagcucuuggcaggacgcagcgaugucagccaucugcagcaaugaggcggcgcugagcaccucguggacguuggccgcguugaccagcagcuuggacguauagaugaaguugaggaucugcugcaggccaccaggugccagugccuccagggacagcuccacacgcugcagcugcuuguucugggugaagagugaguggaagaacuggcuguaggcggcuagcacacccuugugugccggaaagacgcugcgcuggggcaccagcaccaaguccacgucgcagaggucaggcuggaagaggcgcugcucguucaggcggcccaucaagcaggcaaagugcagcgccacguccuccaccagcgagaacucagccgccggggagucaguugucuucucaaccagcaacugcggggacagagggcacaggagugggucaaggccagugggccccugcccgcccuucccccagcaccacucccagcauugccagccauccaggaggcagcccaucacucguggcuccacuuuacagcaacagagccgaaacuagcaaggaagggauucaagccugagugagcugccucagagcucaggcuccacucgugacccucugaggcugaagaucagguccugucacuuucugggccucugggucaucuccugggaaaugggaaaagucaucccaggaagggaaagggaaggaaaggggaugaaagagagaccacagugaccaaccauccagguuugccagggaccugggcauuuucuggggugcagggcuuucagugcuagaaccaggaccaucgcaggcacaccgggaccagguggucaccccaggagggccacaggcauuccuucagcauuuccucagccccguggauucucuccacauauucacucacacauaccaauaaaagcaagcuugcccagccccaaacaccucaagaacagaagccgggcucacugcucacugcccagucucuggcuacagaauccaagggguagcaccugagggaaccccucaucgcaacagccauguggcugcugcagaaguugaaaccugugaagaaauccaggcucagggccuauaccuucuccccacucugguccugcugcacugccuggugaggucuccucaucacagccagggcuugggccaggcugcccccaaccccugccugcagccucaggccuagcccccagcagcucucucucacucaggggcucugcagggguggaaggacacagcuguggaaccugccuaccaugcuugcaggcaggaggcccccaaggccugccccagauccuuuucccgguagacccccagaccccaggucagguacgguccauguccacaggcucugggaaagcccugccuuagaggccacaccaucuggggcuuccagagcccuagcggaggcccucaaugucugaugggucagacuaucaggccugugggccacauccagcaccugugaauugccuggaauagaagccaacucagucaccccggcucuaccacagcagccuccccaaaaggugggcagcacagacaggcagccugcccagucccugcacgagaaccaucacacagugaugugcagauguuguuaauauccaccaaccaccagcccagcuggaccagcaccacugguuccaaguucuggcucuccucagggccugcccaaccaggucugagccuccugcauucgggagguaccuugccacaauauuuugauggccacaaaaccaucagcuccauagcugucagugccucccuggggacccugggaugaauccuggccccauccauccacagccuaccgccccccuuccccaugccaggccuuccaucgccaggagagcaguggguaggcugggauugggcaggggugguggugguugagcuccacuucucagucaccugaaugagaaaccuaccgugggccucagcaggagccucccugagccaccaggggccaccugucuccaggccugcccuggacccugcccccuacacccagcagccagggcagcagccauccuguguucccucacaucccagucuggccaggccccuggccaaggcuaccaucuuccuugaguucuccacuacaccccuuaccccagccaagaagccauccaucucccucugucccaggcuguccaggccuggccaaucuaacugggacguggcaccaagccccucccaucucccuccucugacucauucugauucaucuucugggaccaaccccuacuacacagauggagaaaccgaggcucagaaugagaggguuccacaguccagagccccuggacucccagcuccgcuaagaccaccccuuccuugcuagaccccacauggcuggauuucugagccuuuaaugacuuaaaaagcgagaacaucccgccaccuggagaccagccgugcuuccccacacucaccacuauccccucuaccugcucccuccucccuagagccacugcaccugcaggucagugaaggaucaggguacaacuuggguugcaacaggggcuccuuagggccuccaggggccaaagacuggcaggagaaguggcuuggauaaggguuugcugaagccaggccuguugggggaaguccaccccaggcaacagagccccagaucucucugcucucccuuuauggaaugcccuccacugcccaccugugcccaccugccacagggaaagggcaaccuucccaugugcacuuuggccucuaggccaaaugaggccugacuuuggcccucuggccucucagcaggaaaggaggggagugcuuucucaaacacuccauugcuaagguaguacucucagccaaggcagcaccauccuuggcccuuggggggcccuaaaccucaugaccugauuggacucucuugacugggcacagagaugcugcccgaguccacaauuggcagccccucagcaggguucagccacccccaugucuggccccucccacacaaugcccaccagcugugcuggccuccacagccagaugugcugguucccggaagcaaugcgugccccuccccauccggcugugccagcugcaguccaggucacuccagccuagcuaagaugcaggaccagggagguggucaggcacucugguugccaggggguuucaugcccucaaacccuugccccaagucaggcuggggauuggccaggugccagacaucucuccaggcugcucacccaagucagagccuucuacaccugagggguaccuugccucacugaugagaagccucaucucucuacccugccucagagccucccuggaaggccccaugaugaaaccuggggaguccaucugcgccccccucccaugucaauucuuucuaugcugggcagcagugggggggcccagacugagcaagggggcacaggcucaugaccucuaggcuccuccuuuuggugagggaguguccaugccagccuccucugugcacuuaccuccccucuuucccuuggaaauagacccagagagggcgggggaucugcccaaggucacacaggaguugguacgggagcucuggguguccucccacacccccuuggcccgggucaucccgaauccccaggcagggcggcuccagcgcccacguggcccaaggcccaggcgggaauccgacucccucuuccccccauuacccagcccgagggcggcgccguccgggcgcaggggagcgccccccuucgccggugccuagcaagaccucagccucgcgcgccggcgcccccaccacaggaauuuaacccccuccccaccgagagcagcgccacagcgccgcauucccggcccgcgggacccagcagauggagccgggagaccgggggaggggggaagaucccuccagccccuccacccgggcccgcgggccgugugccugggaggucagagcuggcaggugggcggauaagcggggggacaggcagggcccugcguaccauggugccguggcgcugggggcucacagggccccgcgggaucgcgcugcccccggcggccaggccagggccgcuccaugaagcgccgcgcugggggccgcccccgcgcagggccccgcgaccauggcccccgggggcgcggccaggcaggcggaggcgcagggccgcggcgaguccagcgccaagcagcugcggccccagagccucgggcgcggcgggcggggggcgcggggcgccgauuggagcccgcgcgucagcuggggccgccgucuggacgcuuaaagggccaggccgccugcgugccggcggggggcgcggacacgcguggugugcgcgguccccgugcagcccgcccugccgcaggcugcccuccacccccagccccagcuccagcccccagcccguccccacugcucauauccgagcagauagaccccggccccacccucccgugcugagccuccuuucugccgggaaguucguccgggagucaaacaucgcugcccuccgguugcgccacggagggggagccaggauaggaagcugccgugaaaucaggaagcugagcgcgccgggccccggauccgaacagaaaaggcuuccacccgcuccccugagggaucccacgcugagggacugaaccccgcaccccagccgcgcucaccacccccacccucucgccugggcugcucugaccugggggugagucugggguccccaacugguccagucccccaucccuaucccagggcggcgcagggcucauuuugcucugugccuccaggacuuggcuccaguggacccauaccuaccuggcggccucaugcugcauagggccacccagggcaggagauuuaaaucccaggacuacaaccgcagcgaucaaaucaucuaaggugacuggcccagggccaggagacagagggaccagaggaguagggaccagaggcccaggccccacugugccccucuagccgugugaccugaccacugcugaguggcccccuugcucagccucugcuggggagaugcagccaggcuugcggaaugcugcucuggcauggacacccgugggggcagggggcuggcucuguuggcaggaggcuguaaaggaaggcugccaggcugagcaggcagcaggguggggaccacggggcacuagaccuggcaaggucuggauggugacugggccaccauuguagaggagaggccucuguggacauccccuccuccuaccccaagcucacuacugcccauccugggucacucucauguugcccccauccugauauuccacaccccuccccacauaugugcgcuuguguuuacauacaaguccauguccagcugcagcaguaucuccuggguauguuguccuacucacgagugggcaggaacucuggcgcuggcucagggugacuugguucuaggugccagaggagaaauggaggagagaccaggguauuaggcaggugcugugaaacagccugauggucuguccuguaagauugcaagggccuccucccccacccccacucucugccagaauacguagggccucaggauaaggcuaucccagagcuagggagaaaaugucucaggggccaaaccuggggcaucuggaagccccuggcagcugcugcagacauccuguaccugcaugggugcacagacagcuggcccagcucccagaggccccagguuaaggccaggccagagcagcuuacaugcuucugaccagcuagcccgcugagggcugccuucugccucuuccuccccagcccacuuccucaucugacucacaguggauccuagcaccggcccaggaguuaguuagggaggggcugugugcccauugguuggauaaggacucugaggcucagagcgggacaaaucacuuaggcaucagcaucaggagccaggggaaggggagguggggagaagggaccccuccacgggcuggaagaagccuggcagagagagcugcaugggacauugcuaggcccacugccaagccaaagcuugacagaggguguggccagcgugacugagguagugaugcuggcccuauggggccuugcuggggccuuagcuccagcagucaagcugcagaaagggcuggagguugggugagaagggaggggacaggugguggggaggcacucagucucccugaaggccucggcuguuccccucuugcuucucuggccugcagcucaucagcuggggagucccagggcagagccugagcucugugagcagcugugggcaccuggcaacacuggaccuggcaggaaggagugguuugaagagcugucuggugggcccacagggcugcucagagcugaggcuugaacuugaacauuaacuagagcaaugagggagugaaagggcuuuccagacagaaagccugcaaaggccaggagguggagacaauuuagcaucugcagggaacuagaggggauuugguguaguggagucaagauuccuaucgaucaggaguugucugguuggugggagugaacagguggagcuaggcagaggcagaauuucucucuugguccugaugaggggcaugcaguaggagcuucacuucagggaggucaaggcaggcuuucuggagggagggacugaguuauuggggaguugacuccugggccagaaaugcaugccccaggggugagucaggagucuggagacgcucacccagcaagggcagagcuuagugauccuucacauauuugggauuggguccugacaaggucagcaaagcuaugccccugccucuagaagacagcucauggguuuucucucaauuucccuaaguaucuacccucagugcuggaguguccccaggcuuaguuggggaaaccagauucaaccccacugaaguuagaaagaacagcccagguuguggguaugcguaugugugugggaacaaugcaggacugagucagcccggagggcauggagcuguguguagcugagccuggggaagagggagagcagagugggcaaugccagaaaaauacaggcaaugcaacucaacucgcacagcauguggccagugggcuggcagggaaguucaaagcuacccacuaggcgcugauccgaagcccaaaguucuaguagggcgggaaaacaugaauccccagggugugggguggguuaaggguggaguuuacaccugaauucugccuccacugaacccagcacuaauaggcuacagcugcccuggguugggggccucaugcaaaccgguagguugccugguucccucacagcauaaacaucauggcuuuggcauuucacgucucucuugcagcuucuaggauccucuccugcccuguugguucugggggccuugggccucucccuagugagugaaccuggcuccacacaugaacccucugggacuccuucacuucuccuagagucaccaccucaggggccaccaccucugaaccacugauguaugcuugguuuucuaaacguuuaauacaccacaguucuaggaggaggaaucccuagcauccauuuuucagaugagcugaauuauagaggucaagcaaauuguccuccuuccaguuacccaacugggaaguggcagaguugaacuugaacccaagcagccugguucuggcccagagaccuuaacgauuguaccauagcauaguugcucauagaagucccccugcuucuucaaaauaaaaccaaauuaggcuggaggcauugaggucaguggggacucuucuuaggcuuucucugggaaccuggccugaugggagauuuuaguugcuagagguccuaggugaccagaggcuggugaagugccagccuauacacccaaccccugugggccagguccacugggaggcagacucgucugcaggcugggaagggaugagcaccccugguugucucucaugucugagugugccagucauguauacccucuuucagggguuuaugagccauaggaggcccaggaucagggcucaagaugcagaaugcagguguuuguccugagaccucaggucacuccauuuguuguuucucagacagggucuugcuuuguugcccaagcugggcagagaugcaaucauggcucacuguagucuccaccuccuaggcucaagugauccucccaccucagcccucugaguagcugggacuacaggugugcaucagcaugcccagcugcuuuuuguucuguucuugucuuaauagucuugcuauguuguccagacuggucuugaacucuuggccucaagcaauccuccugccuaggccuccuaaagcacuagaaauauagguggccacuccuuuuacccugauguccucaaggcucugggcugaagagaugcaacccucuccaagcuagccuggguucugcaggcugugaagcucagcucagucuagggagcuggaguuugaugggcuauaguaaguggugggucuggggucuccaagaggcagcaggccuaccuggggccuucugauucacagugaggaguggaggcagcagcaagggagcacuaucucuaccuuguacugaaacuuugaaagaaaacagaccacuaaagccuccuagcccuguguguauguggccagggcaggcucuccuugccuugcacuuaccaggccccgacaagcuucccagucuguccugagaugaacagguguucuuucaggguacccagcguccuccccugacaccucuggacuccugaggggccuuuacugcaucaaagaacuucucccugcugucuucccagcucauucuaccacaaggcccucaugggccugcaggcucuugccucacuguggggaacagcagacuugauucucuguuccaaaaaccagaguucuccggaaaucugaacccaguccguuucaccuugugaggcauggcuuccacauccuuucaccugaccacauuaguuugcaacacuccuucaaggcucagcauuugccuugaaaaacugaguagagccucuuuuuuuuuuuccaguggagacgggauuucaccauguuggccaggcuggucucaaacuccugaccucaagugauccacccgccuuggccucccaaagugcugggauuacaggcgugagccaccaugccuggccaccucccgucucuucuaaacagugaugcccaguuaguguccauaaucucuugcaagaggggcauuuuccuugaauuaccuucccgccuauuuaaugcccagcuaauucagaagagucaagaccaaaguccuuggcacauuuuccccccaauacugcccaacuaucaaguuuaccacuaucagaacuugauccugcauuuucuuuacauuuuaaaggaaugcauccagauuugacaaauuucaggaguugcccaacuaaggaguccacuguuaacucaguuuaaaaacugaguaucugcagugagaaguuaacuacaauaaguuauguuguauucacuaagaaaauagacauuccuuucaguucugaggagacaaaaguuaauuguacuuccccugcaaauucuuauguguauacuaaaaauaucaccaugaauguuuucucugggagugagugacaugugcugcacugccuagugcgcugccguuagggagggaaauguagaggcuguagguaaauggacugucucuagguagaaacucacacaugggaugugacauauuccucccucagcaaagacaucuuuaugcaggucauuuuaacuagaugacaacaaaguguagaggaaaucuggauuuuccaggggaggaagaccaaacaucauuaaugcuuaccuguguagguuaaaaucucugccugacauucucucuagcuccaccuccuacacccaccacuaacacucagcuaggagaagaaaaggagcugccaaaggagaugaggugucuucacuggcugggucagcagaaagauaaaacaugaacagacucagacuuagacuaaguauauauuuuaauuucuacaagguccccuuucaaguuuuagggaaauuuaacugaaguguauacaaauuagacauugcuaauauguacaaaaguauuuuauacaguuuuugaacgauacuagcuauuugcaauaaacaggauguuacaaaaacaguccaauaaugcauuuccuauuaagaagcacaauacacaacauaauucaauuuuauuaaaaaauaacuucaaaauguagaacaauccccuuuaggaagaaaagcuauuucuguaguucacucugucaguaaacacacaaguugaacgcugcagcagagggcuguccuuuuccauggagaaaagaaaugaggcuucuagggccuaucuuuucuggguaaaaauuccaccuacagcugagaugggcaguuauugccugugguaggcagaauuugaaaaugccccucccacuuucaaugagcuaaucuccagaacccgugaauaugaugagaugagacaguacuccugcaauuauguucuaucgcacaaucaaccuuaaaauauaucugugggcuugagcuaaucauaugccccuaaaacaggaggacgggagagagauaugaagcaugagaaagagcaggaaggcugguuugaagcuggaggggaccacauaagaaggaaugcaggcagccuugaggugagagaggggccuccagcugagagccagcaaagaacugaauuccgccaacaaccugaaugaacuuagaagcagauucuuccccagagccuccaugaaggaauguuguccugccaacccuuauuucagccuuuaagacccugagcagagaauccagccacacugugccagacucaugagcuacagaacugcuauggguauuguuuuuuaaacugcuaaauuugggguaauuugucacacagcaauagaaaacuaauacacugcccaaggguaacuuuucuuaaccuaauuacauuuggcaguuucugcuuggguucugaaugcauuuuuuuccugcugacuaguaguaauauucuccuuugcaggcaaccuuuggaaaccuuuaauauaaaucauacuguuuuguauucaguauccaguauuguuuguuuggccuaaguccuguuuucuaauguacuuucugucuauugaccuggcaaacaacugaccaccuuacccuguuuucauaccuucuuugggugauaguuuuaauacauucaagggcacccucccuccaccaaggguugucagcucccuccaacugagggcucuuuuccacuucccaaauacaccagacaaggccugugguaggguggugcugagcucuacaucaggcaaccaauaugaauuucuucugcauaacuggauuaaacuggcacuaaggugauuaaguacacuuggggaacaaauucaaaguaaagauuaaaaaaaaaaaccacacacacacacacacacacacacacacacacacuaguuuuuacagguccaauuauuuuuggaggaaccacccaaagccaugaaaauauguaauuuaugcuauacccucuaucccucuuccccugucucuugcaccugggucaggucacgcaaggcuuugagucagcugcaggucacaguggaaauaggaaaaacaugcugguuacaacaguucagcugcuguugugguaauauccuguacuugaaagacuugaaaggaaagcccugcaaaaugucuccaggaugguggcaguuagauuuuugauguuacuuuugaaguccauucuucacucuuccagaggcacacacacacaguagacuugaguggccaauaucucuuacugccaauccugccugcuccaggggaccccaacccacaucuguacuugagagaagccccccaaauagucaaagugaagacagcucagaauaaaccauuuuuggugccagugauuuugucugaauuucauuuuuaugguauuuuaauauaugauauauaagaguaaugcuuaaagacgcaccaaaaauuaccaagcaccaaagcaugaaguagaauuguuuuuauaaccuaaacuucugaucgguauugauuaaaaagaacauaaaauaguaaguccucagagacagugcagguauuuauaguuaaggcugauugauucuuccuaaccuugcccacaagccugaaguaauacagacugugugggauguaugaugaccacuuuccuaauccugugaaguaucaaagaaguuaggaaugaauuaagaaccccagagccacugccuuauacuccugguuaccaacaguaucaauucugggugguuuguuuuuagagcacauauguacaagacucuauguaaucaguauauaaauauuuggccgccuuuaacaguucuccuucacaguucuaugcuuggcagcauauaugcuaaaacuggaaaaacaggcaaaaagaaucuguauucuaagggauacguaagauagagugaaauagacuuaaaauaauauugcaaauuauacauagauaaauuucacgauuucuugauucaagaaaaugaaauucauuuccauaguuggcuacuguaaaauguggcauaaaaauauuuuuaggagacauaucuguauuuuaaauucuucuccccacauguaaaugaaccaguaacaauuaagaagugucuauuuuugaaauucaccucugauauugaaauagaacaacagacugucauuacauuucuuaagcuaaguugccagauauuuacaaauaagauauaauuuguauccggacguuuucaacuguaucugcugcucucacuggggcuccggugaugagaguaacuucggucacuuucacugucagagccauaagaucuacaacuccuguaauaacaaaacaaaauauauaaaaaucuuguaacuguaaaaucuuugaauuccucuuauagcuuguuuuuuauaugaguggcuugaaaacaucaauaguguuuucaagccacucauauaacugaugcacuauugaugcagcauaacacagagguaggguacugacuauggcaacaccauggacuuuucuuuuucuuuuugagauggaguuucacucuuuuugcccagguuggagugcaacggcaugcucucaacucacugcaaccuccaccucccggguucaagugauucuccugccucagccucccuaguagcugcaauuacaggugcccgccaccacgcccagcuaauuuuuuuuauuuaguagagacgggguuucacuauguuggccaggcuggucuucaacuccugaccucagacgauccaccugccucagccucccaaagugcugggauuacaggcgugagccaccgugcccgacucacacuauggacuuuuugaagcuguuuuaaaugacaaguuguaguaaugucaagauuaagauaaaauaaagaaacaucacaucuuaggaaauuugugugaaauucauucaugcaaaugcugggaccacaaaaacaaaaaaccaaugagcagaauaguuuccccauauuacccaaaaugaguaucaauauuugaauagauuaccugagaaaaguaauggggaaaaggugcacaaauaguuucacucaaggaauggaaaccaaaaugggguccaaugagggguggggguggcccugggcaugaacaggaccacugggauauugagucaagaggaccuggucaugggucccauucaguuauuuugaaaaacauucacugugagccaggcauuuugcaagaugcugggaacacacacacacacacacaaagacacaaaaccaaguauaguucucugggguucaaggacagaauagaauagucagcaagacaaguaauuuaggagcaaggggagccacaguaggagcaaagggcugucuuagaggcacaugggagggacuguauccuaggauuaggcaucagggagggcugcccagggacaguggagaucugcaggguagaugggaacuggccauuucaaguggcaaaaggggagauggugaagaggacacgugugucuccaggcagaaggaaaagucccaacacuuuaaaggagggaagccagaaagagugugagcuggaguuggugcugaggaggcuggaccugaucaugaaagcagcagggaguccuugaagaguuucaagcaagggaguauccagaucagacugauauuuacaagcaucauugcaguugcaauggacaggggaaggcaagaccagaagccaccagaaaaggacaguacaaaaguuaacauaaagacuuuugcagaagccaaaauauguuaaacauaauacauauaauacauaaaaaauguauuuuacuaaauaauugacaacauauaaaccucaauccugcugcugaagcaaauuauauuauguauuuuuuuauuuaaaaaaaaugagaaacuggcuacugcuagcaagugguucuauuuaagcaaguggccaugguuuggguggccuucuuucuuuccaaaagaaaggucuguccaagauaugugaauauuuagaaacccauuuuagauucaaacauuaauaauaaccaacaaauauuaccuggcaacucuuaauauaaaagccacuuuuaguggcugcuuguggguuguucagauuuaaaggaagaaguauuucuguccuuggaagauuauaccacuuucucuuccacuagcagcccaucacccucccacaucaagugcccaccguggccuacagugcgauaaaggacgauaaaggagagagacccaccuggaccgccgauuauaacuucugccucggugguaacugucacuucucuggcuucuacuucgacuccgacuccugcuauaguagcuaucguagguguaggaccugcuuuaacggcaacaacaaacacuaaauuuucccacucagauacucauauguuccuauuucuuuuuaggaucucaggaguguucuagcuuagaacaugggcacuaggugacagcaugaggauauauuuccaaaacaaguacuggaaacauuuaacaauugccccaaaugagacuuaccauaauuaaagagaaaaauguuaauuucuuuucugcauugaaaaauaucacaaaguuaacgaguuaguuugaaccugguggaucucuguaggcaauuauauucaauaaacaccugccauuacaauuugauauugucauuuuugacacuggaguacaaugggccaacagauaaaacuugucgaacagaccucauuuagaaaagguaugguuucaggagacaaauauaugcauuuaguuacucaauaaaauaccacuuugaacaaacaguuuacaaaacaagaucuuucaguucugccccacuggugguuucccaaucccuguucauaccuggaucgacuguggggaucauaugagcugcuccuggaucugcuccugcuggacguccuaauauuaaucacaugaaggaccaucaucuuauagaucagggcaggacaggcuauaccaaauaucuagacauuuauuugcccaucaaggugaaaauacagugaaaucccacagcuacauuuguuuuguuuucauaucaaaaguauauuggauuuuuuaaaaagccuauuggauuucauaagaucaaguuuuaugcaguucuucucugagaugcauauagucacuagggaggcucuaaacuggguggaguuaggggaaaggucuguacagguaggaccuuuguaaguaaagugaagugacagcaguagaaaauaccucagaugcaaaagagggaaagaagcuaggagaacuagaaaucuggggccacccuucccaccauauauauacuucuuccucuugguccccucucuacaaucuuccuaucccaaucucuaacccaugucaagaggugaaugcagauguaaaacuuagguuaaggaagaugcaugugggggagguggagguaggggucaaggcuucuuaaauauuucuacugcuccucuugccucacucugauaagaucccaacagaggaauagucaagaauuccacagcucuuacauagaaaaaacuacaugagaaaauaggccaguaguauauucaguaaugacaugauucuucucaacaacuacccccucugccuauguagccuuaaaaaguggacaugauggagaccacaucacagggugagaucacaagcucaccugugacuuuuguaacuccgguaggaacugcuccggcuucugguucggccucugcuguaccauccucugcuccgacuucuagaguagcuucuugaucuacaauuaaagcaauugaaaaaauauauaauuauguugacucaucaugauauuaaaauuaauuacugguagggcagaaaggggaaaacacaacaagaagaaaggccucucacaaacuccucacaguggauaugacagugucagcuaaugaggaacucucaaaacaaccaugguuaaaaucaaacagaagaaaauaaagaaaaacaagaaaagauuggcacaaguauguucauagaagccugauuuauaacaccaauaacacugagaagaaaauaaaccaaaucuccacuaaugguagaauggguuaaaaaaacauuaagguagagauauauaacgaaauauucugaagaaaaugaacuacagcuacauguuucagcaaggauauaucucuagaacacaauguugaaugaagaaggcaaauguagaacaucuauauauauaaaaguauuuuacuuaauaaaaagugcaaacauaacauuguauaaagauagaaacacuugggguaaagcuauaaagaaagacaacaaaauuauaaccaaaguuuagaauaaugguuaacuuugggacauaggcaugcaccuagggguggcacugguacaucaaagcucuauuuuuuuuuuuuuuuugaggagucuugcucugucgcccaggcuggagugcaguggcgcgaucuuggcucacugcaaccucugcuucccagguucaagcaauucuccugccucagccuccugaguagcugggauuacagacacgcacuaccacgcccggcuaauuuuuguauuuuuaguagagacaggguuucaccauguugguuaggcugguguugaacuccugaccuugugaucugcccaccucggccucccaaaguacugggauuacaggugugagccaccacacccggcccaaagaucuauuuuuuaagcuagauggcagguacaugaguauguauuauauagcuuuuuauacuuuuaucauuuuuuaugucuaauacuuaauaaaacaagcaaaaauguaagcaguacaauucugccccucugcauucacuuggcuccccacccuucuccccuacuuuaggccugucauucaggaacagaacaauaccucuguguacaggugacauuauguaauaucaccauagguuuuauucaguaugcacuauguuuuggaagacaugaccugcuuccaguauaucugcaagaaaaugaauacguuauguucuaauaagauuguagucauuuauucaaccaaaaauaauaaagccagacccugugaggugacugaacgaugaguaacacacaguuccugacuucaaggaguucacagccuaaugggggugucaggcccaggcagguaaccaaaacagggaggcagggcagcacccaggcuuauccaucucagucuacuaccuguuagcugcauagccuagaacaagucccuuagccuuucuacgccuugcugucuucauuacaaacugaaauaccacccacuccaaggcagaggugggaagguaaaugagaagaguggccagcaucacgaauagcucagagcugucucuguguaaaugguuaaggcagaucauaagcagacaggaagcuggagucgcucaauaggcaacugcaucuaucaacaggaacucagagagaaaaggccaugaggaagaagagaagccuagaacacagggacgaaauggccugagugggagaaaggagagcuagcagagggcuccagaagugaggcugaaaauacgccaugguacuggccaucagaaguaccugaaagucuuagucaguaaacuaagagaugcggggaggggaaggcacagaaggcagcaagcacacagccgaggagaaaaugggagaccgaguauagauggcacguggcgguuccuuuuuuaggaagucuggguaggcaagggaagaaagacugaugaauaacuagaaaggaaacaaacgucaaagauucuuaugguauuuucaguucaaaugaugaauaucaagcacaauaaaauaagggauaugaauaauuaagaaacagguaaaaccauaaaauauuuacaagaaaaagaaugcaacacaacugcuuacuaacuuccuauuaccaucacaaauauuuuuaguuuuuaauucucaucucuguuauccauucuaugcugacaaguuaugaugcaauuuauaacaauaacaaaaaaccuuuucaugaaggugcagagugacaaagaugagaaaaagguguuuuaaauucuuuuauugcuuuucaaacaacaacaaaaaucuaaagaugaucauuuuuaucccuaugccccaucuaaacuaagaugcaugucuugggcagguaacuuugucucucuggcccucaacuuccacauguguaaaauggaagguuagauuaaugaucugcaaauucuauauauucugucaauucaggauucccuucuaaggcaucacuugacuggcaagaagcagccucacaccuuuaaagauggagaauuuaccaccuaucaugggaacucauuucuagugacagagagcuuuaaacugauaguaauaguuuuguaaacccagcccaaauuucuccuccugaaauucccucucccuaaguuuucaaucuacucucugaaucacacaaaacaagacuucuuauuccuuucagauauuuggaaauagugauucugucccuaauucugauauucuuccaagcuaaacaauaacagacucuccuugggagaagaaaggaaagagaauauugcucaccgauaagaugauguggaacuucucgaucgacuucuugagugacuauaggagacagaccuuguucugugucuugauuugguuucagauuuacuucgagaucuacuuggacuccuggacuggcuaucaucaucccgacuaggcgucugcucaucacuugaacucuccugauuucuuggucuacgguuuaagcgugcugucuuucuuacuucaucaaagagagacccaggccgaacuuuauuuuugcuuuuaauuucuauucucaagccuugugguuucauuucaggcacaguggucaacaccuuaacuuccacagcacuggauguggcagcauuaggugcugccagguuccccacaccuugcaggggcuuccauuucuuaucaaugagguugaucuggcucuucucagccaccuccuucuucccgguacuuucuccagcacuagccaagcuagcagagcugcuguccuguuuccccacuucacccaacacuuuacuuucggacaugcugcuuuccuguuuuacuaccucugcuugaggauguuccguugccauauccugcuucaaaacaauguuuauaucugggguaucaagccgugcauuuccuagaggggaagucuccucuacuuuugcuggggaacuccuaucaggagugcagaucuccauguugucaucuguuugaagcacaucuuccacuccauugggaacacuuucuucaacgugcugaauguuuuguaaacaggccacauuuuccucaguauuuaaagcugugggagaaauacugaguuuacuaucaucuuuaguaaacugaucaagaucugaugaaacagucacuguaucauguuuaccugaaagguccucuucacuggauuucucaguuuuuagaauauuaucuuuuaugguuucauuguuuucagaaacuuuuuucucuuuugauuccugaguaacuugcuugucaucaaucuccuccuccuccucuucaccaaauucuaguggaggcugccagugaaaugcuugcuuucguuuuggagccuuaugcuuuuugucuuuuuucccuuucaauuucucuuucacuuuuuugguguguucucuuuuaagauuuuccuuugacccauguuugugcuuuuguggcuuuccccuauuguuuuccgaauuggaacaggaccccucagagucagaaguugaugugcgcuguuugcuugauuuccaagcaccauuaucaucaggcagugaaguauuuguggacgacuugguuguggguuugacuuugaugugaauuucacuaaccucugauucagaaucggauguggccucaccuucuuccuugucagaggauggaugggagucauuuuuacuguuuuuagugacaucucguucugaauuugacucagagucccauuuacuaccagcauaauucuuccuuuugggcuuacugccauuucuaaggugaucagaaagauucucuuucaaaguucuuuuuuuugaaugagggcauucccguucagacuuggauuuuucuucaccucuguuuuuuucuuguuuauuauguguucuuuccauuuggcccugcuucucuuuuuccugggcugacuguguggccugaacacuugacugcucacugucugaagaauaaucuaaagaugaucugcucucgcuauacuuucucacacaugaagaccugucucuaccuuugacauauuuacugugaagugucuuuucagagcugcugcuaugcuuuuuaugugaaacgcuauuuuuuuucccacuggaucuaagucuccucuuagcucgccuuccaucaucacugcuaauagaaguauaugaagaugaucuacuacacugugaaugaucacuguauuuauuucgugaaugagaucuagaugauggagaccuagaccuugaaugugaacuagcuagacuacgugaucuuguauaugaucuggaauaagaucuacuccuagaagaucugcuccuugaccuuggugagcuuucugaacuucuaucacuguauuuugaauaagugcucugaucacuuuccgaauuuuuuucucuuuuaugguaggaugaugagcuaccagucucuuuaauauuugcuaaacuguaagugcuuuggauggguagcaaauggguuguuuuagcuuucauuuccugaauucgcucauaagagggcuuccaagguuucuguccaggcuuccaucuugaaggggggggacugucacucagugguauuacaggaauauuuucugcuacaacugguuguacuacuacauuuucauuuugugccaugguugcucuuaaagguucuguuuuaacugguuuauuuucacuuaacugagaagcuguuuuucuuggugauuuugaugcucucuuucggugcccagacuuggaacuagaucuggacuuugaucuacuucgagaaugugaugaggacuuugacgcaguccuugaucuugagcuuccucuagaauaagacugugagugagauuuugaucuguaugagucucugcuggaauggguuaaagagcucuggacauccuuaucagauuuagaccagucucucuuugaugagugaugagaugacaaugaggaagaacgagaacuccuuucucuaucacaagaggauuucauucuucgaguggaagauuuugaggauucuaugucagacgguauaagaauccuucucuucuuuguuuguuugugucuucugcaguguuucugcuuuuucccuuucuuuuuaugcuuaaccuuuuuuucuuuucugcguuuuuuaugguggccagagugucuugcuguacuaaggucugaauaauauccauuauaggaccaugaucuggaucucugagacaagcuucuuucaucccaucggcuugaacaggggucacuuaaccuauagaaaggacauaauauucaugcggugauuuauaagcauguuuucuacaccuuaagacacagcuuuguuaacaacaaaguucuugaccccauuaacacuuuaagcacacgcaggaagcgugaaucagaguuauaggccuggucuuguuauacuuucagagacacacacuaagaacuacuaacaaauucacuuacaaaaggauuuuuuuuuuaagcuaagcaaagaaccuuacauuuguuaggaaaauguuuuugaaaagcaaaccaacuaaucacaagaacacugcugaacucaaaucacaagaguuccuggcuguuaucugcucacaacccucugccucuaggacaguuuuugagggugagucaaaccaaggucucaaacaauuuguugauuuucugaagaugcaggauagcugcuugaaacuagcaugaagcuuguuuuuucuccaccucagacagguaauccagauuuccccuaagacuguaaacuacuuaaaacagaaauugaggaaaaaguacacaaaaacagauacagguuacaaucugaguguuaaugucaaggcucagaacugaaaguccucagcaccacugugucugagccgcuucuacacagcagaugcauuccuuuuccuccuuuucacaauuccaaaccacucugcaggauguccccagagaaaaagagaauacuaccauggaagauuacacagggucccauuaguauauuuuucacuagcuauucuggggccuauccccuuccuaaaauaaauauucaacugugggacaucacugaagguaagagauguguacacuucuaaaaaagcaagucucugcgaucaacagucaacaugaacaccgagugcagguuuuccuauuuaccaaugaacucaucagugaccuggcuggcuaggaaagaaucugcuauauaauuucuaaguccuaauuauuuuuuuuuuuuuuugagacggagucucgcucugucacccaggcuggagugcaguggcacgaucucagcucacugcaagcuccaccucccggguucacaccauucuccugccucagccucucuaaguagcugggacuacaggcacccgccaccacgcccggcuaauuuuuuguauuuuuaguagagaugggguuucacuguggucccaaucuccugaccucgugauccgccugccucggccucccaaagugcugggaugacaagcgugagccaccacgcccggccucuaaguccuaauuauuucuaaaauugacuaagaggucauuaaaagacacaggcuuauaguuuuuguuaaggaaaacaggauuuugauuuaaaagcccaacuaguuaacaguacuacuuucaucaaguagucccaaauguauuuccuuuggucacagucugacugugaaucuuucacugaaucuuuaaugaaaaguccagaauuguauccaaucccuuuaacauuuaaaauauaacagacacaggauugugcuuauacucaaaguucuuacuuaucuccuuuacuccauuuuucuccacuagguggucuauaugcucuuaaucucugcauuuccucuuuccagugaggaggaguuucacugcugucaucaucaucugacucagaacaggaucuugaucuuggaggugugugauagcgcuuuaaaaacaaaaacaauaguauuuuaaaaaaugccucuccacgacagucugcuaugugacagaguuaaguaaaagacccaaucucagaucaucccaucaaagguaaugauugaaguuaccaaaaggauggucuaaaguucuuuuuuuuuuuuuuuuuuuuuaguuuuuaacuuuuauuuuagguucaggugaaguuauuucaaacaaggcauuaaaagagaugggcaaggcugagauucaccuguaauccacauaaaauuuuccuuuuuaaagucuuaaugauuucucagcauacucacugaugguuucacauguuccuccuuucauacucaauuaaacccauucaaacacagcaguauacuuugaucuaacagcaauaccuucccauaaccauggaaaauacaauuaguuccuugaacagauuuuguauuauaucuaaaauuaacgcuaggacuuugaaaauagguaaaaauuuuuuauuagauacauaauaucaaaaaaagucuuaucacacauacaauugugccccuuccuuuaaucuuccguccagacuuugauacagaugguuucugaucacuuacaaugggugcaacaucaggaaucuuccuaggaaaagaagauugugaugaaaauuaaaaauaagcaaagaagcuagaauuuuuaauaaugaaaacacauuauguuaagcuauuaauucaaagauacaugccauuuugcaauagcuuuuuaaaacaagacaauaucaggcuuuaaaaaauauuuaaugaacuaaaugauaacuuuaugcagagagcuaauuauaaauaaggacucuuauacuuuucagcuuucaaaauaacucuucauagggaacuuaucaaugacaccagccauuaugauauuucuguucaugaaacauuuucuuucaauaauucuaaacuugagucuaacacacaaaauacauuaaauacuauuuucucagaccaaaucuaaagcgacacauucacuuuuccaaugcaggaaguaauuguugaacaaguuaacaaaaguaacuuauuuaugauacuaaauuguaucuccaaucaucaugcaauuaauuaugcacuauucaaauuggaacccaugcuucaucacucaaauggauccaaagaauucaacuaacucucuauucugauaacuaaaaccucaccccucuaauaaaaggcaaaggcaagaagaucaggaauaaaaucuuuccagauccccaauaagggcuucccugaccaacuugcccaaccuccucucccugcuagaaugugaauucugaaagguaggguacauaucacucaauaaucugguaucccccauauuuccuacguaucauucauuaaucuaauacucccauacuaucuuucaaugugcuucaaacauggaucauguuccauacaugaguguggaaugcaaugagcugacggaacaguguuaucggagaaauaaaaauaaauaguuuagucauccuacuuacgguucagguucugcaguaacaacaggcauaucucuucucaguaaaaaucgguucucaggcacuggaggaaucucuucugggcggaccacagguuuuucccuuuuagcacuggaaucaacugaccuuuuuucauugguaucacuccucucagagugacuuagaacaaaccaagucacugauuaaaauguauaauguuugcauuucauaauaaaagcacauaaaauuaguuacuaaaacaacagcauaauuaacgauagcuuacaagucucacucaaaagaguuauaugauuuucacaaagagaacaauaucaacccagugaaaaacccaaagacuagaauuuugauaggaaaauuguuaaaugauccuaacuuuuuuauuuuaagaguuccaggaggccaggcauuguggcucacaccuguaaucccaguacuuuaggggucuuaggugggaggauugcuugaggacaggagucagagaccagccuggucaacauagcggaagacccugucucuacaaaaaauuuaaaaauuagccaagcauagugguauacgcccguaguccuagcuacucaggaggcugaugcagaaagaucucuugagcccaggagguggaggaugcagugagcuauaauugugccacuguauuccagccuggauaacagagcaagacccuaucucuuaaaaaaagaguucuuaggacuauuuucacccgaaaacugaaaacacacaaaucuuugaaaugaaaugccuaugcuaccuacuccuagauuugccagauuucaauuuaaaguuuaaaaagugcuauccuuuuucaauaacagguaauaaaauugaguuuauagaauuauacauacuuuucccauuccagaguguuuguuuuuagguaagaguacauugguguuuuacacguacccuuuuggguucauugcauguuuauuccuuggcucuucugaacugcuugcuuccuuucgccucuuuuuagaacguuuaacuuuuggccuccucuuauguuuccuccuucugcuucucucauguucaaguucacuuucugaagaugauucugaagaagaggaggaauuggaagaggaauccgagccuucugaaugaguugguuucuuccuuuuuuucucaaaaacuuuuaagaaacauuaauaaaaacauuaguacuaaauucagugccuaccuuucagaguaaaaaaugugauuacugaauaucauaaaauaugcuuuacauacagcaaacaaaaaaugaaauguagacaguuuuuuucaaguuuauaauaaaauuacuggcaagauuguaagguaguaagucccuugucuuuaugaagccuauauucuuguugggucaaguaacaagaaauaggcccggugcagugacucauaucuguaauccuaacacugugggaggccaaggugagcaaaucacuugaggucaggaguacaagaccagccuggccaacauggugaaaccaugucucuacuaaaaauaacaaaaauuagccaggcaugguggugcaucccuauaaucccagcuacuccagaggcugaggcaggagaaucaccugaacccaggaggcagagguugcagugagccgagauagugccacugcacuccagccugggugacagagcaagacucuugucucaaaaaaaaaaaaaaaaaaaaaaaaagaauugcauaauaugacaaaugauuaagugcuaagacagaaaaacaaagcaguguaaagggaauaggaagacuagggguaguuuaacauaacauuugaacagagacuuaagagcaagggacagugucaugcagauaucuuaacaaaggguguuccagacaaagagaauaggcagcacaaaaucccugagugguuggcaugucugaaaaaaggucaaugugccuggaaggcaaugaauaagggaaaagaguuuagagagacagcagagagccagaccagccagggccuuagagaccaccauaaagacuucugcuuuggaugauugaagaugggaguccuuggaggguucugugcaggcgugacaugaaugcaaacuaugguucaaagggaucacucugguugcuguuaaggacagaccacagcgggccuaggauauaagcaaugagaccaguuaggaggcuauugcugcugacaaaagauuauagaacggaggcaagguaaacaguuacgacgcuacggcaauaauccagacacaaaauacuggugguguggauaaggcugguggcaaggaaauaagaaaaaguaagaucugacaagauaugcuaaaagauuaaacauguaggguaugauucaggggcaccaagggcuauugcuauaccacuaguuccacuaaucaaaucuaguuacagucuucagcaaugcuuuaccugcaucuuagcuucaucuacugucaaaaaaguucuuaccaucuuuuauugauuuuguggcaaguacuccacagucaauaacucgcacaucugcauauggucugcuugcagcaucggucuucagauuuucaauuuguucgauuacuucaaaaccagaaauaaccaguccaaagacuacaugcacccugucauaauacaaauucaagaaacaacugguuugauaauuaagcuauaaacaguaaucaagacaauuaacuguaaucaaugacauguccacagaccugaaaauaaaaccaaacuguuuguuguaugaagcaacuagaauggaaugagaacuugaaaucugcuucauaaaaggaaacgauuaugcaaacugggccucaguuuucugccuuuaaaacaaugguucuuaaccauuuuaggguaaagagucugguaacauucagauuucgcuugguacuugggaaccuuccuuacagggacacaugauauuguacugcuuacuauccgacccauuuuggaaaacugaagagaaaaauaaaaaauaaaaagaauuauauugcugagaagcccauccaugagcacagauugacuccuucagucacaugagagccauggggucucaaaacaaguauauucugugauccuaaggaauagcuuuugcuaugagauuaagccagacaucaagagcgcucccuugagggcucaaccaugguccaaucucucuuuauggcuggccacccaaacacuuccccaauguaguaagaauguaacucuuacccauccagguguggagcaggcuuugugguacuauguaauaaacaucaacacaaagaugaugucaaacacgauguguucaggugaagagagcagaaagguuuaaacacagcauguagagaacaaagaaguaaagauaaaaagauaggggaaaaaguuaaacaugauauauaucuaaccuuaaaaaccccaaaacagcaauaguagccaucuuacuaauuuaaaaaacucaagauuauaaugaauuacaaucaucucuauuagacuauauguaugcauacauaugaaaucaguuugacuuguagccauaaauacacagcaugaauacacauaaaaauuaaaguuacucucaacuccaaaacaacaaaacaaaacacuuaaaaaaaaaaacccucaaaauuuaucagcguaauuaaauaagaaaagcaccuccuauuugcccuauggaaagaaagugauuaacauuugccccaaacacuuaaauguuuucuuguuauuucucauacugagucaguccacauuuuuaggcaggcagagguaggucucaggaguucuguuuccagaauuccugcccaucuuccuucacccaaggugaagcucugacacggcaacucugaaaaugcgauagggagaaaagcuucaaucugccaucccuucugacagcaaaaaguaaugauggauaacauugcagacauuuuaaauuuccuuggcccagaaaacacccaaccagcuucuucuacagucaccaacugucagacagucacucuugggaagccuacaggguauauuugguuaagauauuuugaacccaagcuaguuuucccauagcauuuucacagaucuucacauuauaugaauugcaguggaaaaaauucaaaagcagauaauuagucucagaauuauauacuacaagcaucuugauuuauaagaaugagaaacagauauuuaagagcuagaaaacagaaauuugaaagagagaaaaauaucacuagaugucaggccauguuaaagcagucaacuguacuagaagcugccauauaaauuucuguauucauuuuaaggcaauuuuaagacauguaagugaacaaaacccaguuuuuaaccuucguaacaaugcuaaaaauauuuauucuacaaggauuuguaaugcuuauacuuacauuaagaauauucgguucuguaagagcacuacagaauuuaauuuaaaaaaauuaaaaugucaacuuaagaaguuccagaauuuuaaaggaaauauuaaguuuuaaaagcaaaaaucucaaauauuccuuagaagauugaaaaguggaaauucaugccaauguaauuauaaaaauaaaaacaggcagcaaaaagaaaacagaacaaaaacuaucuagugaauuagugagccacuaguguuuaaaucauuaaacuagcauccagaaaccaccuuggaugguaacuucaagauagaaaugugcuuuaauuauaaaacuuuaccaaaguacacuaaagacaagaaauugguacagaagcuagugacucuauuauaugaaagauguaaagagugcuuuuauuuuuauuuguuuguuuauuuugagauggagucucacucuguugcccaggcuagagugcgauggcaugaucucggcucaaugcaaccucugccucccggauucaagugauucuccugccucagccuccugaguagcugggauuauaggcaugcgccaccaggcccaucuaauuucuguaauuuuaguagagacgggguuucaccauguuggccaagcuggucucaaacuccugaccucaggugauccaccugccucagccucucaaagugcugggauuauaggcaugagccaccacacccagccaaaagggcuuuuaaaaaaguaaauuuuucuacaguguaagggaucagccccaaauauuuagaaguaaaaacgauguaugguuuccugauuagauacauuccuucuccuucuuugauccguuccucccaugacucacagauccugcaguauuggggaaagccugcaaauuuuucuuaaaacauaaagagcccaauucaauuugccaucuuggcugauagaaaggcuguaaaaaccacuuuauggcaaaccuuuggagaaaaugguggaauaaaacauuccagaguaguguagcgaugcagcaacauacuacuugagacucaauuugaggauggaauagcuaucuuuaugacauucaaguuuaguuuuuaauucaaaugaaaacugccaagaauaggcaaacuugguccuuuauagcaguagugcagaaaacaaaugaagacacgaaugacuauuucaaggacaacucagccugcccauagugccuaaaccugauaugaaugauuaaaguccauuacuugcaucugcaacucaagauacagaaauauaagucugcacuuuaauuggauuagauuacauauuaagaauacuaaaaguauuuaacaaaaagaagcccucugggguucucaaccuacauuccaggaguagaaaucccaauguaaagcaggguuacuggcacuuggcuaauacguggaugaacagaggacauuagccaaagaggguuacaaaagggcggagagaaauaauauccacaauccagacuauucaauucuacuaaaagaggcagagagcucaucucacuaacucuuaaucuuucaaaaucuucaauuaaaagaaaaauugcauugaucuuaaaagcggcuguuuaaagagcugugcaauggugacacaugcucaguaaguuaaggccagaggcuaucaaaaauguuuaaauuuauauaugcuuaugaaaacauaccuaaaaaagaaaaaaccacaaagaacauuucaaauuguaaaaccuuucaauauuuaugcauuuccauuuuucucuuguacuuaaagacagugauuuuucaguuuucccgaccccugaaucuacuuuaaaaaacaugugugcaagguauuuaagccuuauaaaucuuagaaauugacaagugucacugcuacuccaaaaacaaucuauaguuuuauaccauuaucagagaaccuuuugcccuuauacagaaaugacuaauuccacacugaaaugagaacuaaaaccauacuauaaacuaauaaccccacucccccaccagaagauguacaggaacuugguggaaacaagccacugaaguuaaaauauaguucccaggauuaaccaugaaaaauaaaaugcacuuguuuuacauguacugcugcuauacagauaaagcagaaaguuuuuuuuuuucuuaaaauguuucaaugcacauaacaacagaauuaaagagauaaaggcaaagagagagagagccuuagaguaaugagacauuaccuuuggagcgcacgguguaacacucuuucuguaaauuuuacacaaaaauggcaagaaauaaauuguaauacacuuuuaagacaagacugaaucuauguuuuaauaucaauauaacuuugaaauuaauuauuuucaaguuuuaugcagagcaagaaagcuuuuuuaaauggagggcucuaaauuuucuuucauaugggauauuuacguagagaugaauuaugcuuaagaaaagcaucguggcuaagugggaaucuauuuagauccuuaauauuguaacauagagugccaauaauagcuauuaacauauuacauuuccuuucacaaaucccagaaauuagcuaagacaacauuuucucaaaagagaauaguguaucuugcauacauacauaaauauaaaaaucugaaugcccaggaccaguuacuaccaguugaaagcaaaaauuucauuagaaaaaagugaguuaagaucauccaaaauaaaauuucaaggaacuuuuaacuaauucacaucaaauaauuaaagaaccuuucaugcuucuacauuugaaaccuuuguuuggugacguaucacaacagacuacuuucaggaguuaaugagcaaauguucggacccuaguuacuguucagugauauuagauacacauugaaguuaagucacugaacauaauaauaaagcagcauuaacuacaauuuuagggaccuucucagagaauaaaaaggcaagagagaugaaagcguaagugcagucaaaucuuagccacaauaucuucuuuuccugucuaaucucugauuuuccccauuaucaagauuuuuuuuuggagaacacacacugaccaauuuuuaucuauauuuaaacaaauaaaucuauuacuacucagaucaaaauacuauuauaccaugaacaaaaugcuuuauaagaguuuugaauguaauaaaucuugaaauauuuaaaaauaagcuuaaaauuaucauaaaggcauugacaacaugaauaagucaaaaaagaacauaauguuugaaauaauguggaguuuucaaugaauguugcaaaaaaaaaaaauaagugacuguagguguaaaguaguacagaagagggaaauaaagauaacuucuguccacuuuagcuuuuaacaugcaaugcuuucccuucaacuccugaaacuaucacacugucagggaagaggcaccaaauuguacagaaugacaacacuuguauaaggguaauggaaacuaaccaagccacuugacaaugcucuacccauguguuccaaaagucaccaaaauagaagugcuuucuaaaauucagcacuaauguuaagauaauacacaccaaacauuacuagauaaaaaauuucuuccacauugcuagcacguaagucacauaaacauuaaguuauuaagccugaauguuagggaugacacuugauauucagagaauaugguuuauggcuaaguuucacgaacaucuuugcucaugaaaaaaucugaaauuaacauaugaagguauuaccccaaaaaaaggaaggaaaaagcuagagcuucucagguuauuaacacuuacuagcauuucuucuuacauaaauuuaugaauacguggguagaaaaagcauuucuaccccgaaucuaguuuuauuacccaaaacaucaacacagcuuuacaaaccccuuaaaaccaacuacuccucaacucuccuugcuccacuacuuuguaauaaucagcacuucucucccauucagguacuugcaagucagauucuuaaaugacauaaaacauauucuaaaacuuaugccccgcccccccauugcccuauuuaugacuguuaaaauguagcaaacauguuuuguuuaaaguucaaaguuugacucuucuauauuaucuuguuuucuuacauuguuauaauuauuaaugaccacugacaguggccagugacaggaacuguucuugcagggucugcagaucccuacucuauggcugcgcagacucauguucuaacagcagcugaugaagagacuucuguugcucuugauuuaagaugagcccaauacuucuuuaagacauuuuucagacuaaugaaaacuaggcaauuaugacuauuuccauuaggcaagacaauguuugcacauaaaucauuccacacauucaggaacuuacaacuacccuacaaaauaccuucuuccuuuuacauccauauuuuuauaccaauguuuaagaaaaacgaacugaagguacauaggaaacuaaaaucaagguuuccugacagcuauauuaguguccuaucccagaaguuacuacaaagcuauaaacuauuuacucaaucuuuuucaugacuauuuuauacaacaucuuugucuuuuugauuaauguauauaaagacaaaaaaauuacagccagaauuaauaagcuaucaguaacagcaaaaggggaaagaauguuuccccaaaugucauuuuguuuuccagcaaaauguuugaugcuucuaauccuuaacuaaaauaaauucagagcagagugguuaauaaaauuuugagcuuaaauaagcuuaaauuuauaguaaaggcauuaauaauaugaauaaguaugcagcauucuuuuucuagcuaucaguuucuuccagauuguaaauaaaauuucuauaaccuggacuuuacaugacuuuucaagaauuuagcauaaucuacagaaugaaaagguuggacuagauaaucucuaaaucccuuuccacucuaugacuuuauaauuccagcuuuuauugugguuucuuccuauucuuuaaccuaaaaaauaagaauacaaaggacaaaauaaauaccaaauuaacuugguaacuuuagucccaaaucuuugaauuucuucaaaaauguucaaaauaaaaccacuguuucuuuagugauucauggguauagugccauauaucacuucuuccacauuucuugagcaguacuauuccaaaaagaaucaaguuuucuucuauauagacccccgagagcaaaaucauuaugacaaauacaguacuagaaauaaaguuacuguaaaaauuacaaauagauuuauagaagaaaaucugauuuucaucauguauauaauuguuccagccaaagaaagcaauauaugcaaaauuauguugaauaaaaaugacauaugccuaaggaagggggaguuuuuagauguguaaguaaugaagacaguaguuaaugcacaaaacauaagaauccuugagggaugucuugcaaauacccauacuaacagcaccaaaucuacuccuuaggaauugcaaaguaacagauuuguaacaaaaacuacaaaaacaauuuugcaaggauguauuaaaaauccuuauugagccuauaaagcaggaacuauaaagacaguucuuuuuauuuuaccaccauucuuacacuauccuuucuuuuucagauuccagaacugccacucaaagugcccuaugaggagcugugguaacaagguaaaaggcaggagccauccuuuggaagccaucagcaagcucugugaccaucagagcuauuaucugugaucauauacauaaccugaagauagcauaucauacuuuuuuuuaauacuuucaacuccaaaaggcuuugggcuuguaaaaacauaguuucaaagauuuuuauuuuaucagccaccaucuccauuuuuaccuauccuucccauaaaugcaaggauauguuuuaguucugaaacaugaaaguuaauuugauuuuauccugcaacucuugagaacugaucuuucuagccagcauaaagaaaguauacugacacaaaaaucuucagaaaaaauauaggaggauuaaauacucaauuacuuccaggauugcuuacuccuuuccaaagggacugcaaaccccuuuccagaaggaaauuucaaacuaaaaaauuuucuuucaaucagaaguucagugauuuuacugccaucuaaaguaaauuaacuuugaaaauaaguauaaaaauuauaauuguaauuuauugauucaaaauuuuguauuuggcauuccuucucaaaaauuguaguccaauauaaaauuaggccauguggaaaacaguaaaggccuuuacuagauauuccuagaaaacacugaagcaaguacuaaauaaaauaaaaauaagauguuuuugaagggagaaucucguauacugaauuuuaauuaguuuauguuuaacgauagcauuuuuaaugaguuuuaacucuaacauuuuaugaacaagcuaauguauguaacaauaucaagaagcugcugcuacuugauaaaucaaauuuuaauuguacugauauaaaaaaggaaaucuaaaagaaacuuuagagcccucaaaugguagcuucuugaccaaugaaucauuacguuuuucauguucacaguucagauaagcuuaaaaauggaaaugggaaaccucaaccaaaggauaaacaauuuuuacauuaaguuacuauuaaaaaggcuuucugaaaauauuucuuucuacucuguauuggcucuuaagaagguuaagaauagaaaaucacucuguuaaagaagaguaauaacaaauaaccuaugggaucaaaacaagagaacaacuguuguaggucuuuuaccuguauaauucuaagcauaaucuuuuaucagcuuuccauuuuuaggacauucuuaggaacagaaugccccuuaucugaacuuuaucagaucauguagaaauauauuuuucagacaaauuuaacauuugaguuuuguaugucaguaauauacuccuuuaaagacagggaagcgccauucauacucauucauucagaaagaugacaaagaaaauguuuucaauaaauuauuaaugaaauauuucuccaacauacauaggacaacugagauucacuuccaaucaaaagcaauaacccucaugcuggacaguuaucuuucacauuuuauaugauagaauuaugauaaaaauagguuuugaagcagccuuagauaagaauauaacuaaaaguaugccaaaggauuuauuuagaauuuucagauaauaaaaagguaaguuuuugguugugcaaugcacauccauguaaauauauuugcuuuuucaaaagcaaauuuaguauucuuaaguuuccugagugacaaucucauaaauuuugguggaaaugacagcaacauuggguuauuucaauuaugcauggagaccucauaaaaugaguuuuuuaaaaugcucgcucaacagcaggucaccuaucucuauacaacaucagaaaauaauaguaccucucucaaaauugccucaaagagcaacaguaagaggaaaaaacaaccaugcaaugguuuacucaaacugcuuucccuguugaggggguacaguaacugaauacucgucuaugaacaauuuuuacauguucaucaauaguuuauguuccaaucuaguuuugguaaagucagcacucgaauuugacaggggcuuaaauaugccgucaucuuuucugaagaugacggcauauuuugaaaacaauguauaaguuuuaaauuuuuuaagucccauucuuccaauucaggauauaugcugaaugcugaggcaguuguuagaccuuauaaguuacuaugauauuagaaauuaauaauaaaaauaaagcugacagaauuuuagcauuaaacuugguuuaacuauaccaucuuucuuaugaacagcgcuucucuguuuaagaaaagcucaucucugaauuaugccuacucacaugaaaaacugggaaccauugguauguuucccucgauuugccauugauaaaaggaacgcucugucauguuugagaauaaaguuuucaucuguuugaagaaaacacaaauuugucagucuccaauuauaagucacuuuaaaguaauguucaaguaauaaauagaaagcaaaagaugaaauuccucuucuggucaguacagauaacuugacugaacacucagaaaagaaaaauuuaagcuaaucaaauaacaaaagcauaaaaaggccaaaagauacuaauuaaagccuugaggaaaagaacauauauuuaauacuucacacaaacagccuuagaacagucacuuuuaguaguaacauacuuuggcuaaaugauauuuaaauuauuaacuuucagggaaaacuaauaaaauuuuagaaaaaucucuagcuuacuuccuccaaauuuccaauuagcuugccuaaugugcuauacauggaagaaguucaauaaucuuuuuagguguuuaauuuuuauacgguaaauuuauuauucaacuuaauugaagcuagacuguaagacaaaaaaauuauguuauauuaaguuacaggaacauaucuaaauuaaguauguguauacucaauuguaucacaaaauuaucuaaggaagaaagcccugugaaacaaaaauuuaaauagcaaaauacaauuuuaagguacaaaaguaucugccacaaggaacaaccacaaaguggccuacagcauuaguuuuaaauugcuacauaacagaaccagcuaaauagcuguuuccuacuaguucaaaggaaaaaaaaaucugugauaaagaucacuuagaguuauuuuaauuccagcaggaauauccuugaaaacuaacuuauauguccuuuuaacauucauacaaacaaaucuucuucagaacaaacagaaacacagaaaacuuuaaaaagugauuaccuugggaacaggcuucugaaaaagaguaguaauccauuuucccccaaaggaaauauaaaagacuauuauaacacugaagcuauuauagcguuaaaaccuaguaauauuagauuucauuacaaaucucugcaacugacuuuucuaaggcuuuuuggggcaagugcaauaguuagauuuaugcagaugcuacuauuaugagaauaaacacagucauaguucuaauauacaaaagaaaacauacaaaccuuugaaaaacgaaauuucaacuuuuauucaaagaaauugcuugguuuaggggaaaaaaaaccccacaacuagacucuuuucucugaugugaaauuaauaacccauugggaaaugaaaaaagauacagaagcauguaugaaauaauacacagaauuuuccaagucuucaagcaauauagaaauccagccacaaccugacccagacuguccauaaauuuauuaggaagggugcaagggaacagaauuggaguuuguguuacugagcuucguucucuuaccuuuucauuuugcaaaagaccacauucucuauaaacaaaagaauauguugacaguuuuaggcaggaagauaggaguuuucauguauauaguugccuaaccuccaugcugaaagucauguuuaaccauaaaguuagccuuaauuaaucuugucaauuaaaaauuauauauuacaauauaauuuauccccaaauucaugcaaauaaaguauuuucaugcagcauuaguuucaugcaaaaagugaacuauaaguaaaccucuucucauuaaaaguauaugaucaaacuugcuuuaauaucagaacugaaacaaaagaccguaaaauauuaagccuuaccuuuaaaauauccaccauaaauugauucuccaccuuuuccauuaccugcaaauaaucaccuacuuuaagccauaaugaacauuaaaaauauacuaacacagaaaucauuuuugauagcuucaauucgcugaaggaaaccuuggaauguuauaacugcugcaauaaucaaaauucucagaguccucaauuaacuucaucuguaaaauauaugucaagucccauuacaagaaauaccaucaaaaaagucaucuucacaaccuacuuauuucaaacaguaauaacaccaaaaacauuccagaacaaaagcaaucagacaguacuuuggcauucauuguaaaggaauucacuaaguaacuauaauauuaauaaaauaaacugcauaaaaacaaaauaaaaugucuuacgugguacuuugcuuuuucauacauucuggaccuauaauauucacucauccaacaaguauucacugaccacauuuuauaucauacuguaacugacacaauauuuagaacuaaaaguaauaaugaaauacuuuaaaaacugauagauggaguuauuaggaacacaacuuuuagcucuaccuucacugaaguccccacccugaaucauaaaguuuuuaaccacacgauggaacguagaaccuuuauaacauaacuucuucccaguuguuuucccaaggccuuucucuccuggaaaaaaaaaaaaaaaaaagaaaugaaguuuaauuauuuauacauccuuccauggaaagaacaaaccaauuaauccugugucaaaucuuuccugugugcuaggcacuggaagagauauaagaaauagaugacaugauaauuuaacauacacacaugcacgcaaaccaaaauaaauaauccaaagcagcauguaaauguaaaauugugugguacagacucuacaugcuauaggacauaauacuagacacacuuaucacucuagucaaagaaugaggucaggcgcaauggcacacgccuguaaucccaacauuuugggaggccgaggcagaucacuugaggucaggaguuugaaaucagcuuggccaacagggugaaauucugccucuaaaaaaaaaaauacaaaaauuagccaggugugguggcacaggccuguagucccagcuacucaggaggcugaggcaggagaaucacuugaaucugggagguggagguugcagugagcugagaucacacuaccgcacuccagccuguuuuugagacaagagucagacuccgucccaaauaaauaaauaacaaaaucaaggaguuagugcaaaaauugcauauguguauccaaguaagaauuuaaaauuucaguguguucuaauuuuuuuuuuuuuuuuuuugagacaaagucuggcucuugucccccaggcuggagugcaauggcgcaaucuuggcucauugcaagcuccgccucccggguucaagugauucucuugccucagccuccugaguagcugggauuacaggcgccugccacuacgcccggcuaauuuuuguauuuuuaguagagacgggguuucaccauguuggcgaggcuagucuugaacuccugaccucaggugauccaccugccucggccucccaaagugcugggauuacaggcuugagccaccgcacccggccaguuuguucuaauuuuaaaguaacauuauagauguuucccuccccauuuuuucuauuuauuuaaaauuuauuguaaaauuuggaauacuaaauuuuuucaaaguagugaaauucauaaaauucuaccaaaucaguuuugaaugugugcuauuauuuuauaaauuaaaauguauagagaagauuccauuauauaacguagauucuuacucucuuuuucauuuuugagaucauuccuuucuaaucucuuccccuuaagaaaugcuucccugauuucauauaaaagucaguauaaguaacucuuuuuuuuuuuuaauucacaaaacuaauuucacgaguccauuauucuuccaggaaaauaucuauucuguucagcaagguaaaacuguaagccacagcuucucauuggaaauaauaauucacuuaccugagcacaagcaaaggaaguuuuugcauguuuuuggacauaugucugagaagagcugaaacauaaugcgaccaacugaaauaaaauacauaggaaaaaaauaguaagcaaguuaaauauaucacauuuaaaugggagaaagaaacagggcuaacaaauuagaaagucuauuuuuguaauucauuuuaauuuuuuaaaagauguaaugggaaagcauuuaacugggugauaccuaugaacaagaacaccauuuuauuuguuauuguuaaaauuuacaugcagccaaauugguuccagccccaaaauuauaggauuuuaaguguguuuuaaaggaacuuuguauuauuagauuccucguaguauaguucccuaucugaacuauaaaucuucuuuaaaaauacucucaauaguuguuugauuuaugcuugggcccuuccagugaugagaguacaucaaaagacaguaauucuggccaguauuguuaagaaacaucucugucucuuuauuuucagcuuucuuccuuuaagcaagaacuguuaagagccaccuuccugaauugcaccaaucacacuuaaaauucacauuuuaagcugggcaugguggcucacaccuauaaucccagcacuuugggaggcugaggcagggaggguugccugaggucaggaguuugagaccagccugggcaacacagaacgaccccugucucuacaaaaaauuuuaaaaauuagcgggggaugguggcacaugccuguaguuauuggggaggcugacguaggagguucacuugagcccaggauuucaaggcugcaaugagcuaugaucaugcagugagcuuugauugugccacugcacucuagccuaggugacagagcaagacucuuaaaauaauacuccccauccuauccccugagagagcagaaagagaagagguuaugcuucccuacaacaaacacgagauuacaaggaaaagucagcaacuucaauuuaacuaugccagagaaaaaugguucucaaacucuggucucagggcucuuuuaaacucauuacugagcuuuuguuuauguaguucauaucuauugcuauauaccauauuaaauguuaaaacucagaaauguuuaaaacacaagaauacacaagcacacauuccauuaggugucagggcagugauaucaucacauauuaauauaugaucucuggaaaaccugacuguauauucacaagagaaugagagcacaaaaggcaaaucauaaucuauuacuauaaaaauaauugugacuuuauggaccuguugaaagcguaucaauaaaauaagaaacguaauucugauuugcaauuaauuacucuucaguuccuuuccccuuuauucuacaagaucuuuuccauuguaaaccuuuuuauuuauucaaaaggacuuacagaauaaauaaaaauuaacuguggaccaagcauaaaucauguucagaacagacacaaaaugacucuguaucacuaagacuguauuguauuccuggccauaucggucaguuccugugaggaggaaacaaugauacugcauuauagacaucguuaauggguaaagcaggauggaagaccuuccugugucaacauucuuagccuauagcuuuaaaagagccaaacuauaaagcaauuucaaaacuuuguagcuguucuuaaaaccuaagggaaugaagaaaaagacggaaagcaagcaaaaaggaggacucaagauuuucaagcagggagcaguguaucuaaagucauuucagaauuaaaaaaaaacccuauaauaucaguaauaguaacuaucacuguauuuauauagaaacauuuuaccaguauaauaaauguauuuugaucaguccucauaaaucucugggaaauggcuuagcuggugucaaguucaaaaucaucccgcuuugcauaccagaacagacuuagaucuuugcaaucccuguaagauggcuacuuuucaggauagaagacauaaucgaaauaaucaaaacauagggcuuuucuuagggccacaguaacuucaacauuaggguguuuuuuguuuuguuuuuuucaaaaucuuguaaugccucaaaaugaaagcuguucaaaguuucaaauguuuuuaguuucuccuuaacagauaauuggaaauuguguacccuccaguaguacaacacacacuugaaaacaguuaaaaugugauuacauuccuauccaauauucggagagggauagcuaacuagagugguuuaaaaaaaaaaaaaaaaaucucggccaggcaugguggcucacgccuguaaucccagcacuuugggaggccaaggcaggcagaucaccugaggucaggaguucaagaucagccuggccaacaugaugaaaccccaucucuacuaaaaauacaaaaauuagccaggugugguggcaggcgccuguaauccuagcuacucgggaggcugaggcaaaagaaucgcuugaaccugggagguggagguugcagugagcugagguugcaucacugcacuccagccugcgcgacacaguaagauuccaucuuaaaaaaaaaaaaaagaaaaaacaaaucucaccucuaauaucuuacccucuucuagccuggagcaaaaaaaaaagucuuuugcccuccgaaccucauggcacaaaggauagaguagagguuuuaucuccucuauggcauuauguuguuaagagcaagaggaaaaauacaacaaaacugaauuguuuuugccucaauaacaaggugcaagauuaaaccuggcacauaagaaaaauaauuuuaaaauccugaaaaaaacacauuaaccuaauuagguuugcaaagcauggcaaaggcugaacuauggauauucagacauuaguugagacuuucuuaaguuaaaaugcuaguauauaugcaauuugaaggguuuaaaaacaaaaaccaaggucaaaaaaacaaaacagcauuaugauuuauaccuauaaagagguaaccuaguauuaauucccuucaaauuaaauccugagauugaacacuacaggauacagaucagcaaauacuaacuugaacugaagcucauuagcaagauuaacagguuuucaacaaauauuuuuuauugaauuguaugauuuuauagaaaacaggcuaccaugugaugauacuucuauucugaaacucaaaauagacaauauucuaaagguauggucuuuaaaaaaaaaaaaaagucaaugugguucacuaguuuaguuaguaaauauuuucggugauggcaagcauaaacuaugauuacaaaacauauugaagauaaaaaaauuaagcuguaguuacaauaaaggacagacuuggaaugaauuugcguaagucucucuggcucccaaacugaugagaaaaauaagugugacaguaaccccaucucuguaaagaguuaagaacaccugcugaugaugccucuuuggaaacugcugcugacuaaauaaauaauaucuaagaaaaauuuguuacucaacaaauacuauuuauaauuuaguggaauuuaguaaucuuuuagaaucaguugauaccggcugggcacuguaauaccagugcuuugggaggcagaggcuggaggaucacuugaaaccaggaguucaagaaucagucaauacuauugauaauauucuuauacauaguuuucguccacagaauuaauguuaugccaauagauacacagcucuauaauaagacuaaaaucuacuguuaguguaaacauuaguauguugcuuuuauacauggcuaaggacaaaaaugacacaaagcaggacuaguuucuaaauuuaauccgaaaauaccaacaugcagauccuuaaaaauaagacaggggaacaauauuaagauuaaucagguaauaucaacacauguuaagcuuugacuacagacaggaaaagucuaugucaugguguagauucugauuuggccacuaggugaaaggaauaaaaucaccaaguacacagauggaauaaaaucaaacaucaucuuucaauacuguuccuuguuuucagaaauaguugcgcuggaauugcagauucaaugguuuaaaaaggagacauguauuauguacauagaugauaugguaguuggaaaagugagcaucaauuagaaaaauguugcagagguugauaaacuacagaaggcaaagaauagcccauagaacaauuaauuacaagcaaggggugaggaaaagagcaaagguuaagaacagaucacacuagguaggccaagagcaaaaucuaggaagaagauuaagaaacaggagcagcauaacaucgggccauuuacucaaauauuauuuacugagaucuuacccauaugucagggaauccaacaguacuauauacuguugugccugaguuucaagaagaacguagugccuaaguuucaagaagcucacaucuuggcuaggaaugacacauggaaaugcagcugcuacacaauaugagcuaucauuaguaugaacuaagggcacuuauauauaaccuaggucugacuguugugugugaccgcagagagauagggaccaugacugcuuuacuuaccacuauauccccagagacuuacguagugccugguacaguuaggugcucaauaaauauuuaauaauaauaauacucaaaacaaaauuauucaaagacagauuuacaaaauacuuucauaaaugaaggaacacccaaauauacagauuaaaauuauucacuacauaccaggaaaaaauauguaaguggagcaacaccaagauaucaauuaauaaagcuauuuaguuuuggagacauaaauggaaaaaaaagccuccuaguauccaggcaguagaaucauaucguucacaaagaaaaaagaaagaagaccagcuucagacaccuuauauuacaaacuggagacaacugagcacagucuaccauuuuuaaggaauaggcugugaaacaagaauucuauaccuagcaaaggaaauacauuuuauccugaaauaucuauuugaauacauaucccugagauauaagucaaaaaauuaaugaaugagaacuaguaggaagaguggcauugggcacugaauauauuacauuacaaaauuaaaccuaaaucacuauaauuaugguuuuaaaauaaaaggaaaugaggccggauguuagagcugccagguaugacaaugcaaacaguguuaauuaugguuuuaaauguuaucaguauuaggaaacaaaguuauguaauggcaaaauuuuuuuuauguaccaucugaaaauguucuuucuuuugaauaggaaauguucucaugacucaaaaaucaguggaaaaagguacaggaugagaagccuuguuucccaacccuaucaacagguacucacuuucauuaauuuucuguguauuuuuccaguuucuuuucauacacaagcaaauauugauaaauucuuauuuuucuuccuuuaaaaaaugguagauuaugcacacuguacugcaccuugcucuacuaacauaucaugaacuuuucucaugccugugauauaaaaauaauguauuuuauuuuuuaagagacagagucucgcucuguuccccagguuguagugcaacggcacaaccucugcucacugcauccucaaccucuugggcucaagcaauccuccugccucagccuccugaauagaugggaacauaggagcaugccaccaugcuuggcuaauuuuuguauuuuuuguugagacaaggucucacuauguugcccaggguaaaaauaauuucaguuggaggaaggcaguggagaaucaauaaaaaccaacaaggauuuggacuggugaaagaaaauacgcauccucauacuucauagugggaaucaauagguagacuuuucugaagcagagaggaaauaaggguuuaggcauacauuuuuuuuuuuuuuuuugagacagagucucacucugucacccaggcuggagugcaguggcacgaucuuggcucacugcaaucuccgccuccuggguucaagcaauucuccugccucagccucccgaguagcuaggauuauagacaccuaccacuaugcccagcuaauuuuuuguauuuuuaguagagaugggguuucaccauguuggccaggcuugucuugaacuccuaaccuugugauuugcccgccucgaccucccagagugcugggauuacaggccaccaugcccagccaaggguuuaagcauacuuaaacagguauucacaaguagaacuaacaauauuuuacaucuuucaagcuucuuuggugggaggggcagcaaccuaguaaaagauauaaaacaaaggaaauagccagaaaaacauaaaauauaaggccgaaacaacuuaauuauuuagccacaugaagcuuuuuccaugacauguccauaaacacccagcuaaagguuuccugcagauaguacaagcaaaaacucaaaagagaacauauuuacuggcucauguaguuaugaugaggauauuagugcagaucagagaaucaaagggccaggaugucaggaaaugaggucagauguuagagcugccaggucugacaaugcaaaaaguguuaaauaccacuuauuuauccugaucacugcauauagucauaaauauuuucauuaaugaauaaaacuaaagauaaauuaaucacuuaggaagauaaaaggaagaauaccaaaauuuagaaaaaagaauuauaagauaguauacagauaaaaaacaggcccaauaaagaaacuaaaaugcugcuaacuauccaaaagagugcugcuauuaauucuuuagauauagaugaauuacuucuaaucuucaaguaacauuaaaguguaacacuauaucaacuguucuagagcacagcaaaagaugaaaagcuuaauuuuuuugaaacaaaauaaaaucgaaaccaaagccugggagagaugauauaaaacaaauuuaaaaccccauaugccaaucucauuuuaaaagagacacuauucaacauuaggaaaucuacuaauauaguuuauugaagugaaggaaaaauccuauaaaaaucccaugauagaaaaaaaaaaucccacgauagaaaccaaaagugcacggugaaauucaacauucauaucuacuacagaaacaacaaaauaaauuuuaaaaaagaaaaauauaaauuaaaaaaaagaaauucaacauucauuccuuuauaugacacacauauucucagauauuuuucaaaucaacaaucagcauuaucguuaauggugaaacacuccuguagcauuaauuccagugaagcaggaaacaagucaaaaguaguuguuagcaucacuacuguuuaaugcucuuucagaaauucuagucaauguaggcuaggcgugguagcucacgccuauaaucccagcacuuugggaggcgguggggggcgcggaucaccugaggucgggaguucgagaccagccugaccaacauggagaaaccccgucucuacuaaaaauacaaaauuagcgggugugguggcucacuccuguaaucccagcuacucgggaggcugaggcaggagaaucgcuugaacgcaggaggcagagguugcagugagccgagauugcaccauuuugcacuccagccugggcaacaagagcgaaacucugucucaaaaaaaaaggaaauucuagucaauguaaguagauaagaggacaauaggagagauuuacaaguaaaaaagagcauauuuaucaccauuugaaacauuagcuauacaccuagaaagcccaaaagaaccaacugaaauaccaacagauacugaaguuguugauauuuauauuaugacaaacaagaacuaguagaacaaaauacaguaaaaaucacauucucaaaaacaacaagaaacauucuaccuacauaaccauaagaguauaggaucuauaaaaacaaaacuccaacuuugagaggcauaaugccaacaugaauaaagggagagauaccuuguucuuagacaagacucaaaauugcaaaugugcccaauauucccuagaguaaccuauaauaacuuaauugcaaccuucaaaaauaccagugagauuucugagggaacuugacaaaaugauccugaagguugucugaaagaauaaaugugcaauuccccuucuugaacuuuuguuuugaaauuuucaaaucuacaaagauguuuugccauauuuaucccucucuaaacacacaaucuucuggaacaaacugaaaguuaaagacacugugacacuucaccccuaauuauuaauacuucagcuuauauuccuaaagaauaaagauauucugcuacuuaaauccaaaaccauuacuacaccaaagaaauuuaauagugauuaucaucuacuccauagcuguggcauaacaugaaacauuacauuugaccucuguccccaguuccuacauuugaccucuguccccaguuucuagcacagugcuccuaaaacuuguaauuuucuaagugauaggacugauaggagcaucuuuuguucuauuugaucuuucuucuuuuuuuuuuuuugauauaugagucuugcucuauugcccaggcaggagugcagugguaugaucucugcucacugcacccuccaccucccagguucaagcaauucuccugccuuagccuccugaguagcugugauuacaggugcucgccaccaugcccggcuaauuuuuguacuucuuuuuaguggucaggguuucaccacguuggccaggcuugucuggaacuccugaccucaagugaucugccugccucggccucccaaagugcugggauuaccgccaugagccaccacacccagccuacuauuugauauuucucucagauucuugacagagaacacuuaaaucccuuagcauucgcauccaaagaagagacucuuggcagacccccagauagcuucaggauagggcugguugccagaaaaaccaugccuugguuagaggucuguaacuuucagccucacuuuccaaccuucagagagagaagaggggcuggagauucaguuaauaauugaucacacauaugcaaucauacgugaugaaauaauugaucauacauacauauauuuuuagccacaaaacccccuaaauggcaggguuuagagagagcuuccagacuggugaacacaaugagggagggcgacauguccagaaggcccaugcaucuccccacccucugcaccuacaauaccuugcccuaggcaucucuucuguuugguuguuccugagauauauccuuuauaauaaaccaguaauaguaagcaaacuggcuuccuaaguucugugagcugcucuagcaaauuacugaagcugagcaggggguuguaggaaucccuaauuuacagcugguuggucagaaguaagagugacucagaagccaggcgcaguggcucacggaggccgagguggguggauuaccugaggucaggaguuuaggaccagccugaccaacauagugaaacccuguaucuaauaaaaaauacaagaaguagccagguguggcggugggcaccuguaaucgcagcuacuugggaggcugaggcacgagaaucucuugaacccgggaggcggagguugcagugagcugagaucgcgccauugcacuccagccugggugacaagaaggaaacucaaaaaaaaaaaaaaaaaaaaaaaaaaaaaaaaaaaaaaaaaaagagcgacucaggacuugcgauuggcaugcccgcagugggagcagucuuguggaacugauuucucuuaacuuguggaauaugacacuaacuccagguagauaguguccagaaucaaauugaauuguuggacacuuaguuggcuuugaagaaucuguuacugugggaaaaaacuccucauaauaauccauauucaaauuuacccaacuaccccuacaaugcccuuuacauguuuuuucccccuuuucauucuuuuuaauggcugaauggaauucuguuguuuggcuauaucaaauuuuacucaaccaauccucaacugauuagcauuugaguuccuucuaguuuacugacaaauauacaucuauuuuuuaaaauccaggaaucucauucaagcauuauauacccauuugguuuucauuuguuggccucuuuuaaucuaaaacagucuccaucuuuuuuuuuuugcaccccauuagaaagcaugucagucggacccauuaaaguaccuuuauaacugagauauuagccacaucuuaguuguaaaggaauuuuccuccauuuuaaauaaauaaucuguuggauacuuugcacacagcacaacuuuucaccuaugguuuggccacugaugacuacuuucugaaccaguuauuaccauggggguugcaaaaugaugauucuucugauuccaucaauucuucuguaucuauuaaacuugaaucuuucuguuaagagccgcacgcacccaccccaugucaaaaguaacacaguaucgacacaaaaagagccuggaucccucacauggacagcccugaucugcugauucugagugcugugugacagaaaagcaaaacuuuuauauuguuguaaguacuguuauuuaaccuuuauguuagaaccaaucuuaucauuuagccuaacuaauacaagguaucuucauaugaggguaaacuacagucaccaaaagugauuacguaucagaaggcugaggugggaggaucauuugagaccaggaauuugaggcuacaccacacuaugaucaugccugugaauagccacaguacuccagcaugagcaacgcagugauacucugucucuaaaaaaaaagccaaacgaaauuuuuuuuuuuagggauagugucucacuauguugcccaggcugguagguuucuaacuccuaugcucaagcaauccuccugccuuggccucccaaagugcugggauuacaagcaugagccacugugccuggccaagaaaaaaauaaaaauuuaaaauaaaaguaaagacaaaauauuaaaaaauguuaaaaagugauuacauaaagauuaauugguguuuaauaaaauaaacauugcugaauuaagaaucaggcuucaauucuuuguacaaguauacauacauagggagugaaagcaagaauucaggauuucacuuuacagcacugucucucggacuuuaagauacaaucucugggaacaaaagggaccaaaaucaaaggucuaccugcacaauaccuaaauaugaaagccccuuaacuugacuuaguguccauacuccugcacaugcaauacuuaaagcaacuuaaaaaaaaaaucagauacugugcuauauauacuuaacaaauacagacugcucuacaagaacagugauagaauuuuaagaaacacugcauuaucgaaaaucacauauaaaaauaacuauuuccauauaaaaaugggaacugggggggacaagggaguuuccaguugcaguaaaaauauuuuuuucuuuaggaguaucaauaauaaauuuuagcuauaagaggacguuauaaaaucuaaacaucauugaggaaacccuacaacugaccaaaccucauuucugccuccauucccagcacugucauuagcacaguggccuucaaaucaguuaggacaaacaagaaugacucagagcagcagagcuauccaacuguucucucccacgccacucuuccccaccugcuuauccgauuguuauaccaaacaguagugugccuaauuaaaauugugcuccuuaauccacccuauuagaguaaguucauguuacucuaauacaaucuauaagauggcauuauuuaauuacucuucucaacaaucuuguuauguaagcacuauuacacuggaguccuauuauuagguuaauaauauaacagguuaaugagcauauacagugcaagucauuuaaauuucaggccauugcaucuagucacucuacucaugagcuuaugacccagggugaccuugagagcggagaugcauuucuccuauucccucagaacaaaccagaucccauauaccucacucgaaguaugagcuauuuugaaugugagucuaaaguuuaguuuaauuuugaauauaagcaaauuuuccuguccuguuagcuuuggaaccaaauuaagaacaaaacuguauaguaguuccauuucacaaagagguuguuaaacggcuugaccaaggacacaaguaguacucaaacauuugccugaauccuuugucgccucuuaagacuaauuucuugguaucacuucuaaauacuuuacaauguuugcuaaaaacacauuuuccagucuguuuuuaugaaucuuaagcaguaaagcaaaucuaaacauaacuaauuauauuaaauguauacaguuaaacauacugacuaaaagacauugucagagugggacaagacccaucuauuugcuauccagaagaaauccacuuuaaauauuauacagaaagguuaaaaguaaaaggauugaaaaugauauaccauguaaacacuaauaaaacggaaguaacuauauucauaucugaggcaaaggaaacuucagagccaggaaaguuacuaggaauauaaggugucauuacauaauaauaaaagaguucacuaagaagacaacaauccuaaauauguauguacccaccuaagagccucaaaaugaaugaugcaaaaacuaagagaacuuaaaagagaaauacggccgggcaugauggcucaugccuguaaucccagcacuucgagaggccgaggcagguggauugcuugggcccaggaguucaagaccagccugggcaucaugaagaaacccugucucuacuaaaaauacaaaaaauuagccaggcaugguagcucacaccuguagucccagcuacuggggaggcagaggcacgagaaucacuugaaccaggaaggcagaggguguggugagccaagaucaugccacugcacuccagcauuccagccugggcgacagagcaagacucagucucaaaaaaaaaaaaaaaaaaaaaaaaaaaaaaaaaaaaaaaggagagaaauagauaaauccacaauuacaguuguuauaguugcagacuucaauacucuucuccugguaaucaauaaacaaguagaaaaucagcaaagauauaaaagaauugaccaacacuaauagccaacuggauuugacauuuauagaacacacuacacaaaaauguacauucaagugcagaauguacauucaagugcacaaagaacggaaaucauguguguucucuagccauaauggaauuaaauuaaaagucauuugagacugucucaaaaaaaaaagguaucaaaucaacaaucuaugcuucaacauuaagaaacuagaaaaagaacaaaauaaaaauugaagcaagcauuagaaagaaagagaacaaugaaauugaaaacaaaaauagaaacaaaauucaaucagaucaaaaucugguucucugaaaauguauaaugaauaaaccucucgucagacugacaaaggaaaaagacaaaaggaagaauuaucaauaucaggaaugaaaagagacaccacuacagaccccacagauauuaaaagaggcugugacaaacaacucuaagcacauaaacuugacaacuuagauaaaaugcaccaauuucuuuaauaaaaaccacaggcuaggcaccguggcucacaccuguaauucuagcacuuucggaggccgaggugggcggaucacuugaggucaggaguucagaccagccuggccaacaugaugaaacccugucucuaauaaaaauacaaaaaaauuagccaggggugguggcacaugccuguaaucccagcuacuagggaggcugaggcaggagaaucgcuugaaccugggaggcggagguugcacugagccgagauggcaccacugcacuccagccugggugaaaaagugagacuucgccucaaaaaaaaaaaaaaaaaaaaaguuguguaaaauccacuauuuaguuaauauacucaaaaagugcuaguuauuucacaagacugaaccauaugaaauuuccaacuaucaaaugauuaaaccuagaacaauguaagcauugcauuuccuuguuuuauaugauucggcguucucaagagugcuaaucacaucuacacaucuaucacaaugaauugccuuggauguugaggaaugagguucauugaacauuugucaaacauauucuggagauuuuucacaacacagguuaugugcaaaucuaggaucugaacauuuacuaggaaaggaguacuuaacuacagaaauuuuuauuuguacuuuuucuuaagcuguuuuuuuuuuuuuuuuuuuuuuuuuagaaacaagaucuugcucuguugaccaagcuggagugcaguggugcaaucauagcucauggcagccuuaaacuccugagcucaagccauccucccaccucacccuuccaaguacaggugagcaccaccaugccuggcuaauuaaaaaaaaauuguuuuuuguagacagggucuugcuauauugcccaggcuggucucaaacuccuggguucaagcaauccuccugccugggccucccuaaguacugggauuacugguaugagccaccaugcuuggucauacuucuacucuucagcaaucuacuauuuuucuuuucuuuucuuuuuuuuuuuuuuugagacagggucucacuccgucacccaggcugacaugcagugguauaaucucuacucacugcaaccucugcuucccaggcucaagcaguccuucagucucagccucccaaauagcugggacuacaggcaaaaacuaagagagccaccaugcccagcuaauuuuuuuauuuuuuguagagaugggguuucgccauguaggccaggcuggucucgaacuccugaccucaaaaugauacacccgcgucugccucccaaagugcugggauuacaggcgugagcuauuuuuaauucuuaauagaaaauaacccuguuaucuaaagcauggauucacuacaaaauaaagauuaagguccaucaaggcuuucuaguaacacuuauuuaaaaaaaaaaaaaaaaaagaucaaucaaggcuaaaaacauuaaaaagagagagaaggcaaccaaauuuccaggauuaucucaucccuuugcucgaaacccuuuaauaucuuccuaccucacugagucaguccuacaggccauuucuuacuauucucuuuccucuucuacuccagccacacugggcacccugcugucccucaaacaugcaaguacaguccuccauuguuuaauaaccaggacggauucugagaaauguguaauuaggcaauuucgucauugugugaacaucauggaauguauuuaaacacaccuagaugguacggccuacuacacaccuaagcuauauagucuauuugcuccuaggcuacaaaccuguacaggauguuacuccacugaauaccguaggcaacuuuaacacaaugaaguauuuguauaucuaaacacagcuaaacauuaaaaaguuaccaaaaaaagguauuauauauaagaccauuguuaaagauagaaaugucauuuggcgccugacuguauacuacuccucaccucagggcugugcuguuucccucuaccacgaaugcucuucuuaaauacggcucacuucaucuccuucugauaccugcuuaaaucucaucuucucaaaauggccuugucugaccaacuuauuaaaauaguaucccaacuacaagucacuguuauuuuuuuccuaguuguccgucuuccccccaauagaauauaaacuauaaaaggaagaggccuuuguuuuaugcgcugcucuaucuccagacccuagaacaguagcaggcucucauaagaauaugcagaacaagauguugcacaaagacaacacauauauauaugucuccaauuaaaacuuuugucacggauaacaaaaaaagcuaagaaaacaguuugaaacccugcacgcucugcuacuuagaaugaaauaacuaugcuuuagaaggaaauguuucauuuaaaaaaaauacacuaacaaaugucuggauucccuaaagacaaacauuaaugcuaagugcaugcaugcugcaauucugcugguacaaaaugcucugguuuaucacaaaagaucuucacuaagccauuuucccaggaaccacgaaauucuagcuaaagauucuuaaggaaaaauagaggcaaaauuaacauauuagugauauaucgugauuaggaaacacacaauauuuccuacuaguugaaacuucauagcaccaagcaagauaaccggaaaucggaucgggagugucugccucacggagacacugggagagaaaaaguccucaaagaacugcaccuccuuuucuuggcgccaggcuggcuacgaggacucaguccggagaugcagcggggugugugggguuuggcaggaagaggcccggacugcgaguuaggggugugcccaggccaccuuccucucccacugauuuucucucaagagaaaacggaaaguugccugcgccuccuacccgcucccaaaaaggccgggggaggguugcugaggguagaccccuccccuucgccaaggcaggccucggccccagcagcgcuccccaguuuccagcucacccggcucccgguugaucucgaugucgaaguggcacugcggccgguccugcgcccccaucgcgaccgagguggcggcaagagcugggagagagggggagaaaagcggucagggcaggggcgagggcgggggcgagggcaggggcgagggcggggcugagacgaaguccgcgccacggugccucacgccggcccgucgcgacagcgcaggaggccaagacgaggcccccucccgccccgggccucgcggcucccacgcagcgcgcacgcaugcgggcgagcucuucaccuggcuggccuccagccugagcggguccccgugagcagaagagaaagcacugccacugcagccaaaccccaacgccgcuaacggaacgccgucuccucccccaggccgggccucccaaugccacgcuaaaccccgcgagagucgggaca

SEQ ID NO: 16177 - RNA, 6978 nt, Homo sapiens
ccugugcgucaugugcaggaggccaggcggcucgccuuacagggacccggccaccucuauauauagccccucgaagacagcugcucagucuaagcaaaccccagcaggaaagcagggguacagagaggagcccccuuggcaccgccaccgcacccuaggccacccaccauggcgcugggcuuggagcaggcggaggagcagcgguuguaccagcagacgcuccugcaagacgggcucaaagacaugcuggaccauggcaaguuccucgacuguguggugcgggcgggcgagcgcgaguucccgugccaucgccuggugcuggccgccugcagccccuacuuccgggcgcgcuuucuagccgagccggagcgcgcgggcgagcugcaccuggaggagguguccccggacgugguggcccaggugcugcacuaccuguacacaucagagaucgcgcuggaugaggcgagcgugcaggauuuguucgccgcggcacaccgcuuccagaucccuuccaucuucaccaucugcguguccuuccugcagaagcgccugugccucuccaacugcuuggccgucuuccgucucggccuccugcucgacugcgcgcgucucgccguggcugcccgcgacuucaucugcgcucacuucacgcugguggcgcgcgacgcugacuuccucggacucucggccgacgagcucaucgccaucaucuccagcgacggccuuaacguggagaaggaggaggcaguguucgaggcggugaugcggugggcggguagcggcgacgccgaggcgcaggcugagcgccagcgcgcgcugcccaccgucuucgagagcgugcgcugccgcuugcugccgcgcgccuuucuggaaagccgcguggagcgccacccucucgugcgugcccagcccgaguugcugcgcaaggugcagauggugaaggaugcacacgagggccgcaucaccacgcugcggaagaaaaagaaggggaaggauggagccggggccaaggaggcugauaagggcacaagcaaagccaaagcagaggaggaugaggaggccgaacguauccuuccugggauccucaaugacacccugcgcuucggcauguuccugcaggaucucaucuucaugaucagugaggagggcgcuguggccuacgauccagcagccaacgagugcuacugugcuucccucuccaaccagguccccaagaaccacgucagccugguuaccaaggagaaccaggucuucguggcuggaggccucuucuacaacgaagacaacaaagaggaccccaugagcgcauacuuccugcaggugccugaccagccuugggagccgccagcuaaugcugggcucuaggcacuguggacagucuuggggcccagaaggggcuugugucuacacaagugaaugccacugggucuagggugagauguagacuggggagguugacugauagccaccuacuugaagguugaagacagucaauaggcagcugccaaaaagcagcauaacuuugguaucuuaauuucaggggugugguagccccaaguuggcauauguuggaggcccuggcccugcacagggguugggguggggcacaguaaggagcagcaaggucggugugaggauccugggcagggccucugcgugaaggccaggcccggagcucacagcagugucccagacaaaggaacaauccuguaugguccucccauuguacagaugaggaaacugaggcccaggagguaucagcagaguggagugccaggucugaguuggggugugacugugagaucucaaagggcagagacaguuuccuggagacuggccauauaaguuugagccuugccaguggggugggauuuggagaugugaaggggaagauggcaguguuuccggccaaggaacgguaagcaagggauagaacuggggcugagccuggugaguggugugcucagggaggccugaucagcaagaggggugacaggcgcuuggugccaggguuaagcucacaggccuuacgguugcacugggggaugagggcagcuucaccagcuacuagcucagcagugugggcacauuguuuauucucucugggccucuguuuguaacuggggauauucuccuuccugcaugauaagguuguuggaagguuaaaugaugcuuauaaagugcucaucagcaaggugcucagcccucagaaaacuuuccaaaaagaugaaccccuaguauuaauaucuuaauuauaaagcuguggagguggacaaggcuguggacuguagauuuuacagggcgaaaaggcagggccguauuuggaaguuuccugaacagugggaugggguggagaggagggggcaggcaggccucaguugggaguuguucagccugggaaagcaaggccauagcuggaccucccucacagagcucccccucauuucugugcuguggugcccuaccgccugcuauaauggugguugccaggagccugccugggugugggggacgcucaucugcucucagccugaugguaggaggggcacuguuucucagggcaccuccaggcuguauuggcccuaccuggguucccgaccuccuccgugaucuggggcagugggacugaguggggcugggcugaggcugggggaguggggggcgguagcugacuggacaccuggccugcaguuugaccaucuggacucagaguggcuggggaugccaccgcugcccucgccccgcugccucuuuggccugggagaagcucucaacuccaucuacguggucgguggcagagagaucaaggacggcgagcgcugccuggacucggucaugugcuacgacaggcugugagcauggcugggguggggcugagcuccgugggggugaguggggcauggaggccgcagcuggucuagggccuggggugggauuuggagcuagagccuugugcuuagagugaaggugggcuuggguaagggcggggagguuggggggcagggugggaucaaagaacugagaggccucggaaguuccagcaauggaucugacgcaucucgaauauguguuagguggaugggcggaugggugcagagacagggacugagccgagccuggaugggugcccucccccacccccacucccgucuccuccaggucauucaaauggggugaaucggacccgcugccuuacgugguguauggccacacagugcucucccacauggaccuugucuacguaauuggcggcaaaggcagugacaggugaggcugggccuggagugagucuguggagcagagguagaaucucccagaggcugucagggguuuguccuggcugccccggcaggugauugcagggaggcguggcugggcuccugcuucucuccacccauccccacccuccaccccacaggaagugccugaacaagaugugcgucuaugaccccaagaaguuugaguggaaggagcuggcacccaugcagaccgcccgcucacucuuuggggccacuguccaugauggccgcauuaucguggcagcuggggucaccgacacagggcugaccaguucugccgaaguguacagcaucacagacaacaaguaugaaagcuugucccuuccgccaaggacaacugcauggcuuugggcuucugucagccccagcaggagcugcagucccugucuugggucuccaguguugacuuuggacaucaguauagaaauaggcuuucucuccugaucagcagugagguggggaggcggggcaaggguuauggccagccuggucugcaggagggggcucccagggcugggggaggggaugccagguuccucauucagggacucauaccaggcaauggccuggugcaagggauauagcagugaacaagacagaagcugcccugccugggacaucagaaaagagaaaacugaacugagagacaguuggacucagcucgcaaaaggggugaggguggugggaggagguugccccagacuaaggaaagguggugcugaggcaguuuggagaaaaaacucaaggccuauaggagggaagguguugcuccagcuggguggaggugggugggugauggaguugggauggcggugcuggggcuggagcgggggccagcaggagagggacuguaucucaucuguguucuacuaaaguacuucauggcaacugauauagagagcagauuagggauuucccaggggucaggaaggucaggggugauaaaggccuggagcugggggcacagcggagaugggguugaggggaugcaccggacaaagacaggccagggcuucuuacacugugaugggcaugcaaaucuccuggggaucgccuuaaagugcagauucugauucucgguaugcggagggcugaaagccuguaagucugcauuucuaacgcacccccaggagaugcugacgcugcugggccaugaaccacacuuugaguagcaagagucuaggaggugggagaaacagggcuuagcuauugauuggaugugggggugagagggggagaaguacaugcuucugagugagggugggaggccauuuacuggauaaucauugggauuggguagggaaagugaggguccaguuaggacauguggacuugaaguaccuggggguguccaaaaggaccccacccgggagagagagggcugagcuggagggagagaucugggggucaguagcacacggaggggccaagcucccucaggagagagaguguaaaugggaggagcugagguccaagcccugaugguggaggcagcugcauuauccaggaaggaggccacgaaggugaggccgaagagaugggugaggaaagucacgucagcagggcugugugcuguaggaccucagugcgugugcagugacuguggaccucaggaaggucaguuuuggaggaugggacuaaggcccaaggcaggagccaggguagcgaagauacauugagaacaacugggcugugaagggagaagaaggauagagcaggugugcaagguggguggggcugcaggggccgcugaggggcaaaaggacugcguccagggcaaggcugggggccugcuaggggcugggguugugaguuggaggguggaguuaguucaggagaggaguaggggcaguggggagauccaugguggacuuugcuggacagguuggauagaauggcaagaggacaaggaaaggaaaguggaggagcaagagaauggggaaggaagggaagaccagagggacagggaaggggaaugggguugggggcaugggugccugggacuuggauugcaaaggguugcaguuggagcugugggugcuggguggcagggacagucacugggcuugccgaggcaucccaaugaugcaccuucucacacacccccaggugggcacccuucgaggccuucccacaggagcguagcucacucagccuggucagccugguggguacccucuaugccauugguggcuuugccacacuggagacggagucuggagagcugguucccacagagcucaaugacaucuggaggugagucccacccuggggaggcaagggggcaucaugagcaaggcugacaccccauagcaccauggugggguaccaaggcacugggcaagcuccucugggggcaaagcggaucccucuucuagggaguccuguagggaggaauagccaacauacccugcuuggccguuucucaccaguuuguugggaaagucugggcuugcacagaugacaccaugccccacuguggagcagcaacaguguugcagaugggagcagacccaagcuuaggucauagacucacagaaacagggcccaaauagcagccggauuuucuucucuccugccuuccgggugcuuggucuggagggagggcugccacuagggcugggaaacaguuggagcccuggccuuucagaaccauugcucucuauggcugguccuuugugggggugggagaaggaaacuuuagccucuggggcaucuccuuccugaaccugcagccaucugcacugcugcaggcagccccuggggagcagugcugccggaggcugagacgugagacuuaguagaaauggagcauggaaauucucaaggagaggacauugaugggguggugugggcaguguagaccuuccuggaggggaacuuugaggaauaugggaacaccccuugagaggugaucuuuccuggggagaaagacccuuccuggagugugggguggguguuccuuggggugggucuuguggggggucuccuuucccagagccuggggauuuucaggagcagaucucccuagagaugggccaagugcccucagccaccccucucugcugcguuccacucuggacucagcugaccaagcucuccauccuuguccccacucucucucauccccagguauaacgaggaggagaagaaaugggaggguguccugcgggagaucgccuaugcagcaggugccaccuuccuaccagugcggcucaaugugcugugccugacuaagaugugaccagcucaggcagacugaacuaagcaccccucccauccugcgacccucacuggccuggccuugugggggcuccagaaaagaggcuaggagaggccagagucuaccuggauccaguuauggugccucaggggcugcgucagccaaggaaagggaagugcugcuuaguccuggacuuuugggcaagggugagaaacuagaggcuucuccaguguugccauaucccccuagguugucuugauccaugaaccagaaccacagggcgguaucccaggccgugugcuggcccugccccagccuagcugagugugcuggcaaaguuccccacaggacucagccuucucgucuuuccgaugggagcauccccaucaagugcaguguacagugcagauaugucuccuucuuuaggaagaauaaagugccuucugagcaagcagc

SEQ ID NO: 16178 - RNA, 20496 nt, Homo sapiens
uugacaugggucacuuacuuuaauaacaauacauauaccauguuaacaccauggaaugcaaauucagauuagacaagagaauuucacaagugugauagccuucuguauauuauauaaaaguuuggguauacugucuggccaaaccagcuugcucauaagucauuaaccaaauccauuauagguaauuuguucaguucaauguuuacaauucuuauggaaaaaauuagcaacacacacauuuaaaacguguucauuuaccuuugcgugagugcuuaaaauacauauuucuauuucaagaugacauuuaaaaauuauucuaauauaucagcagcaaaaauauaauuugcaauuacaaaaaacuaaacuagaauccuuaaauuauucucauguuuacaguugugauucuuuaauaaauacuauuaugcagcucuauuguuuaagcuuucuggauuugguuuaaacacaugcauauauauugucaauugugggaagcuuuacaaguuauauuccaugcacuuuuuggacagaguucuaacagagccagccaguccacaaaacaggcagacaaaaguugaauuaacuggggcaaauaggacucuuaugcaacauccaaaauaucugacauucugcagcaaacagggaguaccuucaggauuggccuguuaucuucuuuagaacuaaguucaucuuaaaaauuuaagaagguggacauuucaacaccaucaagugcauuuaggugacauguuuaaguuaacuugacuuccuugaaugaccuaguuaguaaacuagucacuaguaauucggucaccaagcaaaucaagccugcaagaaaggaagccaauauucaaaaugccauguuaccaucuaaacccauacaaauuaguuuauuuccaacaauaauagguaacuuuaauaauaagacaucuaacuaaagcaagcuccuccaacaagaccaagacagcaucucuucuucuaaggcuuagguuuugcccagaauucccgauacauggaauagcccauaccuaaagaaaaagaaugcuaguuaagcauuucaguauuuucuuaaauauucaaaaauaaaaaccaguucauaaaauagcugaaaguagcaccacugcuagcauggaauauuuacaaggggaauaagacccuaggaagcuuauacucuugccuucuuaaacaucuuaaaucucuaaaacucuuguuacauacaguaguuucccaaguagcaaagggcugguauggcuacuucacauguuacaauauuucuuugaaagaacaaucaauauuuaucugguaacuuugaaaggaaucacucuugcuacauaauaccagauaaagucaaugaauuauaaagccaauagaagaagcauguaauaccuaaacuuuaagaaucucuccuuuaaaaacacaauaaaauagcaauuguaugucucucccagauaacagauguuacuaucaaccccaauuacaugucuaggcucuucaaugaaauuauaaacucagugauugacaggauuuuuuuuuucuuuaaaaucuuaguaggauauaucauagaaaaacuaugucacuacuugaauuaucuucauuaauucauuuuuuacaugaaaaugaguauaagugauauucuccaacugcuaaaaggucagcuaaaaauauuuaccuauuuuguuuguaaagaaauaccuuaaugagaaacgaaaauuugaaauuuccuauaggaaccuaccaacagucauugcuccuacaacaaagccuugggcugccacacgcauguggaucagaugaauggacauuuuaguauuuccccugcucuucaguuuauauaauccauaugcaacaauugcugcaaaacccgcuauuccuguaaaacaaaguaacaaguaugucagaugcaugagaagggaccaagaugacuuuaccaucagucaauguacauucuauuauuuuuaugaggauucuuuaucagaucauuaauuagcuaacauacaaauugaguuuuucauguuuuccccuaucaaaaccaaaaaucuuuaagcaaacaacaacagauccagaaagucaggauuaucuuuaaaaacauggguuuguggggccaguagauaaacuccuuuaaaaaacugcuagggaauuaacaggaaccuagauuaugauuaucagaacgaaagugugccaaaggucuugacuuagagaaugaauuuauuccauuuccucucuguccuauuucccucccucaagguaaucaguuaauauaccagagacaauccuacacacuacuaccacugagaaacauugccugaauauuucaaacuuugggauauuguacugggaagaaguaaauaaaggaaaagaauagagcaauauuaguuucaguuaaaaggauuaugauccuagaguucuauacagagccaaacucucauucauuuugagggcaaaagcauucaggacaugaccuuccauguuuucuuuuuaagauuuauuauuuuauuuuuuaagagauggggucuugcucuguugcccaggcuggagugcagccgcacaaucauagcucacugcagccuuguucucccaggcucaggugauccucuucgcucagccucccuaauaacugggacuacaggagggcugucuuucccaagcugccacccagguacugauacaaaaaccuagaggaaaauauccagucaaauaaaaacagugagucaaaauggacaguucaagaaauaaagacauaaugguuaagauauaauggugagcaauaaagacagaaaaaucuguacugguuccuugaaaaugacugguauaauauagcaaaauuaagaaucugaaauuaggcuaugauuaucacaacaaaacgugugcuaaaggucuuagggaauaaauuuauauucauuuuaauacaggaaauagaugaaaaaaacacauccuaguuugacaauguaaagauaaccaccagcaagcaguguaagaauagccgcagaacuuccaaaucauaaggaggaaaaaaaaauuagggcugggagcaguagcucacacccaucaucccagcacuuugggagguugaggcagguggaucaccugagaucagggguuugagaccagccuggccaacagccuggucaucucuacuaaaaauacaaaaaauuagccgggcaugguggcaugcgccuguaaucccagcuacuugggaggcugaggcaggagaaugcuugaaccugggaggcggagguugcagugagccgagaucacaccacugcacuccagccugggcgacagagcgagacuccaucucaaaaauauauauauauauauauauauauauaaauuuuuaaagucauaaaacuuuaaaauaaucuaauauagcagcaaaauaaauaaauggagcaaaaauuguuaggaacacaagauuagcucuauuagaagacaacaaaaugggaaaaucugucucuuucagaaaacaacagaauaagaagccccaaacuaaagcuacagaauugcacggcaccauuaaauaaacuuacuuaaauucuuaaaaauaaauaaaauuuaauauuuuaauuuaaaacagagaucccacauucuuuaaaaugucuaugaagcuuugacaaaaccaaucauuuauuaggccacaaagaaaauuccaacuuccaaaaaguccuucuuccuggaugacuaccauaaggccaaaacuuagcaaucaaaacguaaaacaaccacacacauacccccaccucuaaccacugagaagcugagcaccaauaacuagauuuggagguuaaaguaaaaacugagagauuaggaagcuaucaaacauuauuugaaaaauaaaaacaguacugguucuuagaacaaauaaaauuguaaaaccucuaggaagucugaucaaagagaaaauaaacauacgacauuaggaaugaggaaguggauauaaucacaagugauaaagagauuuuuaaaaauaagagaugauugcucuuugccaauuaaauuugaaaaucuaggugaaaugaaugauuucugaggagaauacaaauuccuaaauuugauucaagaaguuguagaaaaccuuucuauaccaauaaccauagaaagaauuaaaugggcaauccaugcuuuauccccaaaagauaaagaccccaauaguuucauuaacaaggucuaauaaaaauuauaagggcauucucaauucauguuauuuaaaguauuccagggcauuaaaaacauagcaauacauuuuuuuccaauauauuuuccaagaaaacaaaucccugauaccaaaacaaaauuaagauaacauaagaggcugggugcaguggcucacaccuguaauccaagcacuuugggaggccgaggcaggugaaucacuugaaaacaggaguucgagacuagccuggccaaaauggugaaaccccgucucuacuaaaaacacaaaaaucagccuggugugguggcgggaguagucccagcuacucaggaagcugagguaggagaaucacuugaacccaggaggcagaggcugcagugagccgagauccugccacugcacuccagccugggcgacagagcgggacugucuccaaaaacuaaaaaauaaaaaaaaaagccaugagaagagaauuacaaagcaauauaaauuauaaacauagauauaaaauuccuaaaccaaauacuagcuuaucaacuuuaaaauguauuagaauaauauuaucaaccaugaucauuagguuuuuacuuugggaauuuuuuuuuuuuuuuuuuuugagacggagucuuguucugucacccaggcuggagugcaguggugcaaucuccgcucacugcaaccuccgacuccugaguucaagugauucuccugccccagcuucccgaguagcugggauuacaggaaugugccaaccacacccggcuaauuuuuguauuuuuaguagagaugggguuuccccacauuggucaggcuggucucgaacuccugaccucaugaucugccugccucagccucccaaaaaagugcugggauuauaggugugaaccacugugccuggccuacuuugggaauuaaccauugcuuuuacauaagaaaaucuuggccaggagcaguggcucaucccuguaauccuagcacuuugggaggcugagguaggaggauugcuugaggccaaggguuugagaccagcaugggcaacagagugagaccugugucuacaaaaaaaaaaaauuuuaauaaaaaauaaauuaaaaaaaagaauucacuggaagaacauccaagaacaaaaaaaaaaacgaaaaaucucuuaagauucacgaaagaugaaacuaugugaacaucugaauaguaaaaguaaauuagaauauaguucagacaccaaaagcaaauacaaauuguacuuaguguuaaaacacuauaaauauuccauuuuuaauuuuuaucuauuuauuuauuuauuuagagacagggucuugcucugucacccaggcuguaguggcaugaucaugguucaccacagcuucgaccucccaggcucaagcaaacucccaucucagccucccaaguagcugggacuacaggcguguggcaccaugcccagcuaauuuuuaaauuuuuuuuguagagacagggucucacuguguugcccaggcugucuugaacuccuaggcucaagugauccuccugccucagccccgcaaagcacugggauuacaggaaugagccaaagugcucagccuuauuuuuuauuaaaaaacgaaaaagagauaagaaaaaaaaguucccuuuaaagaucagaauaagacagggauacaugugaauacugcuguuguugccuggauauccuaaacaauuuuaaaucacauaaaaaaaacuauacgcauaauuaggaagaaacucuacugguuugcagaucaucuaacuguguguauaggaaauccaagagaaucaaaugaaacacaacuagaggccaggugcaguggcucacgccuguaaucccaguacuuugggaggcugaggcagguggaucauuugaggucaggaauucgagaccaaccuggccaacauggcaaaacccugucucuacuaaaacuacaaaaauuagccagguaugguggcaggcgccuguaauaccagcuacucgggaggcugaggcacaagaauugcuugaacccgggaggcggagguugcaguaagcugagauugugccacugcacuccagccugagcgacagagcaagacuccgucucgaaagaaagaaagaaaaacaacuagaaccaauaagaaaaaagauuacuuugaugaauacauuaaaaagcauaucuagagaaauuaaauuucuagaccuagagaaaacaauaaaaucauauuuaaggacacaaaagguuugaaugaaaaucaguagaugcaccacauucuaaaauuuccauucucuccaaauuuauaaauucaauguaauccaaauguaaaaaugagacauuuuucccguuuuggacugggcaagccaguuucuuuuucuuuucucucuuuuuuucagacacggcgucuuccuauguuucccagacuagaguucaguggguauucgcaggcaugaucauuauacacuacagcccugaacuccugggcucaagugacgcuccugccuuggccugcugaguagcugcaauuaacaagcuaauuucaaaguaaacaggcaagcucuuuuuaagaagguagaauagugaaaguguacuggcuuaugagguaucuaaacauaccacuaaguuucuggcagacagaucaaagcaacaaaauacauacaguaguugaguaacaaaucucucauauguuuaguauaugacauaguucacauuucaaauaaguggaaaaagaaugcaaaacagauacccaaaucacugugauagaaaauuaaaguauccauacggaaaauaaguuagauuuugccucaugucauaccuacaaauaaauuccagauagauuaguaucucaaugauaaaugcacaacauaaggaaauacaggaaccuaaguaaucccaggaucaugaaggccuugcaacauauuaagaaaacauuaauaccuaaaauacauaauuauaauuuaauuagaaaaagacauccuaguuaaaacagaaacaaaagcaaaaacaaaaaagcuaauucacagaagagaagccugaaugaccaauacauaugaaaagaugcucaaagaaugauaauaucuagugcuacugagaguaugggaaaaccagcccaucacagccuauugguguaaaucauuguuuugguacaauuaaguauauaaggauauuuaauuuuuacacacacagucuuccaacaguuuguaaaaucaacauaaugggaacaacuccuaugucgucaauacagcaaugguuaaaucaauguaggguuuauguacucccaagaagggauauguauaaaugacaacccauuaaagagcagaaaauuuuauauuuguaucuuauccuuuugaaaugucuuucugcguauuucauaaugacuuaaaugacuuaaaagucauaaaugacuuaaaaauagguaaacacacaacacacuggcaggaaguacgugcucaaauuauuuuuuacugagggaauauacaaccaaaaaauuuuauagaucacuguuacaaaacauuguauaucuacaaaauuaaugauucaauuauuaaaaauauaaauguuccuauaugcauuguuauaaaaagauaaugaacaaggcuaaagaaaaauauuucaucuaaaaauaauuauaaauaauaguuuaugguaguacacagagaagaaaacacugacagacugugcagacugcuguugucuuucagagucgggaucauaggacaugguaccuuucuguuuuauguacuuuugcaacuaacuuauuaauuauauggucagaagaaaaauuccuucaagagacuucaaaguccuuuaacuucuuggagagccaucuaaaaggaugcucaguaguuuaauuguuaauaaugaaaaauuagaaaucacauaaauuucuaccaagaggauuauaauaauguuauauacaacaguaauuuauaucauauaaauuaagucauucuuaaaaguggaguuuuggccgggcgcgguggcucacgccuauaauuccagcacuuugggaggccgaggcgggcggaucacaagaucaggagaucgagaucauccuggcuaacacggugaaacccugucucuacuaaaagauagaaaaaauuagccaggcgugguggcgagcaccuguagucccagcuacucgggaggcugaggcaggagaauggcgugaacucgggaggcggagcuugcagugagccaagauccugccacugcacuccagccugggcgacagagcaagacuccguuucaaaaaaaaaaaaaguagaguuuuaggccaggcacgguggcucacaccuguaaucccagcacuuugggaggccgaggcagguggaucaccugagaucaggaguucgagaccagccuggccaacaugaugaaacccccaucucuacuaaaaauacaaagaaauuagcuggcguggcggcgggcaccuauaauucuagcuacucaggaggcugaggcagaagaaucgcuugaacccaagagguggagguugcagugagccgauaucgcgccacugcacuccagccugggcaacaagagugaaacuccuucucggaaaaaaaaaaaaaagucgaguuucgaauaacauaguuaaaaacaugagauaaaaauuauaauacauauaugcaucuuaguaugauccugaauuugugaagauaaaaaaagaaaaaacaacuggagaaauauguacaucaaaaugguaacaacaguuauaucuaaaugguggcauuaaagguaauuuuaaaauucucuguaagauuaaaaauuuuuaaacuuuuucuuaagauuaauuuauauacuauaaauuucaccuuucaucuguuuuaacugcauauuaaaugaauuuuaauaugccugcgaguccgaccucugggggauaggagacugaauagcuaauuucagucacagcugacaccucaauaaaaccugguuaccaaggcuuggugggcuucccuagauggcaagacuuagcauguauugccacauaucacaucaguacugaagaauuaaaugcacccccucucccccugugggacucccugggaaggggacaccuagaauuuugugucugguuuauccuacacuucauucuauaugucuuuguugacuuuaaccuauaucccauugcuguaauaaacuaugacuguaacaagcauuuuugagucuuaugagucuuggcccaaucaucuaaccugaggauggucuuggggucccccaauacaacauuaugcacugaaauaagacucaauaaaauaagaagucucagcuggaguggcagcucacgccuauaauccuagcacuaggcugagggcaggcggauugcuugagcccaggaguucaagacuagccuaggcaguaucgcaaaaccccgugucuauacaaaacuacaaaaauucgcugggcgugguggugcacaccuguggucccagcuacuuaggaggcugaggugggaggaucaagaaccugagaggucgagggaugggggcagugagcuaugaucaagccacugcacuucagucuaggugaaagagacccugucuccaaaaagaaaaaaaaagucugaauacauacagaagaaucuuuaugaugagauuuauaucaugccaaucucagcauauuucaacauaagaaaaaaauggaaaauacauucuuucaggauauugcuaaaugaacaaauuaucacggcucuaccauauucaagacuacuaaaaugucagucaaacuuaccaacggguacgaauggugccucuuuagcuuuucgaaugaguuuugaucccugaucuuccucauaugaaggaagggaaacaccugugucuguugacauagugauugcuugaagaaucucccugagaaagaauuucuaugagguucuguaauuaaaagcaucugaacauuauuaaauaucuggauguauuuaaaauauuccuaacuuccaugagaaucuuaguauauguuauccauaauccuaaaguuaaaaaauauuuuuagaaauuaacuguauuuuuaauguacagucacucucaagggagaguuguauacacuuauucccccuauuauuuugccguuuccccuguacaacccauucauuuuuagcaccauguuaauuaaaaauagugaaaaauuuuaaauugauguuacuuuuaucaauuaaaauaguagcuacuaauuuucuggcuaucuucauccuuaaucaacuauuuaacuugacaauuuuaaguuacucaaaccaaacugacaacuccuauugaaccuucaauaucauguuggaaauccuacuuagcacuuuucgguguaguuaaaugcagucuuuauugcuuucaacugcugauuuauuuauuccaaugugcuuccuugcuucaauuuucacuucagauuaguuuccagucuauuacaguaaucuguuauccauggugguugccucuggggaaaagauuauucugaauagccaaaguuucuaccuagcucauuauuuacucauuuuaagaacaaagcuuuuauuuuaaauauugguagaaaugucuccuucauagccuuuuagauuuuuuuaaugaccuaugauuaguuuuuuuucuuuuuugagacugagucuugcucuguugcccaggguggagugcaguggcacgaucucggcucacugcaaccuccauuuggcacacaccaccgugccuaauuuuuuuguauucuuuaguagagacaggguuucacuccugaccucacgugauccacccaccucagccucccaaacugcugggauuacaggugugagccacugugccagcuuaugauuagcuuuuuuuuuuuuuuuugagauggaguuucguucuuguugcccaggcuggagugcaauggcguagucuugguucacugcaaccucugccucccagguucaagugauucuccugccucagccucccaaauaccugggauuagaagugccugccaccaugccuggcuaauuuuuuuuguauuuuuaguagagaugggguuucaccaucuugaccaggcuggucucgaacuccugaccucaggugauccaccugccucccaguguugggauuacaggcaugagcuaccacaccuggcccuaugauuagcaccuuuuaacaucacugcagcacaaaacugaauuacccucagggucuucuuaauaucuucuaagcuucagaucugccuucauuuacauaccuuauauccccuaggcuuccuuuuaaaacucuacccucuuuuuauaauuccuuuaaaugguaucccaaaggcaagaucuagccugauaguguaugaguaaggggauaggaaaaaaaaaaaaaggauucauuuucauuaucacagggaucaaaggcuccuuuccuccuuuucagucaucuccgugaauagcccuuuuaucacaaugaggcauuaacaaaugcuauuucauuuuagccacaauaacaaaguauacuuucuucacugaacuauuuugaauugcaauaaacuuuacucacagauaaaauaagggccugaagcauaguguaagcauacaagucucuaauuagugucaauuacaauaaacuuaaaagucuaugcccauccuaacacccauauaaaaucuuacuuucacuucuggguuuuucaugugcauuaugcucccuuugauaaaaguaccucucauucaacaccuugcuacucaaggggagucaguggcaguuaagguccucaacaaaaaugcaacuccggaggggguggugugcuuaguuuagaaagugaauucaucccuauaagccucaccuucauugagaagacucaacugucaucugacauagaagaaaaucuuagcuaaauaaaagaaaauuuagauuggacuuaaaccuucuuuuuguacuccauuacuucuuaacugaauaaacuccuaaguaaugagcuuuauuauauauaagguucaauaagcucaagguucaagauacucacuauauaucugaauaauacaauauaaacacuaaaguaauuaaucguucaaaaauuaguuguuguuuuuuuuuuuaaaaaaaaaagagaaaucauguaaccgccaaacagguucaccuugcccgcuggcuagacagagcugauuuaccaagacaggggaauugcaauagagaaagagcaauucacccaaagccagcugugugggagaccaggauuuuuauuauuagucaaaucagucucuuggagcauucagggaucaguuuuuaaggauaauuuggugggugggggaaggccagagaacagagugcugauugguuggguuggagaugaaaugggaaguugaagcuguccucuugugcugagucaguuccuagguaggggacauaagaucagacgagccaguuuauugaucuggguggugccaguuggucuaucaagugcagggucugcaaaauaucucaagcacugaucuuaggagcauuuuagggaggguuagaaucuuauaacuuccgucccucucccucucccucucccucuccgucucccucuccgucucccucucccucucccuccuucuccgucuccgucuccgucuccgucuccgucucccucuccccacggucucccucucaugcggagccgaagcuggacuguacugcugccaucucggcucacugcaaccucccugccugauucuccugccucagccugccgagugccugcgauugcaggcacgcgccgccacgccugacugguuuugguggagacgggguuucgcuguguuggccgggccggucuccagccccuaaccgcgagugauccgccaaccucggccucccgaggugccgggauugcagacggagucucguucacucagugcucaguggugcccaggcuggagugcaguggcgugaucucggcucacuacaaccuccaccucccagccgccugccuuggccucccaaagugccgagauugcagccucugcccggccgccaccccgucugggaagugaggagugucucugccuggccgcccaucgucugggaugugaggagccccucugcccggccgcccagucugggaagugaggagcgucuccgcccggccgccaucccaucuaggaagugaggagcgccucuucccagccgccaucacaucuaggaagugaggagcgucucugcccggccgcccaucgucugagauguggggagcgccucugccccaccgccccaucugggaugugaggagcgccucugcccggccgagaccccgucugggaggugaggagcgucucugcccggccgccccgucugagaagugaggagacccucugccuggcaaccaccccgucugagaagugaggagccccuccgcccggcagcugccccgucugagaagugaggagccucuccgcccagcagccaccccaucugggaagugaggagcaucuccgcccggcagccaccccguccgggagggaggugagggggggucagccccccgcccggccagccgccccauccgggagggagguggggggucagccccccgcccggccagccgugccauccgggagggaggugggggggucagccccccgcccggccagccgcccgguccgggaggugaggggcgccucugcccggccgccccuacugggaagugaggagccccucugcccggccagccgccccguccgggagggaggugggggggucagcccuccgcccggccagccgccccgucugggaggugaggggcgccucugcccggccgccccuacugggaagugaggagccccucugcccggccagccgccccguccgggagggaggugggggggucggccccccgcccggccagccgccccguccgggagggaggugggggugucggccccccgcccggccagccgccccguccgggagggagguggggggggucagcuccccugcccggccagccgccccguccgggaggugaggggcgccucugcccggccaccccuacugggaagugaggagccccucugcccggccagccgccccguccgcgagggaggugggggggucagccccccgcccggccagccgccccguccgggagggagguggggggggucagccccccugcccggccagccgccccgucugggaggugaggggcgccucugcccggccgccccuacugggaagugaggagccccucuggcuggccagccgccccguccgggagggagguggggggucagccccccgaccggccagccgccccguccgggagggagguggggggggucagccccccgcccggccagccgccccgcccgggaggugaggggcgccucugcccggccgccccuacugggaagugaggagccccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucugcacuaagaaaaauuccucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccaaucccuaaucucaaguaaucagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaauaaaaaaauaaauuaaaaaaaaaaaaaaaaaaaaaagaaucuuauaacuuccagcugcacgacuccuaaaccauaauuucuaaucuguggcuaauucauuaaaccuacaaaggcagucuaguccccaggcaagaaggggguuuguuuuaggaaagggcuguuaccaucuuugcuuuauuuuucuauuuuuguuuuaugagacagggucuaguugccacgcaggcuggagcacgaucucgaucuuugcucaccgcaaccucugccuccgagguuugagugauuugugccuuagccuaacagcugggauaacaggugugcaccaccaugccugguuuuuuuuuuuuguauuuuuaguauagaugggguuuugccauguuggccagccuggucucaaacuccuggccccaagugauuugcccgccucagccucccaaagugcuaggauuauagacgugaaccaucaugccuggcuccaucuuuuuuuggcuaggucagaucucuuucacugucucaguuauaauuuugcaauggugguuucaaucacaguguaauuaguugucaaaagccuaacacagacaaggucugaauuuagagagagugauguauuuuagcuaaaggagguuuggcacguuucacagagaaacacuugagacuggcuuugaagaaacugcauaaauggacuggauagagagauuaaacacuguauuuauuuuaggccaguauguuuacuaguugccuucauaucuaaucaugaacuucucgggcaggugcgguggcucaugccuguaaucccagcacuuuggggcaccaaggugggcaaucacuugaggucaggaguucgaaaccagccuggucaacauggugaaacccccaucucuacuaaaaauacaaaaauuagcugggcauaguggugugcaugccugaaaucccagcuacuugggaagcugaggcaggaggaucgcuugaacccgggaggcagagguugcagugcgcugaaauugugcaacugcacuccagccugggccacagagagacucugucucaaauuuuaaaaaauaaaagaaaaagaaaaagaaaaagaaaaaaaaaacaugaccuucucaaaggggaaguuuaucacaaauccuuucauuucccuucccaaccccacauucugaccacauuaaauauuuuuaagaugcucucuauaccucuaagccuuugcacaagcugauuccucuacuugugagaguuucccucccuuuccauccccuucagauacucuuuccuagcuaacuccucccauuuuuuuuuucagguuugguuuuucuuuuuuuacacugagucagaacauuauuuuaauaguuacaaaacuuuuuuuuuaacagaaucaguauaaaauagcaguugauuucuccauaauuaucagaauuauuuauauuugaggucuugccuaaguggggcugaaaucaacaaaaggucuuggacuacuggcucagaaaucauccuaggaagcccgcccuguugacauuugucaugcuuagcucuuaugagaugacccgguccuuuaaaaaaaaaaaaaguaucuccguuuauucuguuuauuuggagguuugaagugaauucggcagcauucauuaaacuccuuccagcuccugucauuuaucauucugacuacauccauuucaacuuugccugcucuguucugaguugcuuuaacaauauuaaaucguccaaauucuuuucucucucuucucagagguuuuuuacuacugcugaggucugggcuauauaguuuuuuaugacucugucccuacuggcaugagcugccaucaaagacucaaaguuguuuacagguuuggcuggcaucaaucuucccugcaaaggaagcuguuggaacuguaguguuuaauuaauguacuagucuguaucaacuguccacaucaccuugaguaauuccuggaacucggcgaacuccucacaguucacacugccacugggugccaccauacuggacucagguucacaucuuaauugaccuccucucagaaauuuuugucucuuuaaguucguaagugcuuugguuaugcagucccauaggaccuuguacuuuccuuauaacccuuauaagcaccaguuugucuguuucuuuugcuagaauccuucaagucagggaccaauaccugcucugcuuguauccaacuccacugccuggugcaauacccuauauauaauauguacacuacaaauguuucuugaauacauuuaaaaguuacauuucucaacaacugaaagcauucuuagguuauucaguaauauugaguacaaaaaaauaacaaucauacagauuuguagaguuuaaucaguaagaaaaaugccuaacuguauguaccuaagugcuuauuucuuuuauguuucuuauauuguaccuaugaaaagagaaauaaccugaggucuuaguuccuugcaacacaggggacaaaacuauuauauaccauaauccacuuuuaaaaacuaaaaacuucugcagauauaaaagcauguuuuccccuuuuuugccugaaucauuucuaaacuaaaaaaucauuugggaauugucuuuaaaagcaagaaaguugguagccgggcaugguggugcacaccuguagucccagcuccucaggaggcugaggcaggagggcugcuugagccuggaaaguggagguugcggugagccaugauccagccacugcacuccagccggggcaacaggcaagacccuugcugagggacccaacaaacaaacaaaaacaggacauaaaucguuuuuuaaaaauagcaagaaaguugguaguuuuucuuauaauuaucucacaucuggcugacucuaauucuccaacaggucaauggagcaaaagguuuuuuuuuuuuucuccuuucaggagggaggggguuaguugucucuuuccuguauauaaaucaagaacagaagaaaaccuauuucuccguucuucaucuaugauacagacucugaagcuuguauggauagggcauuugaccuggguuucagaaaguagccccugcgguaagcaucaggguguggggaacaaaauggucauuauuugcuugaaacgacagaugauaaucugucugugauuccagaauaccuuauguguacauuucagaauaaaauuaguaaggauuaauauuuaaaaauccaacacauaucaguuauuuguuauucuguagucaaaauauuauaauucccauauaguacauaucuaaaauacucucugaauacaaaauuuugauaacugucuaauuaccacguagaaguuuccaaaguauucaugguuuauagccaccugaauugaaaacugguuaaguaucaggaacaauaaguucuaaucauauaauuugagaguaacaaaucagaugaauaauccaagccaauagccuuauuuuacagguggggaaaggguugugagaggguuauacgaauugcucaguacaaggaauacaugucuggugggguaggauuagaauccagcucuucugauagagaguccuggguucuuuugauugacgauauauugccaaagcaucaaucuuacgcugcugauguaaauuagauuaaauuggcagauaagaauucugauuagaaaauuuaagaauccauuacucaacagaagcccacguuguucucuuugaaugauauauauaaaaaaaucaugccuaagguaaacggaaucuucuucagugacuuaacucaucuaacaauuucaauugugauuugaaaagacuuuuuucacuacaccacugccagacuuuccuucauuaucguuuucucauccacccacaguaguugucccagauuucugucagaaaguugaauagacgcuaaaaaaggcaccaguaaccagauauuuaaagucaguuuggagagcacaaauuaauucuguacgcuuaguaagacacgacugaagaccuuuccacagggaaccuaaagaggcauuaagggaagaugagccguccagcaucaggagacguaacagguugaaugaaggaucuuucuucacagucauuuugucacgggaauuacuaucuaaagcaacgcuggcuucaaacugauuuugcaucagucgcccaucagcuuguuuaaaauggcugccaaggccccagcauggagauccggauucagguggucuggggcagagcucaaggaaucuuuaagaagccccuucaagugacucuggugcacaaagagaacuccuaguauacaggacuccaaauaugugugucaugcuggagcuucaugaccagguugucaccgcuucaaccuguuagaacuuuccauccaaaccugucuuacuccaaagugccuuuguacuuccggaagcagggaucccugucguggggauuacuccgaagagggaaauagcugcuucccacuccgggaauuuaagacaaaggcgaauaucacugcugcaucaugucggcugcuccuaauucugcccuuacgcugugcuuuguaaucucuaacccgccgacucggcaggagaaaaauuuaauucggucacagaagcacuacacaggacccuaggccuuaucacuuucccaggguggaggaaacaccaggucggggagaaaagcaagaccaggacuggaagguccucugcuaguacgcccuccccucaaccucccgaccuuccucgccgccucucuuccugugaccuugucgugacuccgugaccggagcgcucgcucuccuaucccgccucgccugccgcuuagcccgcucuucagaauguuccaagcuccggggaagcucccgcuccucgcuccccgccgucgggcccagucaacacccuccuggcccccgucucucauuaccaccccaucagcgagucuuccccgcucggcaacucacuccacaagcuucugcuccaucuccucgcuggcuccgucuccccucacccgaaggacccuaggccucggcucccgacuccucucauccgcccaugcucgaggccgggccugagccccggcaacuccaccucuccucccucauucgagacacggacucccagcccccacccccaaaguccuuucggccuggccaagcgcugccccacuucuucccgccccgcggcccgagucccuggcucgcagucccccggcuuguuucgcuuaccuagagcgagaaaaccucucacaccccaaccggcuuccgaucccugcaggcgcacccaguccucccggcuucuccccacccacagccgucccagccaaucagaggccagcggccgcaaaaggacgcgugcgugugcgcggcggguggggcagugcagagcggguccuggauuggcugggccggugagugcuggcccacuaccccggcucuagcguacuggcggagacagacgugagagcucggcgccugggguucgcgcccgggcacuugaggggcuuuggcuccuggcccaaggacuccucagauuucuccugcccuuuuccccucgggcagcggaggcgagcaccgcgaacgccgug

SEQ ID NO: 16179 - RNA, 20496 nt, Homo sapiens
cacggcguucgcggugcucgccuccgcugcccgaggggaaaagggcaggagaaaucugaggaguccuugggccaggagccaaagccccucaagugcccgggcgcgaaccccaggcgccgagcucucacgucugucuccgccaguacgcuagagccgggguagugggccagcacucaccggcccagccaauccaggacccgcucugcacugccccacccgccgcgcacacgcacgcguccuuuugcggccgcuggccucugauuggcugggacggcuguggguggggagaagccgggaggacugggugcgccugcagggaucggaagccgguuggggugugagagguuuucucgcucuagguaagcgaaacaagccgggggacugcgagccagggacucgggccgcggggcgggaagaaguggggcagcgcuuggccaggccgaaaggacuuugggggugggggcugggaguccgugucucgaaugagggaggagagguggaguugccggggcucaggcccggccucgagcaugggcggaugagaggagucgggagccgaggccuaggguccuucgggugaggggagacggagccagcgaggagauggagcagaagcuuguggagugaguugccgagcggggaagacucgcugauggggugguaaugagagacgggggccaggaggguguugacugggcccgacggcggggagcgaggagcgggagcuuccccggagcuuggaacauucugaagagcgggcuaagcggcaggcgaggcgggauaggagagcgagcgcuccggucacggagucacgacaaggucacaggaagagaggcggcgaggaaggucgggagguugaggggagggcguacuagcagaggaccuuccaguccuggucuugcuuuucuccccgaccugguguuuccuccacccugggaaagugauaaggccuaggguccuguguagugcuucugugaccgaauuaaauuuuucuccugccgagucggcggguuagagauuacaaagcacagcguaagggcagaauuaggagcagccgacaugaugcagcagugauauucgccuuugucuuaaauucccggagugggaagcagcuauuucccucuucggaguaauccccacgacagggaucccugcuuccggaaguacaaaggcacuuuggaguaagacagguuuggauggaaaguucuaacagguugaagcggugacaaccuggucaugaagcuccagcaugacacacauauuuggaguccuguauacuaggaguucucuuugugcaccagagucacuugaaggggcuucuuaaagauuccuugagcucugccccagaccaccugaauccggaucuccaugcuggggccuuggcagccauuuuaaacaagcugaugggcgacugaugcaaaaucaguuugaagccagcguugcuuuagauaguaauucccgugacaaaaugacugugaagaaagauccuucauucaaccuguuacgucuccugaugcuggacggcucaucuucccuuaaugccucuuuagguucccuguggaaaggucuucagucgugucuuacuaagcguacagaauuaauuugugcucuccaaacugacuuuaaauaucugguuacuggugccuuuuuuagcgucuauucaacuuucugacagaaaucugggacaacuacuguggguggaugagaaaacgauaaugaaggaaagucuggcagugguguagugaaaaaagucuuuucaaaucacaauugaaauuguuagaugaguuaagucacugaagaagauuccguuuaccuuaggcaugauuuuuuuauauauaucauucaaagagaacaacgugggcuucuguugaguaauggauucuuaaauuuucuaaucagaauucuuaucugccaauuuaaucuaauuuacaucagcagcguaagauugaugcuuuggcaauauaucgucaaucaaaagaacccaggacucucuaucagaagagcuggauucuaauccuaccccaccagacauguauuccuuguacugagcaauucguauaacccucucacaacccuuuccccaccuguaaaauaaggcuauuggcuuggauuauucaucugauuuguuacucucaaauuauaugauuagaacuuauuguuccugauacuuaaccaguuuucaauucagguggcuauaaaccaugaauacuuuggaaacuucuacgugguaauuagacaguuaucaaaauuuuguauucagagaguauuuuagauauguacuauaugggaauuauaauauuuugacuacagaauaacaaauaacugauauguguuggauuuuuaaauauuaauccuuacuaauuuuauucugaaauguacacauaagguauucuggaaucacagacagauuaucaucugucguuucaagcaaauaaugaccauuuuguuccccacacccugaugcuuaccgcaggggcuacuuucugaaacccaggucaaaugcccuauccauacaagcuucagagucuguaucauagaugaagaacggagaaauagguuuucuucuguucuugauuuauauacaggaaagagacaacuaacccccucccuccugaaaggagaaaaaaaaaaaaaccuuuugcuccauugaccuguuggagaauuagagucagccagaugugagauaauuauaagaaaaacuaccaacuuucuugcuauuuuuaaaaaacgauuuauguccuguuuuuguuuguuuguugggucccucagcaagggucuugccuguugccccggcuggagugcaguggcuggaucauggcucaccgcaaccuccacuuuccaggcucaagcagcccuccugccucagccuccugaggagcugggacuacaggugugcaccaccaugcccggcuaccaacuuucuugcuuuuaaagacaauucccaaaugauuuuuuaguuuagaaaugauucaggcaaaaaaggggaaaacaugcuuuuauaucugcagaaguuuuuaguuuuuaaaaguggauuaugguauauaauaguuuuguccccuguguugcaaggaacuaagaccucagguuauuucucuuuucauagguacaauauaagaaacauaaaagaaauaagcacuuagguacauacaguuaggcauuuuucuuacugauuaaacucuacaaaucuguaugauuguuauuuuuuuguacucaauauuacugaauaaccuaagaaugcuuucaguuguugagaaauguaacuuuuaaauguauucaagaaacauuuguaguguacauauuauauauaggguauugcaccaggcaguggaguuggauacaagcagagcagguauuggucccugacuugaaggauucuagcaaaagaaacagacaaacuggugcuuauaaggguuauaaggaaaguacaagguccuaugggacugcauaaccaaagcacuuacgaacuuaaagagacaaaaauuucugagaggaggucaauuaagaugugaaccugaguccaguaugguggcacccaguggcagugugaacugugaggaguucgccgaguuccaggaauuacucaaggugauguggacaguugauacagacuaguacauuaauuaaacacuacaguuccaacagcuuccuuugcagggaagauugaugccagccaaaccuguaaacaacuuugagucuuugauggcagcucaugccaguagggacagagucauaaaaaacuauauagcccagaccucagcaguaguaaaaaaccucugagaagagagagaaaagaauuuggacgauuuaauauuguuaaagcaacucagaacagagcaggcaaaguugaaauggauguagucagaaugauaaaugacaggagcuggaaggaguuuaaugaaugcugccgaauucacuucaaaccuccaaauaaacagaauaaacggagauacuuuuuuuuuuuuuaaaggaccgggucaucucauaagagcuaagcaugacaaaugucaacagggcgggcuuccuaggaugauuucugagccaguaguccaagaccuuuuguugauuucagccccacuuaggcaagaccucaaauauaaauaauucugauaauuauggagaaaucaacugcuauuuuauacugauucuguuaaaaaaaaaguuuuguaacuauuaaaauaauguucugacucaguguaaaaaaagaaaaaccaaaccugaaaaaaaaaaugggaggaguuagcuaggaaagaguaucugaaggggauggaaagggagggaaacucucacaaguagaggaaucagcuugugcaaaggcuuagagguauagagagcaucuuaaaaauauuuaauguggucagaaugugggguugggaagggaaaugaaaggauuugugauaaacuuccccuuugagaaggucauguuuuuuuuuucuuuuucuuuuucuuuuucuuuuauuuuuuaaaauuugagacagagucucucuguggcccaggcuggagugcaguugcacaauuucagcgcacugcaaccucugccucccggguucaagcgauccuccugccucagcuucccaaguagcugggauuucaggcaugcacaccacuaugcccagcuaauuuuuguauuuuuaguagagauggggguuucaccauguugaccaggcugguuucgaacuccugaccucaagugauugcccaccuuggugccccaaagugcugggauuacaggcaugagccaccgcaccugcccgagaaguucaugauuagauaugaaggcaacuaguaaacauacuggccuaaaauaaauacaguguuuaaucucucuauccaguccauuuaugcaguuucuucaaagccagucucaaguguuucucugugaaacgugccaaaccuccuuuagcuaaaauacaucacucucucuaaauucagaccuugucuguguuaggcuuuugacaacuaauuacacugugauugaaaccaccauugcaaaauuauaacugagacagugaaagagaucugaccuagccaaaaaaagauggagccaggcaugaugguucacgucuauaauccuagcacuuugggaggcugaggcgggcaaaucacuuggggccaggaguuugagaccaggcuggccaacauggcaaaaccccaucuauacuaaaaauacaaaaaaaaaaaaccaggcaugguggugcacaccuguuaucccagcuguuaggcuaaggcacaaaucacucaaaccucggaggcagagguugcggugagcaaagaucgagaucgugcuccagccugcguggcaacuagacccugucucauaaaacaaaaauagaaaaauaaagcaaagaugguaacagcccuuuccuaaaacaaacccccuucuugccuggggacuagacugccuuuguagguuuaaugaauuagccacagauuagaaauuaugguuuaggagucgugcagcuggaaguuauaagauucuuuuuuuuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccgggcggggcggcuggccgggcggggggcugaccccccccaccucccucccggacggggcggcuggccggucggggggcugaccccccaccucccucccggacggggcggcuggccagccagaggggcuccucacuucccaguaggggcggccgggcagaggcgccccucaccucccagacggggcggcuggccgggcaggggggcugaccccccccaccucccucccggacggggcggcuggccgggcggggggcugacccccccaccucccucgcggacggggcggcuggccgggcagaggggcuccucacuucccaguagggguggccgggcagaggcgccccucaccucccggacggggcggcuggccgggcaggggagcugaccccccccaccucccucccggacggggcggcuggccgggcggggggccgacacccccaccucccucccggacggggcggcuggccgggcggggggccgacccccccaccucccucccggacggggcggcuggccgggcagaggggcuccucacuucccaguaggggcggccgggcagaggcgccccucaccucccagacggggcggcuggccgggcggagggcugacccccccaccucccucccggacggggcggcuggccgggcagaggggcuccucacuucccaguaggggcggccgggcagaggcgccccucaccucccggaccgggcggcuggccgggcggggggcugacccccccaccucccucccggauggcacggcuggccgggcggggggcugaccccccaccucccucccggauggggcggcuggccgggcggggggcugacccccccucaccucccucccggacgggguggcugccgggcggagaugcuccucacuucccagaugggguggcugcugggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcgguggggcagaggcgcuccccacaucucagacgaugggcggccgggcagagacgcuccucacuuccuagaugugauggcggcugggaagaggcgcuccucacuuccuagaugggauggcggccgggcggagacgcuccucacuucccagacugggcggccgggcagaggggcuccucacaucccagacgaugggcggccaggcagagacacuccucacuucccagacgggguggcggccgggcagaggcugcaaucucggcacuuugggaggccaaggcaggcggcugggagguggagguuguagugagccgagaucacgccacugcacuccagccugggcaccacugagcacugagugaacgagacuccgucugcaaucccggcaccucgggaggccgagguuggcggaucacucgcgguuaggggcuggagaccggcccggccaacacagcgaaaccccgucuccaccaaaaccagucaggcguggcggcgcgugccugcaaucgcaggcacucggcaggcugaggcaggagaaucaggcagggagguugcagugagccgagauggcagcaguacaguccagcuucggcuccgcaugagagggagaccguggggagagggagacggagacggagacggagacggagacggagaaggagggagagggagagggagacggagagggagacggagagggagagggagagggagagggacggaaguuauaagauucuaacccucccuaaaaugcuccuaagaucagugcuugagauauuuugcagacccugcacuugauagaccaacuggcaccacccagaucaauaaacuggcucgucugaucuuauguccccuaccuaggaacugacucagcacaagaggacagcuucaacuucccauuucaucuccaacccaaccaaucagcacucuguucucuggccuucccccacccaccaaauuauccuuaaaaacugaucccugaaugcuccaagagacugauuugacuaauaauaaaaauccuggucucccacacagcuggcuuugggugaauugcucuuucucuauugcaauuccccugucuugguaaaucagcucugucuagccagcgggcaaggugaaccuguuuggcgguuacaugauuucucuuuuuuuuuuaaaaaaaaaaacaacaacuaauuuuugaacgauuaauuacuuuaguguuuauauuguauuauucagauauauagugaguaucuugaaccuugagcuuauugaaccuuauauauaauaaagcucauuacuuaggaguuuauucaguuaagaaguaauggaguacaaaaagaagguuuaaguccaaucuaaauuuucuuuuauuuagcuaagauuuucuucuaugucagaugacaguugagucuucucaaugaaggugaggcuuauagggaugaauucacuuucuaaacuaagcacaccacccccuccggaguugcauuuuuguugaggaccuuaacugccacugacuccccuugaguagcaagguguugaaugagagguacuuuuaucaaagggagcauaaugcacaugaaaaacccagaagugaaaguaagauuuuauauggguguuaggaugggcauagacuuuuaaguuuauuguaauugacacuaauuagagacuuguaugcuuacacuaugcuucaggcccuuauuuuaucugugaguaaaguuuauugcaauucaaaauaguucagugaagaaaguauacuuuguuauuguggcuaaaaugaaauagcauuuguuaaugccucauugugauaaaagggcuauucacggagaugacugaaaaggaggaaaggagccuuugaucccugugauaaugaaaaugaauccuuuuuuuuuuuuuccuauccccuuacucauacacuaucaggcuagaucuugccuuugggauaccauuuaaaggaauuauaaaaagaggguagaguuuuaaaaggaagccuaggggauauaagguauguaaaugaaggcagaucugaagcuuagaagauauuaagaagacccugaggguaauucaguuuugugcugcagugauguuaaaaggugcuaaucauagggccaggugugguagcucaugccuguaaucccaacacugggaggcagguggaucaccugaggucaggaguucgagaccagccuggucaagauggugaaaccccaucucuacuaaaaauacaaaaaaaauuagccaggcaugguggcaggcacuucuaaucccagguauuugggaggcugaggcaggagaaucacuugaaccugggaggcagagguugcagugaaccaagacuacgccauugcacuccagccugggcaacaagaacgaaacuccaucucaaaaaaaaaaaaaaaagcuaaucauaagcuggcacaguggcucacaccuguaaucccagcaguuugggaggcugagguggguggaucacgugaggucaggagugaaacccugucucuacuaaagaauacaaaaaaauuaggcacgguggugugugccaaauggagguugcagugagccgagaucgugccacugcacuccacccugggcaacagagcaagacucagucucaaaaaagaaaaaaaacuaaucauaggucauuaaaaaaaucuaaaaggcuaugaaggagacauuucuaccaauauuuaaaauaaaagcuuuguucuuaaaaugaguaaauaaugagcuagguagaaacuuuggcuauucagaauaaucuuuuccccagaggcaaccaccauggauaacagauuacuguaauagacuggaaacuaaucugaagugaaaauugaagcaaggaagcacauuggaauaaauaaaucagcaguugaaagcaauaaagacugcauuuaacuacaccgaaaagugcuaaguaggauuuccaacaugauauugaagguucaauaggaguugucaguuugguuugaguaacuuaaaauugucaaguuaaauaguugauuaaggaugaagauagccagaaaauuaguagcuacuauuuuaauugauaaaaguaacaucaauuuaaaauuuuucacuauuuuuaauuaacauggugcuaaaaaugaauggguuguacaggggaaacggcaaaauaauagggggaauaaguguauacaacucucccuugagagugacuguacauuaaaaauacaguuaauuucuaaaaauauuuuuuaacuuuaggauuauggauaacauauacuaagauucucauggaaguuaggaauauuuuaaauacauccagauauuuaauaauguucagaugcuuuuaauuacagaaccucauagaaauucuuucucagggagauucuucaagcaaucacuaugucaacagacacagguguuucccuuccuucauaugaggaagaucagggaucaaaacucauucgaaaagcuaaagaggcaccauucguacccguugguaaguuugacugacauuuuaguagucuugaauaugguagagccgugauaauuuguucauuuagcaauauccugaaagaauguauuuuccauuuuuuucuuauguugaaauaugcugagauuggcaugauauaaaucucaucauaaagauucuucuguauguauucagacuuuuuuuuucuuuuuggagacagggucucuuucaccuagacugaagugcaguggcuugaucauagcucacugcccccaucccucgaccucucagguucuugauccucccaccucagccuccuaaguagcugggaccacaggugugcaccaccacgcccagcgaauuuuuguaguuuuguauagacacgggguuuugcgauacugccuaggcuagucuugaacuccugggcucaagcaauccgccugcccucagccuagugcuaggauuauaggcgugagcugccacuccagcugagacuucuuauuuuauugagucuuauuucagugcauaauguuguauugggggaccccaagaccauccucagguuagaugauugggccaagacucauaagacucaaaaaugcuuguuacagucauaguuuauuacagcaaugggauauagguuaaagucaacaaagacauauagaaugaaguguaggauaaaccagacacaaaauucuagguguccccuucccagggagucccacagggggagagggggugcauuuaauucuucaguacugaugugauauguggcaauacaugcuaagucuugccaucuagggaagcccaccaagccuugguaaccagguuuuauugaggugucagcugugacugaaauuagcuauucagucuccuaucccccagaggucggacucgcaggcauauuaaaauucauuuaauaugcaguuaaaacagaugaaaggugaaauuuauaguauauaaauuaaucuuaagaaaaaguuuaaaaauuuuuaaucuuacagagaauuuuaaaauuaccuuuaaugccaccauuuagauauaacuguuguuaccauuuugauguacauauuucuccaguuguuuuuucuuuuuuuaucuucacaaauucaggaucauacuaagaugcauauauguauuauaauuuuuaucucauguuuuuaacuauguuauucgaaacucgacuuuuuuuuuuuuuuccgagaaggaguuucacucuuguugcccaggcuggagugcaguggcgcgauaucggcucacugcaaccuccaccucuuggguucaagcgauucuucugccucagccuccugaguagcuagaauuauaggugcccgccgccacgccagcuaauuucuuuguauuuuuaguagagauggggguuucaucauguuggccaggcuggucucgaacuccugaucucaggugauccaccugccucggccucccaaagugcugggauuacaggugugagccaccgugccuggccuaaaacucuacuuuuuuuuuuuuugaaacggagucuugcucugucgcccaggcuggagugcaguggcaggaucuuggcucacugcaagcuccgccucccgaguucacgccauucuccugccucagccucccgaguagcugggacuacaggugcucgccaccacgccuggcuaauuuuuucuaucuuuuaguagagacaggguuucaccguguuagccaggaugaucucgaucuccugaucuugugauccgcccgccucggccucccaaagugcuggaauuauaggcgugagccaccgcgcccggccaaaacuccacuuuuaagaaugacuuaauuuauaugauauaaauuacuguuguauauaacauuauuauaauccucuugguagaaauuuaugugauuucuaauuuuucauuauuaacaauuaaacuacugagcauccuuuuagauggcucuccaagaaguuaaaggacuuugaagucucuugaaggaauuuuucuucugaccauauaauuaauaaguuaguugcaaaaguacauaaaacagaaagguaccauguccuaugaucccgacucugaaagacaacagcagucugcacagucugucaguguuuucuucucuguguacuaccauaaacuauuauuuauaauuauuuuuagaugaaauauuuuucuuuagccuuguucauuaucuuuuuauaacaaugcauauaggaacauuuauauuuuuaauaauugaaucauuaauuuuguagauauacaauguuuuguaacagugaucuauaaaauuuuuugguuguauauucccucaguaaaaaauaauuugagcacguacuuccugccaguguguuguguguuuaccuauuuuuaagucauuuaugacuuuuaagucauuuaagucauuaugaaauacgcagaaagacauuucaaaaggauaagauacaaauauaaaauuuucugcucuuuaauggguugucauuuauacauaucccuucuugggaguacauaaacccuacauugauuuaaccauugcuguauugacgacauaggaguuguucccauuauguugauuuuacaaacuguuggaagacuguguguguaaaaauuaaauauccuuauauacuuaauuguaccaaaacaaugauuuacaccaauaggcugugaugggcugguuuucccauacucucaguagcacuagauauuaucauucuuugagcaucuuuucauauguauuggucauucaggcuucucuucugugaauuagcuuuuuuguuuuugcuuuuguuucuguuuuaacuaggaugucuuuuucuaauuaaauuauaauuauguauuuuagguauuaauguuuucuuaauauguugcaaggccuucaugauccugggauuacuuagguuccuguauuuccuuauguugugcauuuaucauugagauacuaaucuaucuggaauuuauuuguagguaugacaugaggcaaaaucuaacuuauuuuccguauggauacuuuaauuuucuaucacagugauuuggguaucuguuuugcauucuuuuuccacuuauuugaaaugugaacuaugucauauacuaaacauaugagagauuuguuacucaacuacuguauguauuuuguugcuuugaucugucugccagaaacuuagugguauguuuagauaccucauaagccaguacacuuucacuauucuaccuucuuaaaaagagcuugccuguuuacuuugaaauuagcuuguuaauugcagcuacucagcaggccaaggcaggagcgucacuugagcccaggaguucagggcuguaguguauaaugaucaugccugcgaauacccacugaacucuagucugggaaacauaggaagacgccgugucugaaaaaaagagagaaaagaaaaagaaacuggcuugcccaguccaaaacgggaaaaaugucucauuuuuacauuuggauuacauugaauuuauaaauuuggagagaauggaaauuuuagaauguggugcaucuacugauuuucauucaaaccuuuuguguccuuaaauaugauuuuauuguuuucucuaggucuagaaauuuaauuucucuagauaugcuuuuuaauguauucaucaaaguaaucuuuuuucuuauugguucuaguuguuuuucuuucuuucuuucgagacggagucuugcucugucgcucaggcuggagugcaguggcacaaucucagcuuacugcaaccuccgccucccggguucaagcaauucuugugccucagccucccgaguagcugguauuacaggcgccugccaccauaccuggcuaauuuuuguaguuuuaguagagacaggguuuugccauguuggccagguuggucucgaauuccugaccucaaaugauccaccugccucagccucccaaaguacugggauuacaggcgugagccacugcaccuggccucuaguuguguuucauuugauucucuuggauuuccuauacacacaguuagaugaucugcaaaccaguagaguuucuuccuaauuaugcguauaguuuuuuuuaugugauuuaaaauuguuuaggauauccaggcaacaacagcaguauucacauguaucccugucuuauucugaucuuuaaagggaacuuuuuuuucuuaucucuuuuucguuuuuuaauaaaaaauaaggcugagcacuuuggcucauuccuguaaucccagugcuuugcggggcugaggcaggaggaucacuugagccuaggaguucaagacagccugggcaacacagugagacccugucucuacaaaaaaaauuuaaaaauuagcugggcauggugccacacgccuguagucccagcuacuugggaggcugagaugggaguuugcuugagccugggaggucgaagcuguggugaaccaugaucaugccacuacagccugggugacagagcaagacccugucucuaaauaaauaaauaaauagauaaaaauuaaaaauggaauauuuauaguguuuuaacacuaaguacaauuuguauuugcuuuuggugucugaacuauauucuaauuuacuuuuacuauucagauguucacauaguuucaucuuucgugaaucuuaagagauuuuucguuuuuuuuuuuguucuuggauguucuuccagugaauucuuuuuuuuaauuuauuuuuuauuaaaauuuuuuuuuuuuguagacacaggucucacucuguugcccaugcuggucucaaacccuuggccucaagcaauccuccuaccucagccucccaaagugcuaggauuacagggaugagccacugcuccuggccaagauuuucuuauguaaaagcaaugguuaauucccaaaguaggccaggcacagugguucacaccuauaaucccagcacuuuuuugggaggcugaggcaggcagaucaugaggucaggaguucgagaccagccugaccaauguggggaaaccccaucucuacuaaaaauacaaaaauuagccgggugugguuggcacauuccuguaaucccagcuacucgggaagcuggggcaggagaaucacuugaacucaggagucggagguugcagugagcggagauugcaccacugcacuccagccugggugacagaacaagacuccgucucaaaaaaaaaaaaaaaaaaaauucccaaaguaaaaaccuaaugaucaugguugauaauauuauucuaauacauuuuaaaguugauaagcuaguauuugguuuaggaauuuuauaucuauguuuauaauuuauauugcuuuguaauucucuucucauggcuuuuuuuuuuauuuuuuaguuuuuggagacagucccgcucugucgcccaggcuggagugcaguggcaggaucucggcucacugcagccucugccuccuggguucaagugauucuccuaccucagcuuccugaguagcugggacuacucccgccaccacaccaggcugauuuuuguguuuuuaguagagacgggguuucaccauuuuggccaggcuagucucgaacuccuguuuucaagugauucaccugccucggccucccaaagugcuuggauuacaggugugagccacugcacccagccucuuauguuaucuuaauuuuguuuugguaucagggauuuguuuucuuggaaaauauauuggaaaaaaauguauugcuauguuuuuaaugcccuggaauacuuuaaauaacaugaauugagaaugcccuuauaauuuuuauuagaccuuguuaaugaaacuauuggggucuuuaucuuuuggggauaaagcauggauugcccauuuaauucuuucuaugguuauugguauagaaagguuuucuacaacuucuugaaucaaauuuaggaauuuguauucuccucagaaaucauucauuucaccuagauuuucaaauuuaauuggcaaagagcaaucaucucuuauuuuuaaaaaucucuuuaucacuugugauuauauccacuuccucauuccuaaugucguauguuuauuuucucuuugaucagacuuccuagagguuuuacaauuuuauuuguucuaagaaccaguacuguuuuuauuuuucaaauaauguuugauagcuuccuaaucucucaguuuuuacuuuaaccuccaaaucuaguuauuggugcucagcuucucagugguuagagguggggguaugugugugguuguuuuacguuuugauugcuaaguuuuggccuuaugguagucauccaggaagaaggacuuuuuggaaguuggaauuuucuuuguggccuaauaaaugauugguuuugucaaagcuucauagacauuuuaaagaaugugggaucucuguuuuaaauuaaaauauuaaauuuuauuuauuuuuaagaauuuaaguaaguuuauuuaauggugccgugcaauucuguagcuuuaguuuggggcuucuuauucuguuguuuucugaaagagacagauuuucccauuuuguugucuucuaauagagcuaaucuuguguuccuaacaauuuuugcuccauuuauuuauuuugcugcuauauuagauuauuuuaaaguuuuaugacuuuaaaaauuuauauauauauauauauauauauauauuuuugagauggagucucgcucugucgcccaggcuggagugcaguggugugaucucggcucacugcaaccuccgccucccagguucaagcauucuccugccucagccucccaaguagcugggauuacaggcgcaugccaccaugcccggcuaauuuuuuguauuuuuaguagagaugaccaggcuguuggccaggcuggucucaaaccccugaucucaggugauccaccugccucaaccucccaaagugcugggaugaugggugugagcuacugcucccagcccuaauuuuuuuuuccuccuuaugauuuggaaguucugcggcuauucuuacacugcuugcuggugguuaucuuuacauugucaaacuaggauguguuuuuuucaucuauuuccuguauuaaaaugaauauaaauuuauucccuaagaccuuuagcacacguuuuguugugauaaucauagccuaauuucagauucuuaauuuugcuauauuauaccagucauuuucaaggaaccaguacagauuuuucugucuuuauugcucaccauuauaucuuaaccauuaugucuuuauuucuugaacuguccauuuugacucacuguuuuuauuugacuggauauuuuccucuagguuuuuguaucaguaccuggguggcagcuugggaaagacagcccuccuguagucccaguuauuagggaggcugagcgaagaggaucaccugagccugggagaacaaggcugcagugagcuaugauugugcggcugcacuccagccugggcaacagagcaagaccccaucucuuaaaaaauaaaauaauaaaucuuaaaaagaaaacauggaaggucauguccugaaugcuuuugcccucaaaaugaaugagaguuuggcucuguauagaacucuaggaucauaauccuuuuaacugaaacuaauauugcucuauucuuuuccuuuauuuacuucuucccaguacaauaucccaaaguuugaaauauucaggcaauguuucucagugguaguaguguguaggauugucucugguauauuaacugauuaccuugagggagggaaauaggacagagaggaaauggaauaaauucauucucuaagucaagaccuuuggcacacuuucguucugauaaucauaaucuagguuccuguuaauucccuagcaguuuuuuaaaggaguuuaucuacuggccccacaaacccauguuuuuaaagauaauccugacuuucuggaucuguuguuguuugcuuaaagauuuuugguuuugauaggggaaaacaugaaaaacucaauuuguauguuagcuaauuaaugaucugauaaagaauccucauaaaaauaauagaauguacauugacugaugguaaagucaucuuggucccuucucaugcaucugacauacuuguuacuuuguuuuacaggaauagcggguuuugcagcaauuguugcauauggauuauauaaacugaagagcaggggaaauacuaaaauguccauucaucugauccacaugcguguggcagcccaaggcuuuguuguaggagcaaugacuguugguagguuccuauaggaaauuucaaauuuucguuucucauuaagguauuucuuuacaaacaaaauagguaaauauuuuuagcugaccuuuuagcaguuggagaauaucacuuauacucauuuucauguaaaaaaugaauuaaugaagauaauucaaguagugacauaguuuuucuaugauauauccuacuaagauuuuaaagaaaaaaaaaauccugucaaucacugaguuuauaauuucauugaagagccuagacauguaauugggguugauaguaacaucuguuaucugggagagacauacaauugcuauuuuauuguguuuuuaaaggagagauucuuaaaguuuagguauuacaugcuucuucuauuggcuuuauaauucauugacuuuaucugguauuauguagcaagagugauuccuuucaaaguuaccagauaaauauugauuguucuuucaaagaaauauuguaacaugugaaguagccauaccagcccuuugcuacuugggaaacuacuguauguaacaagaguuuuagagauuuaagauguuuaagaaggcaagaguauaagcuuccuagggucuuauuccccuuguaaauauuccaugcuagcaguggugcuacuuucagcuauuuuaugaacugguuuuuauuuuugaauauuuaagaaaauacugaaaugcuuaacuagcauucuuuuucuuuagguaugggcuauuccauguaucgggaauucugggcaaaaccuaagccuuagaagaagagaugcugucuuggucuuguuggaggagcuugcuuuaguuagaugucuuauuauuaaaguuaccuauuauuguuggaaauaaacuaauuuguauggguuuagaugguaacauggcauuuugaauauuggcuuccuuucuugcaggcuugauuugcuuggugaccgaauuacuagugacuaguuuacuaacuaggucauucaaggaagucaaguuaacuuaaacaugucaccuaaaugcacuugaugguguugaaauguccaccuucuuaaauuuuuaagaugaacuuaguucuaaagaagauaacaggccaauccugaagguacucccuguuugcugcagaaugucagauauuuuggauguugcauaagaguccuauuugccccaguuaauucaacuuuugucugccuguuuuguggacuggcuggcucuguuagaacucuguccaaaaagugcauggaauauaacuuguaaagcuucccacaauugacaauauauaugcauguguuuaaaccaaauccagaaagcuuaaacaauagagcugcauaauaguauuuauuaaagaaucacaacuguaaacaugagaauaauuuaaggauucuaguuuaguuuuuuguaauugcaaauuauauuuuugcugcugauauauuagaauaauuuuuaaaugucaucuugaaauagaaauauguauuuuaagcacucacgcaaagguaaaugaacacguuuuaaauguguguguugcuaauuuuuuccauaagaauuguaaacauugaacugaacaaauuaccuauaauggauuugguuaaugacuuaugagcaagcugguuuggccagacaguauacccaaacuuuuauauaauauacagaaggcuaucacacuugugaaauucucuugucuaaucugaauuugcauuccaugguguuaacaugguauauguauuguuauuaaaguaagugacccaugucaa

SEQ ID NO: 16180 - RNA, 4255 nt, Homo sapiens
uauacgaauugcucaguacaaggaauacaugucuggugggguaggauuagaauccagcucuucugauagagaguccuggguucuuuugauugacgauauauugccaaagcaucaaucuuacgcugcugauguaaauuagauuaaauuggcagauaagaauucugauuagaaaauuuaagaauccauuacucaacagaagcccacguuguucucuuugaaugauauauauaaaaaaaucaugccuaagguaaacggaaucuucuucagugacuuaacucaucuaacaauuucaauugugauuugaaaagacuuuuuucacuacaccacugccagacuuuccuucauuaucguuuucucauccacccacaguaguugucccagauuucugucagaaaguugaauagacgcuaaaaaaggcaccaguaaccagauauuuaaagucaguuuggagagcacaaauuaauucuguacgcuuaguaagacacgacugaagaccuuuccacagggaaccuaaagaggcauuaagggaagaugagccguccagcaucaggagacguaacagguugaaugaaggaucuuucuucacagucauuuugucacgggaauuacuaucuaaagcaacgcuggcuucaaacugauuuugcaucagucgcccaucagcuuguuuaaaauggcugccaaggccccagcauggagauccggauucagguggucuggggcagagcucaaggaaucuuuaagaagccccuucaagugacucuggugcacaaagagaacuccuaguauacaggacuccaaauaugugugucaugcuggagcuucaugaccagguugucaccgcuucaaccuguuagaacuuuccauccaaaccugucuuacuccaaagugccuuuguacuuccggaagcagggaucccugucguggggauuacuccgaagagggaaauagcugcuucccacuccgggaauuuaagacaaaggcgaauaucacugcugcaucaugucggcugcuccuaauucugcccuuacgcugugcuuuguaaucucuaacccgccgacucggcaggagaaaaauuuaauucggucacagaagcacuacacaggacccuaggccuuaucacuuucccaggguggaggaaacaccaggucggggagaaaagcaagaccaggacuggaagguccucugcuaguacgcccuccccucaaccucccgaccuuccucgccgccucucuuccugugaccuugucgugacuccgugaccggagcgcucgcucuccuaucccgccucgccugccgcuuagcccgcucuucagaauguuccaagcuccggggaagcucccgcuccucgcuccccgccgucgggcccagucaacacccuccuggcccccgucucucauuaccaccccaucagcgagucuuccccgcucggcaacucacuccacaagcuucugcuccaucuccucgcuggcuccgucuccccucacccgaaggacccuaggccucggcucccgacuccucucauccgcccaugcucgaggccgggccugagccccggcaacuccaccucuccucccucauucgagacacggacucccagcccccacccccaaaguccuuucggccuggccaagcgcugccccacuucuucccgccccgcggcccgagucccuggcucgcagucccccggcuuguuucgcuuaccuagagcgagaaaaccucucacaccccaaccggcuuccgaucccugcaggcgcacccaguccucccggcuucuccccacccacagccgucccagccaaucagaggccagcggccgcaaaaggacgcgugcgugugcgcggcggguggggcagugcagagcggguccuggauuggcugggccggugagugcuggcccacuaccccggcucuagcguacuggcggagacagacgugagagcucggcgccugggguucgcgcccgggcacuugaggggcuuuggcuccuggcccaaggacuccucagauuucuccugcccuuuuccccucgggcagcggaggcgagcaccgcgaacgccgugucccgagcgccgccgccugcggacgccucacgggccgggaagggaugcgggugagggguuucggcugcgggugagguuguguuccccgacccacccggguccgacugcuuguucucgccguucaguaacgagaugcagacagacugggaaagaacggaguuuauuucugcaacagguuacagggagaaggucggaguaacucaccagaccaacucaaaauuauuaauacaaguuuuucuagugcuuaaauacauucagugcauuuacaagucgaaagccaaaguguuucacucaagccaaucuuuaacgguaauagggucaggugucuagacaauugcuucagagccuuggaaauaaucuaaaguggguccugguacaaggugugcaagaacaacuccauuauuuuaauuaaacucuagggguugaaaaagcucaggcgggauccuaauggacuugucuuuacauucuagccuuucuccuaaggcaccaguuucuccaauguuuaacuuauacaugcaucagaaugacagugaggcguuggugagagcugcucugguugcuaauggagaucuggccugccacagugggagcagagcuugcccagugcgccgggacgacugcgggcuccauccauuccgcucccagggcgguugucggccaggaccgugagcugucaggucccccgcgggauccuuccuggagcuuacacuauaguaggaggcagccaguacuugcaagcacggggucgcgggaacuacgaccucacccaggccaggcgaccuuucucucaagaaggagaugucagaggccccucgugacagcgagcuuccggggacagggcuccuaauguguuugucaaguaaauaaugaguaauaauccggccaauuggugggucaacgaaaaaagucaaacucuaagauauuugaagagauuuauucugaaccaaaugugagugaccguggccccugacacagcccucaggagguccugagaacaugugcccaaggugguccaggcacacuugguuuuauacauuuuagagaggcaugagacaucaaucaaauacauuuaagaaauacauugguuugguccagaaacgggggacaacucaaaggcgagaggggagggggcuuccaggcuauagguaaauuuaaacauuuucugguugauaauugguugaguuugucugaagaccugggaucaacagaaagggaauguucaaguuaagauaaaagauuguggagaccaagguucuuuugaagucuuguaguggcugccuuuagagacaauagaugacaaauguuuccuauucagauguuugaaaggugcuagacuuuuaaucucuuuaggauuggggggccuggaagaaaaagaucuagcuauguuauagggauucuuuacagaugagaauuuuuccccgcaaaggacagcuuuguauggccauuucaagauauggcaaagaaauauguuuugggguaaaauauuuuuauuuucuuccuugucuuauaauguuaugccagagucaaguuggaaaguaagucacgauauauagaguuaaauaaaacccauuugaugauaacuuauuauuuguggggcaugacuccccagaccccuuagauaggaauuugggcaugauaaaaaaaaucagagcuuaguccucagaugcaaagcaucuacaacugcaccauggagaaaucugugauuaaguuagaguuucuugauauaaccacaaaacaaggcagacuaccaagugcucgucauacagauaggaacuaaaugucaugggcucaggauuuugaaaaucguucaucucauaauuaagauacauguaagaaacauuucaugcuauggaugauuaagaacuucauacuucgcugggcacgguggcucacgccuguaauccaagcacuuugggaggcugaggcaggcggaucaccaggucaggagaucgagaccauacuggcuaacacagugaaaccccgucucuacuaaaaauacaaaaaauuagccgggugugguggcgugcaccuguagucccagcuacuggagagacugaggcaggagaauggcgugaacccgggaaucggagcuuguagugagccaagaucgcaccacugcacuccagccugggugacagagagagauucugucaaaaaaaaaaaaaaaaaaaaaagagagaacuucauacuuugau

SEQ ID NO: 16181 - RNA, 4255 nt, Homo sapiens
aucaaaguaugaaguucucucuuuuuuuuuuuuuuuuuuuuuugacagaaucucucucugucacccaggcuggagugcaguggugcgaucuuggcucacuacaagcuccgauucccggguucacgccauucuccugccucagucucuccaguagcugggacuacaggugcacgccaccacacccggcuaauuuuuuguauuuuuaguagagacgggguuucacuguguuagccaguauggucucgaucuccugaccuggugauccgccugccucagccucccaaagugcuuggauuacaggcgugagccaccgugcccagcgaaguaugaaguucuuaaucauccauagcaugaaauguuucuuacauguaucuuaauuaugagaugaacgauuuucaaaauccugagcccaugacauuuaguuccuaucuguaugacgagcacuugguagucugccuuguuuugugguuauaucaagaaacucuaacuuaaucacagauuucuccauggugcaguuguagaugcuuugcaucugaggacuaagcucugauuuuuuuuaucaugcccaaauuccuaucuaaggggucuggggagucaugccccacaaauaauaaguuaucaucaaauggguuuuauuuaacucuauauaucgugacuuacuuuccaacuugacucuggcauaacauuauaagacaaggaagaaaauaaaaauauuuuaccccaaaacauauuucuuugccauaucuugaaauggccauacaaagcuguccuuugcggggaaaaauucucaucuguaaagaaucccuauaacauagcuagaucuuuuucuuccaggccccccaauccuaaagagauuaaaagucuagcaccuuucaaacaucugaauaggaaacauuugucaucuauugucucuaaaggcagccacuacaagacuucaaaagaaccuuggucuccacaaucuuuuaucuuaacuugaacauucccuuucuguugaucccaggucuucagacaaacucaaccaauuaucaaccagaaaauguuuaaauuuaccuauagccuggaagcccccuccccucucgccuuugaguugucccccguuucuggaccaaaccaauguauuucuuaaauguauuugauugaugucucaugccucucuaaaauguauaaaaccaagugugccuggaccaccuugggcacauguucucaggaccuccugagggcugugucaggggccacggucacucacauuugguucagaauaaaucucuucaaauaucuuagaguuugacuuuuuucguugacccaccaauuggccggauuauuacucauuauuuacuugacaaacacauuaggagcccuguccccggaagcucgcugucacgaggggccucugacaucuccuucuugagagaaaggucgccuggccugggugaggucguaguucccgcgaccccgugcuugcaaguacuggcugccuccuacuauaguguaagcuccaggaaggaucccgcgggggaccugacagcucacgguccuggccgacaaccgcccugggagcggaauggauggagcccgcagucgucccggcgcacugggcaagcucugcucccacuguggcaggccagaucuccauuagcaaccagagcagcucucaccaacgccucacugucauucugaugcauguauaaguuaaacauuggagaaacuggugccuuaggagaaaggcuagaauguaaagacaaguccauuaggaucccgccugagcuuuuucaaccccuagaguuuaauuaaaauaauggaguuguucuugcacaccuuguaccaggacccacuuuagauuauuuccaaggcucugaagcaauugucuagacaccugacccuauuaccguuaaagauuggcuugagugaaacacuuuggcuuucgacuuguaaaugcacugaauguauuuaagcacuagaaaaacuuguauuaauaauuuugaguuggucuggugaguuacuccgaccuucucccuguaaccuguugcagaaauaaacuccguucuuucccagucugucugcaucucguuacugaacggcgagaacaagcagucggacccgggugggucggggaacacaaccucacccgcagccgaaaccccucacccgcaucccuucccggcccgugaggcguccgcaggcggcggcgcucgggacacggcguucgcggugcucgccuccgcugcccgaggggaaaagggcaggagaaaucugaggaguccuugggccaggagccaaagccccucaagugcccgggcgcgaaccccaggcgccgagcucucacgucugucuccgccaguacgcuagagccgggguagugggccagcacucaccggcccagccaauccaggacccgcucugcacugccccacccgccgcgcacacgcacgcguccuuuugcggccgcuggccucugauuggcugggacggcuguggguggggagaagccgggaggacugggugcgccugcagggaucggaagccgguuggggugugagagguuuucucgcucuagguaagcgaaacaagccgggggacugcgagccagggacucgggccgcggggcgggaagaaguggggcagcgcuuggccaggccgaaaggacuuugggggugggggcugggaguccgugucucgaaugagggaggagagguggaguugccggggcucaggcccggccucgagcaugggcggaugagaggagucgggagccgaggccuaggguccuucgggugaggggagacggagccagcgaggagauggagcagaagcuuguggagugaguugccgagcggggaagacucgcugauggggugguaaugagagacgggggccaggaggguguugacugggcccgacggcggggagcgaggagcgggagcuuccccggagcuuggaacauucugaagagcgggcuaagcggcaggcgaggcgggauaggagagcgagcgcuccggucacggagucacgacaaggucacaggaagagaggcggcgaggaaggucgggagguugaggggagggcguacuagcagaggaccuuccaguccuggucuugcuuuucuccccgaccugguguuuccuccacccugggaaagugauaaggccuaggguccuguguagugcuucugugaccgaauuaaauuuuucuccugccgagucggcggguuagagauuacaaagcacagcguaagggcagaauuaggagcagccgacaugaugcagcagugauauucgccuuugucuuaaauucccggagugggaagcagcuauuucccucuucggaguaauccccacgacagggaucccugcuuccggaaguacaaaggcacuuuggaguaagacagguuuggauggaaaguucuaacagguugaagcggugacaaccuggucaugaagcuccagcaugacacacauauuuggaguccuguauacuaggaguucucuuugugcaccagagucacuugaaggggcuucuuaaagauuccuugagcucugccccagaccaccugaauccggaucuccaugcuggggccuuggcagccauuuuaaacaagcugaugggcgacugaugcaaaaucaguuugaagccagcguugcuuuagauaguaauucccgugacaaaaugacugugaagaaagauccuucauucaaccuguuacgucuccugaugcuggacggcucaucuucccuuaaugccucuuuagguucccuguggaaaggucuucagucgugucuuacuaagcguacagaauuaauuugugcucuccaaacugacuuuaaauaucugguuacuggugccuuuuuuagcgucuauucaacuuucugacagaaaucugggacaacuacuguggguggaugagaaaacgauaaugaaggaaagucuggcagugguguagugaaaaaagucuuuucaaaucacaauugaaauuguuagaugaguuaagucacugaagaagauuccguuuaccuuaggcaugauuuuuuuauauauaucauucaaagagaacaacgugggcuucuguugaguaauggauucuuaaauuuucuaaucagaauucuuaucugccaauuuaaucuaauuuacaucagcagcguaagauugaugcuuuggcaauauaucgucaaucaaaagaacccaggacucucuaucagaagagcuggauucuaauccuaccccaccagacauguauuccuuguacugagcaauucguaua

SEQ ID NO: 16182 - RNA, 64620 nt, Homo sapiens
cgcagcccgcgcaggcgcagcuacccggcacccccuccccgcggccggcagcccgcucgguauuaugauuagcgcugggugcgggguuucggcggccgggagggaguugucggcgccgcggccgcugcggacggacgcucgccugccggcugagguaggggcgagcgcggagcgcggcggggcgcggcggccguaggcaggggugcggggccggccuccgccgccucaguagccuccgcuguugccgggcugggcgcccgggccggggcgcucgccgcaggcggaaaguaaguugcgcucucggcgccggccgcagcgcgcggcccgggaggacgcggggcccgggcugcgguggcccggaccccgcggcgcggccuggcggcggggcggcggcggggcccggcgggagccgucacugcggcggcggccgcggucgccuggaggcccugcccuugcggccgcggcgggauugcggcaccucggaaggcgcccgcauccccgcgccccgccccggagcgggccgagugcggcgcccgcggggccccgcgcccugggcgcuugguaggguguguguucuuugaaugcguuuuccccuuucagaagacuguagaaauccggccucagcaaaaggguuccguggucaaacugcuuuacaauagaguggggauguugucuguagagaaagggcaaagggguaaggaaagaggagcagugccauucccgagggagagcuagaauuuuugcagacugggagacugggaaaucuacguucuuuuccauagucaucgccuguugauuucuuucugguccauuuuacagggaccuuccugccuuuuacuuggacuuggguugcaggaaaguggcagccuuuuaucuucgggguucuuggagcugugcuauuuguaacuguuggaucgcauacaguccaguaguuucauagggaguuucaggcuuuggggagaauuuagcaguggaguuccuaaaucuauagaggucugaggauaugggaccuuucaaacugucauguuacuuuccaccccccuucccuuuaauuaugugcauucuuaaagucuuaggaaccgugguaaaguugacuuaaugccuuaaacauuuugucagguuuuaaggugaagcauggcuugcaaguguuggacauccuguugaaucuccaccaaguuccuaucaaacaugaaaugccugaguuugggcuccuuguaugggauuggagcacuaugucccaaaccagucuuuaacuuaucagaauauauacagcaguguacuuuaaagcccggguugucaaggcuuauguaaucaguuuguuaauuuauaaucucguuacauugcuuuccagauuuauaaaauaauucccuuaaggaaaucuguccucaacgucugcuuaaauauuucucuuggaauuggauucuugaagaggaauguacuguacaagugaugauuaaagcauacuaauuagacaaguuucuuuuuuuaaagaacaccaaauaccaaauuuuuaaucugauuaucuguguaauuguccuugagaggagaacagguggacauucccauuuuacagaacuagaaaugagagaaauuacaugacauuuccaaggucacauauugaagcaguguagaaagucaggugcacagugcuaacuuuuuauaauacucucauccugaaggcuuuucaggcaggaaacuuucagugccaccuuucaauuuuuuuuuaaauuuguauaaucaguuuuuaauuguucauuuugugcacaaaaauuacucucaccguauuuuuuaauaauucugaguauuuuuuucuguuuuacugcaguaagauccauuagucuaaaacaugcuagaacucagaaguuguacuaauuuuauuuuucuagaccagaaguauagguugggucuuuaugguuuagauuuaaucacauaauccuaaaagaaaggcuuuuaaauguccuuauuaaaauugaagggcuuucgugauauuuuuacuggucacaggaaauacuguucaucugaacuucacugugaguacuucccucauacagaaagugaaaccaaauagaaaaauauuuauuucuggagauacugagcagccaugguucuaaguacugguauaaauaagacaugauuucuucccuguagcagcuugucuaauccuaagagcucuuuacacugcccaagaagaaaaggguacaaaugaacuuuccauaggccagaaucuuaggaauuaaaaaccguagaugagaaacucuagacuuaauguaacugcaucccagcuguuugcuuaaagauagaguguuuauaacuaagaugcuuuaguaagaaaacuguuauucagaauuuagguauuucccaguguguaucuaugugcagguaaacuuagaacaacuuagguggaaaaauugaguggauccuagcaguucugaagauaaacuuaaccuuugaucauuuauucauggaauguuugugugucucuuuugguggcccuaggguagagggagggcagcaguagaaaagugaauaaaaaccaguuccugacuguagguucuuagaagcuacuggggaacaccaagguaaacaguaacaguacgaacagaugaacuguggugaggcauagggaaaaaccugcagaagcacaaggauggcggcagugaacaaccugacauggaaaugcuucacagaggaggugaugguuaaacuggucuugaagaauaggaagaauucccaggcagagaaaaagggaaaaggcucaggggguucagggagggugagaagacaaggucaaguggugggugggagaagaacauagauccaagugggugaaagggaguugagaaggcugagacaaugcaacuguucuuuccuuaaagcauuugaaaaggaaggagggaaauggggcaguugcuuugggggauggaggagaaggauuuuggugagguguuuguuuuguuuuguuuuaacuuugggaagagcugguauaaaauuccucagauuuaauggccucacgagugagcacuggaacuguguugucugcucuggauaauccagagcuacgucauugauccucaucugcuuuucugcacaucugcuuuggguuguggcucugugucucaugggaaaccauuucuugcuggugguagggaaggaaccugucuaaagaggauuccugcuuugcccucccugaacauuuauuucucugcugucacuuccagagccuccugagagucugcuuuggcauccccagcauuuggccucugcucagguaggcuguuccauggcaaaucaggccucuuucccuuuccuuuugcuauuaugcccccuagucugcugccauguggcuacucaaaaguuacuucagacucagagaucauuaguuguucaucuaacauguuuuaaguuuuggaguaucuucaggcccaaagcaagauuaggucuaucugcacaucuaaacacauacccucuugacuaauauuugccuggaccguuuaauguagguuaugacaaaaaugcuccaggaaccuggauuacacaacauaacgguggucaaaucgcagccucacugggccucaauuucuuaauuguugaccugcaguuaucucucuuaaacccauaauacugucagcucuuugaaggcagagacuacuucuuugaucuguacauuaucagacccaaguaaugccggguacauagucuguaccaagaagugucuuggugaagaagguaaaaaaaucuaaucuuuaauuuguugauuuuaucagcuuguuauggaaaccacacccuuucuaauaaagcuggguuggauuugaauuguuuuucaaucauacaauuuuagaacuagaagcaaauccucuacuuucugcuagcauguuguagauguuccuguccugaaaguccagucugagagaauggcaucaccagcuaccacucuccgcuagagucauucuggauuucucccuuugcuuagccuccugugcauugaguucuuggauucuacuuccaaaaugugucuccuccacaacauccuuaucaucacugcccauauaccagcugcccucauuuuuaagucuuuaaguaauuuaccuggagacauuuucaguugucugcuuaccugucuucuagcucuauucucgcccuuucagucugaucuucacuuugcugccagaguaauuuguuaaaccaucaucucugauugccauucuccugcucaggauuuuucuugagcucuuguuuuuggcucuuuaugcuagccuucauuuguucauuuaauaaaauauaucuguauauuuugaguagaugcuauacuuggcagacccugggauaaagaacuaaauaaaaugaacaugauccuuaugugaacugagccugucauuuaguuuagugggggacacagauuauuaaccacacagucacacaaauaauuauaugaccucacauuugugauaagggucauaauggcaaaggacacagugcugugagugaguauagggagcuguaugugcauggaguuggggagggcaaggggauggucaggaagucguccuuuaagcugggcccuagagcauggguaagggcuagccuagaccuaagaaguagaaauugaugaauuauauggaauacaugccugaccuuguccccugcgcucugcauauauuguugucugagucauacuaaacuuccuugggccucuuuccugaaaagccucuuccuuaccguugccaguuucaguucuuagcucaaacacacaaaauuuauuucuccagaaugcugucuguggcauucuccaaggcagauuuaggagaaaagaacaccucuuuuugcguaucuguucccguaagagacugugaauaaguugagacagagaccuuccuaguauccaguacagguguuuaggggccaguuuguugggccaauagaggaugagguuacugauaagaaaaugagauggagaacuauauauacaaccccuuucaaauacuguaaucucaugggagggaggccaguucuaaaguuagggggauaaaauccuuaggugauuuguauucuacucacacccugcuaauauauauuaucccauuuaacuuucacaauaacuguccaagguggugauuaucuuuauuuuaucaagacaugccuuuucauagaaguugaguaacuuguugggcuguagauccugugguacucuuuccacugugcugucaugccacucugcauaugugcuuaauaaaugaauucugaucauuccugaaguguaccucuauggugaagauaauaagaaaaguuaacuaugugguacuuugaaauguggaaucuuaggacuguuauccuagcuccuccucugauguucccucgcccccaggcaacucuuaacuggguguaggaccuggacaaagugaguuuguaaccucauuggcuuggcccugcuuuuucauuuguaaaauggguaucacucuuaaggaauuaaaugauauaauguaaaaagugcaguacauacauagauuccuagaaauuaaaaucuguuuucucauuuugagaccugcauucaaacaaaacuggaauucuaauggccaacugaggcagcaaaagacauuuuaaaaauuagaaauaagacaaaaauccaugguuuugcuuuacucguuucuguauaaaccugcuuagguuacuaauagauuuuuaguaguauguauaugggugauaacgagagagaucuauuaagccacaacaaaaauguaguguuuuauggaacuuuguagugaacaaugaacuuuuaaaauuuguuugaauucucuaauaagcuuauuucuguguugcuuucauguuaauauguaaaggauuuuccucuuucauugaggcucuuugaugagaagcuuuuccugugcauuuuuuauucuuuaaugacgcuuugacuaaacuuaaguauaauucaaacacagauauguggugaauuaguuaguauggcaaauuuuccauuuguuuuguccagcacgguugcuuaaaugaugagccaguagguauucuucagaaucagcuguagguauucuucagaaucagcugccucucuuaaaauuuaucugacuuccacucccaaaucaucacuucaccuaaacugguguucuuuccuaagccagccagcuguaggcacucuuacuuuguuucuuguuuaccccacuuucaggaaugguguuccucuacuccuguugaaggauaagcccuggucugugggcugcaccaguccuuggugagccugccaucuauaguguccucuauucuuccucugacaugccucaccuaggcucacuuguguaauuauuucucuuuuuauauggggauacuauuuucuuuucuuuuuuuuaaguacugggauacauguacagaaugugcagguuuguuacauagauauacaugugccauggugguuugcugaacuguagguccuguuuuccuaaaucauuuuuaagauuugaauggacagggacuguguuguguccuguacaguuaaggcucaaauuauuuguuaaugaaaaugacuuaguguuucuguuauucagacugaagcaguugcauaccuuucuuuucuuuuucuuuuucuucuuuuuuugagacaggcucuugcuuugucucccaggauggagugcaguggcugaucucggcucacuacagcauggauucuugagcuccggugaucagccugccucagcuucccaaagugcugggguuacauacaggugugagccaccacguugggcugcauacccucuuucucagaggaaguaaauauuucauugaauaugccuuguuuauuaacauuacauaaauaggcauuagauaguauaguacgcaguguauuuucagaaaaauugguguauuucauagaucucuuaauggaaaaguaaauggaaugaauaauuauguacagaaagucaaaaauugaguagucucugccuuuccuggaguaugaaagcagcacauaugcacugucaaaaauuuuaaaagaacagaaaagcauaaagagaaaaaauauccuguaaucuuacuaauuuaacauuuuaaguuuuuaaaauauauacauucauacagauuauaugcuuuuuaugaaagauugggacaggccagguauaguggcucaccccuuguaaucccagcaccucgggaggccaaggcaggugaaucacuugaggucaggaggucaagaccagccuagccaauauggcaaaaccccaucucuacuaaaaaaaaaaauuaaaauuagcugggugugguggcauguuccuguaaucccaguuacuugggaggcugaggcaggagaauuguuugaaccugggagguugagguugcauugagccaagauugugccacugcaauccagccugugugacagagugaggcucugucucaagaaaaaaaaaaagauuggaauuacaugcugugaaguuugguauauacaauuuuuuuuaaacuuaacauuauguugugagacuuuccccaugaaauguaguagccucaaaauaugguagcauacuguuaacguuggguauauuguguuuuauuuaaccaucuccuuauuguagaccuuuagaugauuugauuuucuuuugcauguauaaauaucacugaacauuguugaauauaaauauuuguccucaccuuucuuugagacaugaaucuaguaguaaguuuauagucaaggauauuaauuauuuuaaggcuuuugagacagauugaguaucucuugucuaaaaugccuagcaucagaaguguuuugaauuuugucagauuuuguaacauuugcaauauacauaaugaugggacccaagucuaaacaugaaauuaauuucuguuucauuuauaccuauacauauaugcuaaagguaauuuuauaccccauuuuuaauaauuuuaugcaugaaacaaaguuauuacugcauuuccucucaaaaacuaauagaaacugugauuggucacaugaggguuuuuuuuaacuuguggugucuuguuggcacugaaaguuucagauuuuggagcauuuuggauuucguauuuucaccuuagggaugcucaaccuguacacauauugccaaauuguuuuucagaaagguagcuugcuugcagucccaccaguguaagagaauuccuggaaugagccugucuuugagucaaagucagugaaauguuaggugccaguauuuugguuuauugauuaguuuuuuuuuuuuucuguuccacaauucuuuuuuugaccauuuuuuaaugaucacuuuuaucaaaauauuaggaggaauaaaaagaugguagggaguuaaagugaguuuugacaguguuaauaaaagcuuuagaucagagauuuagauuauuaaaauucuccauaacuuaauauucuguuuuccugggcacaauaaguaauuguggguuggcuuuauuuauuuuggaguaauuucuauacacccagcuuuuguuuaagucauuacuuauuaugugaacacuuaaugcuggaguugucaccauacuaauuuuuaaguccuacuuacacguaggcagaaaugaugacaugcuuagcauuuuucaucacuuugaccaagaggcagaaucuguuuaggaauuucaucuguguugcugguccaggucuuguggcuuggauguuaaucucuuccucucuacaaauacuaaguacuguacaucaguuaaugauuugccuaacuccugaguacauucagauuacuugauauauguuggacugcagcuuguuuuacuuagagcaaauaaagauuacuuaaaccaguacuucaaggauucugcauuggcaaccaaaucauugccucaagaaacuggaacaggcuucucaccaugacauuccuaguccccucagcggccccuagcccaucaaauugaugaaaacgaagaacauacuuuaguaagcagcuaccuugucuuggaaaaugcuuucuuagagacucaggaguacaaauugcuggaaagaacauuucuaauaauaaaugacuuuaaucuguuaauuuguagaucccaucuugauuccauccagugauugcagacugguaacugcauaaccacauaguaauacaaccaauccagugaaaaacucugaauucuuuuacaacuuagggccuauugaccuguuuaugguucuuaucuuugguuuauagcuuauauuaauaacuccuaggaggaggcaugcuguccuuaaaaagugaaauauuguuuacuuuuuuuuuguuuugagacugagucucacucuuuugcucaggcuggagugcaguggcgugaucucugcucacugcaaccuccaccuccuguggucaagcgauucuccugccucagccuuccgaguagcugggacuacaggcccaugccaccacgcccagcuaauuuuuguauuuuuaauagagaugggguuucaacauguuggccaggcuggucucaaacuccugaccucaaguaaucuauccgcuuuggccucccaaaaugcuggauuacaggugugagccaccacgccuggccaaaauauuauuuacuuugaauaaagaaaacagcaguggugacugcaugauaggguuguguuuauuuugcuugacuuaaagguuauuccuggaagacuuaguuuacugucuuccuuucagccuauaccauuuuuaaaauuuuagcaguaaaaucagguugguaauaucauugagagaguguuaauuccuuuacuuaaguugguuuuucuauagauguacaauuuggucuacuguuucucaggaaggauuacaguuuucauuucuugguauguguaaaauauaccagauaauuuauauguaugagaagcuuaaaugcaguuuuaguguagcuuugcaaaaacucaacuuuuaguuguuuguauuagauggauauacuggcauauauauauauauauauguauauauauauauuuaagcauuuaauauguuugagaggaauauuggucgucugauuuuggaggaaaacuuauauucuaaaugaaauguuuauuauagauaagcuauagaaguaguacaauuuuugugcacagcccuuuuuguucaacuccucuacuuucucaugccauggauugguucacagugguauccaggcagagcugccuuuguugagcauacuguuuugucccuaccucucucuaagaggugugaggaagaggcauuuguuugauguacagaugagacugcaauggugaugauguugaugaaaaccuaaaagugaguuuuaacaagaauaacagggugaauuccaaauugauaguagguuuaacagaagcugguucuacaacuguuuucagcagcuugcaaaacguguguagggccacccacacuuccuuccucuucuccagccacacccacaugcuucaguugcuucugcugucuucaguaggagaacaucaguauauucuugcagcacauaacaguacuuguuucucagacauaaguuuuuauauuaugagcacucuuggcaaguuggccuauuucauuuagguccagccuaguuauaugccugugcuaaauaaaaagguugcucuagaauggccuaucuagugguugcuguguaaagacauguuaucuuagcuguauagucauuuaaaauauugaucuagaagaacuuagugcaugggaaaauguucaguuuauaaaauagaggaaaaaguaguuaucaaacuucaugucgaaaaucuuagcuuuguaaagaacuguuaaguauagaggauguacacucggaccugaugagaagucaucauagaugagcguauaggugauuuuuacuuucuucuuugugcuuuuaugcauuuucuaaacuuucuaaagugaaagucuuguauuaacuuuuccagcuuguuuuuuggagagaaguauugugaaaauaguuacaaaucucuuuuuacccugacauccccccaagcccguaaguauuauccccauuuuauuuuuuaaaauugugucuggccauauauuaugaauagaaaauaauuugaaagaaucuauaccaaaauguaaagcgauguuaucauaaagggugggauaauggauuuuuuuuucaaaauuccucccccccuuuuuuacuagucuguauguucuaauuguaguuuucuccugaauuaaacagauuuuucuuucauaauuguuuuugagauuuucuguaagaauauauuugaugugaaaaaauguaaaggaguauuaaguccuuuuugaaaagcuaaauuugauagaaaauuauauuaauaucauuuuaaaagcaaauacuuacauuuugugagauauuuuauugaaaaacccccagucuuugaugccuaacuagagacauuauuuccuauaccuuacagcacucauuuucaauuuauuuuaggaaacugaacagcaguucaguuucugaacuggucuaucuuaugaaagcaaaagagagauaauaguuuggugaauucauucgcuugaaguagggucagcaacugaaagaauuucugcuuggauggugggaacgucgucuguaacaaugauggugguggugguagcugguauuuacagaaugcuuacucugugccaggcacuauucuaaacacuuuaccuauauuaagucguuugauccucaccauaucuuaugagauuguuuucuuauuacuaacauuuucuaaugaagaaacugaccauacagagaggugaagguaacuugcugaguuccuuuggcuagugauuggugagcugggauucaaaugcaguuguuggucuuuagaaccaguacuuauuacuguacuaccgcacugcuuugccacagagacuagggaugaaacaggggcugcuggaaaaagagaagcaggcaaggauaguggaaggagcuacuauaucccucuuggagcugaagaaccagucagguaggcaucccaggguucaucugucacuagauauggaccugugcccauggcuuugccagcccugugugugcugcagaacuguugcuccacauucccucauuccuggcaggacacuugcuuucauauccagaggucaaccaccuuuccucguccuuucaccuguccuaucuuguuuccuccauucccuugcacuccuuuucucccaagugcauuugaacuuuaccuggacaccucucaccauuaguguauaguguaaauuaucauguuggcauaaugugaauguuuaggccucucuguuauucauguaauaguuuauuuucaugggaagaccugcaaggcuaccuuggucaguauucccucauugugccaugaaguuuggauauaagugauuugcucacauuccuuuuguuuguggugauaguuucuuuguuacuaucaagugacaguccucggaugaugaaggugcuuugugugaucccuaaugcuggcaucauaagugauuuccacuugccuucuagaggacaguguguuguaaagcuugccguccuuggcugcuauagcgugaggguuucaugagccuuuaggggcuccuagagacugggugguuuuggugccaggcugagcaugauuggagcuagagacugcugcuucacaggcaaguuaagccucauuguaccuacuaugcaguuucauggggaggauucagugaaaugugaguucggggccuguugcaagaggcauuuuaaaaauggcaauuguacuguuguucauuauuauuauuauuuuugagauggagucucgcuuugucacccagguuggagugcaauggcgccaucucggcucauugcaaccuccgccuccuggguucaagcaagucuccugccucagucuccugaguagcugggauuacaggcgcccgccuccacgccuggcuaauuuuuguauuuuuaguagagacgggguuucaccauauuggucaggcaagucuugagcuccugaccucaugauccaccugucucggccucccaaagugcugggauuacaggcgugagccaccgcacccggccuuguucauuauuauuucuucauuccaguggaauaauuuuucugaccugucuaccuggaacaaucucuguucacucugaaaucccuguuuauuaaauuucgcuuaaaggaguuguaauucacagaaggcagaaggauaauaggagacuggguuacuaaagacaaauuuuacuauuuuuauacaugugucuagauccagccuuagaguauauacuuugacuuuaagcaaaauucaaacaaauagaacuaaaccuguaucuuuuucuuuauuuucuuuuaggaaaaagaagcaacuaacaaaacacugugauaauaaggauuauucaguaugcaguuugcaggguaugucuuggagacaguacaaauucaccuuuacuuuauauaagccacaucuuaacauugggcauugauguucagaaugacuuuugggagcugcaagauccucagagaucaaaaaaaaugauuuaguuacuuuguacucuaacucaaaauguacuuaauaguaggauuagacaguagacuaguguuuaaaaagauguucaggaacaaggauauuuuucgucuaaacuuucaguuaaucauuguguccuguucuuagcuauacaauuuaauugugguuucauagacuauggaaaaggggugcucauauaaaaaguaaauuauuugguaguaagagugauuguuucacuauaggguacucauugugaagauaccaauuagauuauuucuauuuaaucuauagcuugcuauagauuaaaaaucauuucacugugcccucuugcuggcaaagguuugggaagagaaacauuaggguuuaauaguacuuaucucuaggugucugaggcucugaaaaaaaagcuuuuucauuuauuuuuguaauaaaacuuuuauuuucaaaaaucagauucauuuauaaaaucugauuuauaugucacuuuccaggaacacaucuaaacuaaaaugauagaugaaaagaacaaaguuauauaacuugggggcagccugaaggaauguguuuugaaagcuaaaguggcauuugcaagcuuaugcaauagcaacagacuuggguggaauuuuaagcauaauuauugcccuuguaauuaauugaaguuaaauauuuaaagauaguuuccugccccccccccagaguuuuuauauuugaaaauuaaauauacccaaauuaaaauuucuuuuggggaacugcuguccaaauaaagcaaggucuuucaauuuggauuuuccuguuaauccugucauuaaaguuauuaguucagaugacagggauaauauacauauggaagaaauuugcuuccccccacacacaccuaggcauuguaucaguuucuuauuuaaaaaucuuaauaguuuaaaaaucuuaauagcaggauuaauaguuuugguucugaaaucaguuugcagacacagcguagcauaguguuuuaaagcacggacuuuggugucagacagccguggguuucagucccagcucuuuuacacacuggccauuuggccuaggccaaguuacugugccucaaaaggggguuaauaauuccugucuuugaggggaauugugaggauugaaugaggauaaugugaaguauuugguaugugacugguguguaauacucauucaguaaaugguagugcuauuuauuauuacaauaauuacuaaagugcaaaaaauauauuaguaaacauauuaacauugacuuuuugaacuuauaauuuaacauacauaaauuuuuugaggggguucuagguaugcaauucagaucauuucugaagugguauaaauauaaaagugacuuuaugcuucuuuuauaguugguauuuuaacucuaaaaauaauauuauccuaaauggggcauugauuagaguggccaaauguuuauaaacaaugugggcuuugaaauguauuaauuaggugugaauccuagguuuuguaguuaaugucacuuguaccuagagcagccuauugccuuagcuauaaaaaugagaccagugcugacuggccaggcacgguggcuccagccuguaauccuuguacuuugggaggccaaggcaggaggauugcaugaggccaagaguucaagaccagccugagcaacauagcaagacccugucucuaauaaaaauaaauagcaguuuuuaaaaauuaaaaaaaaacuuaccuauuauaugucaaauuucguuuuuugggauauuuuuaucuaaguggacucaauaauuaaugcucuuaauauguaacugaaaaugugaaacuguauauugagagcaguagaaaaagcuucgucaaagggauagauacugacuaaugggagagagcuagccuuaggagguugcuauauuccuuguuggauuuuguuacucaguucuauuaaauguuggucagaacaaaagugaggguucagccugugagauauaaaguugcaucuuguuuaauuuuauacacguuuguuuuucugagucauugucauuuauaaauaggaaccuauuucuauucauuuauuguaaaaguugaaauuuuuaaguacaguacgaaaugugguucuuaaaaaccaaaugauuuuuaagacuuaaaucaucuguaagaaugcaugccuguuuacucuuggaauauaaucacguuaugcuggguugugauugacaguuggaaaacaaucauuaaaaaucagcauaacugcugaguaccaguaaauuaacaaauauuuacuaaguaccuacuaccauauaccuagaacccccucaaaacauuuauauaaauucaauuauaaguuuaaaaagucaauguuaauauguuuacugauauguuaagcaccuacuaugugccaggagcuuauccuaaacaguagugaugcaagagcaaacaauuaccuccuaaacauuuuggaaaaaguugcauuucaaaauuuaauaagacaguuuugauuauaugcuauuuguaaccacuguucuagguguugggggaaaguagaagaaaaaaaaauagaaccuuagaauagaaaaucccugagaaccugcuacugucagguuagaggagaugguguacccaaauaccuguagaauaagaccacauagaauagaggugucccaaggugcucuggggauauugaggagagaagguaauuccagcugggagaguuagagaaaccuucacagaauggauuuuuuuuuuuuuuuuugcacuuaaaggaagugguguuggucuuggggaaacugaaaaguuguuggguuucugugcaaauguuuauucuuuguguuuucccuugucaacuguugcguuauuuuuuaagacacuaaaauuccuuuuagaaaauguuuguuuuuuaaacaugcuuaucaaacuugccaguuuucuuauuacucacaucaccaaaaaauugcuuccaaugaacuaauuuuuuuuucaguuugcaaaaacuugauaugguauuuaaauucagccuuuguaauauaaagucuaaauguaaaaauagguuuuauuaaugacccugacucauuuuuuaucucaauuuauuuucuucaaguuucucuuaaaaugaaaaaaacaaaaaaugaagugauuuuaaaguuugugaagaaaagucgcagaaacuuaauuuuguuucucuucuuauuuuguagauauccaugacgacauugaaaaugaauuuuuuguauucaccagauauucuuauaugagaagaucuauuuuaaacagucuaaauauuuuuucuucuguuggaccagcauggcaggauuuaagcgaggguaugauggaaagauugcuggauuauaugaucuggauaaaaccuugggucgaggccauuuugccgugguuaaacuugccaggcaugucuuuacgggugaaaagguggcaguaaaaguuauugacaagacaaaacuggacacucuagcuacuggucaucuuuuccaggaagugagaugcaugaaacuagugcagcauccuaacaucguccgccuuuaugaaguuauugacacccagaccaaacuauaucuuauucuagaacuuggggauggaggagauauguuugauuauauaaugaaacaugaggagggucuuaaugaagacuuggccaagaaguauuuugcucagauaguucaugcuauaucuuauugccauaaacuccaugugguucacagagacuuaaaaccagagaauguagucuucuuugaaaaacaaggucuuguaaaguugacagacuuuggguucagcaacaaauuucaaccagggaagaagcucacuacaagcuguggaucucuugcauauuccgcuccagaaauucugcuuggugaugaguaugaugcaccugcaguagguagguaaccucgguccaguauuuggccauuugaauucugccagcuagaguuggucagaucgguuguuuaucuaaaaaugauuucuagagaauuucuguuaaauuggccuuaacuagcaaauuggguuucauaaaugccauauaugccuaaagcuggcauuucguuuauuucaaccuuuagauggcaaaugucuaaaguauauuugugaguacaaaggaaaaugaguaaguuaucauuuaaaguaaucucuuuucuguucauugucauuuuuuucuuaaggucugaaugcuuuuccucagauuuuucuuuuaguggcucucuuuagccaucuccucucugugcauaucgucuaacaaucauuggagacccauauuggaaagguacugugaauauuacagugcaauauaaagaauuuggguauuagaaucauuuauuaacugugaacuugaacaagugcuugaccucucugcuucauuuuuuauccauaauauaauauugaaucagguacagguguagcacucccauauuaucuuguuuacuuuucacagcgacccgugggguuguuauugucuaucucauuguucagaauaggaaacugacauacagaggcuuucuguaugguggauucuggaauugugguaccuuuggcauuccuaacuaccuucuuucccucuccacacacuuugugcucuuucacuugucaagauuuaucuauuuguggugaaaguauuuacugccuuucaguuugugucaacuuugucuccuugggauuguauuuguuuugaagaucauguaggaauuuguucuuaauuuuuuuaaaggauuuguugauccgaaggugcagucagcuuuuuaauuuguuaaucuuggaaaaaaauacaugcacaugaugucagauucauauguaugaguauucugcuugcauuugugguaauuugaaaugcagguuaaaggauuaaugacaaaggugcacuuaacauugaagaguguugauguuauauugaauacucuguacaccaagacacugauuuucauguuaugacuaucauguucuggaaaagaaaggguuaaugagcaguuucugccuacuacagauaacuagacuucacugaagucuuucauuagaauaucugagcggagauuuuugauuaauggagccauucuaaucagacagugaagccaggaauuuccaggagaggaaacacaaaugucuacccaagaaaaaaucuucacccucauuagugcagauuuaauaagaguaucuuauuaaaaauaaaguacucuuuaaaucuauuaaaaauaagauacucuuucauacuuuucacauugggaaaaacugaagucagacaaaacuaaguguugguaagaccauagaauaucaggaacucuuauuuagaagacaguuuggcaauaucugguaaagguaaagauguacacaucugauaaccuagcaguucucuccuauauaugcaccucagaguagcucucacuuaugcauacaagagauuuucaaagaacguuuuuaacagcauuguugaauguacagcaggggaauaauucguucaguauucauauucuguauacggugaaaauuaaacaauuugccaacaugauuggaucucacaagcauacuuuuuaagagaaacaaagcaaauugaugaagaguacauauaacauuuauauacaauuuuuuuuuuuuuuuuuuuugagacagagucucguucugucacccaggcuggagugcaguggugcccugucggcucucugcaagcucugccuccuggguucacaccauucuccugccucagccucccgaguagcugggacuaccggcccccugccaccacgccuagcuaauuuuuuuuuuauuuuuaguagagacgggguuucaccguguuagccaggauggucuugaucuccugaccucgugauccacccgccucagccucccaaagugcugggauuacaggcaugagccaccgcacccagccaacauuuauauaaaauuuuaaaacauacaaagcaguguuauauauuguuuaggaguacaugaacauguaguacauguaguaaacucugaagaaugcaugagagcaagauagguuacuucugaggggcaggcauaucuguaggcuuucagcuguauuggugauguuuauuuuugaaguugggugguggguacacaggaguucauuguaauguuccuuuuucuuccccccuuaugucuuaaauauugcauaauaaaacuuuuaaaaagcuauuaaaaaaggaaaagaaaaccacuugggaagauguucaccagucugauaaaugauuaccguguguuggugaaguaggcuuggguggaguucauagguaacuuuuucauuuucauuauuuauaguuauuucaauuuauauugugugaugugugauugaaauaaauauagaauugcuauuuuuaaaaaaaaggacaggugucuuucuguuaaucuacauuaguuuaucaugccaaaauuagucagugauuuuucacaaauguuuaguaaaaugagcauacacaaauauuaaaaucugucauuauauugugagauguuacuaaauaaaaaaacuuugguucuuuuuuuugaauaaguguuuuauaguauacugguccucagcauugagacuuagcugaggaauugucuauuuuauuauuauuuucaaaagaucagauuugauuuuaucaacuauacuuuuuguuuuagaugucauuuuuuuucuuucaucuuuauucuuucuaggaucuuugagguuuccuauuuuuuaauagcaucauguaucaaaagcuuauuucugugugucuugauuucuaacaaaugguuuauuaaugcuauuuagaagacaauuuggcaauaucugauguguacaucuuuaacuuuaaugcuauaugaugcccucucccacaaucccugaugacauucuagggguuucacucugcaguuguccuugcuaaaauuugucuuugguuucuuacuuaacugaaaaguuauuuagaaagguguuccuuuuuaaaaauuccaaauggauagauuuauuuuucucuuuaguugucugguuuuuaacuucuaauuuuaguacauugaaguuaauuuaugcccaauugauuucugcuucggauacuauuuuuagauuuucuuuguggcuugauacaugguaauucauaccauggugacuguucuuuaugugauuaaaauauuuguauacuuggaguuuuuauacauacuuaagauuaugcauuaugcaccuuguuccuuuguacccuuacauguuuuuauucugaccugucauuuucugagagaauaaugguagucuucuauucucaucugugaauuuuguaauuuaaccauuuuuugcuuuauacaugguauugucaagcuauaauugacaauaaagauauuaaaaguuucuaauauauuuuacaugaugaguuauaccuuuuaucaauacgaaaguauacuccuugauacauauugccuuaaauucuguuuugucauugcuuuagauuuaucccuuuuaaacaaaggcauaccucauuuuauugugcauaacuuuauugcacaucucagaucuugcgguuuuuuuguuuauuuacaaauugaagguugccgcaacccuucaucaagcaaguuucuuggcaccauuuuugcaacagcauaugcugacaucaugccucucugucacauuuugguaauucucaaaauauuuuaaacuuugucauuauuuauuuuuuauggugaucugugaucagugaucuuuaauguuacuauuguaguuguuuuggggugccagacacagcacccagauaagacagcaaacuuaaccaauaaauguuguauguguucugacuguuuuaccuaccagccauucccccaucucucucucucucugucucucucucucuucuugggcuucccuauucucugagauacaacaauauugaaauuaggccaauuaauuacaguggccucuaaguguucaagugaaaggaagagugguacaucucucacuuuaagucaaaugcuggaaaugauuaagcuuaucgagcaagacauagugaggcaagauagacugaaagcuaggcuucuugcaccuaauagccaaguuaugaaugcaaaagaaaaguucuugaaggaaauuaaaagugccacuccagugaacacacgaaugguaagaaagugaaacagccuuauuguugauaugaagaaaguuuuagugguguggguaaaagaucuaacuagccacaauauucccuuaagccaaaaccuaauccagagcaaggcccuaacucucuucaguucucugagggcuaagagaggggaggaagcugcagaggaaaaguuugaaacuagcagaguuugauucaugagguuuaaggaaagaagccaucuccauaacauaaaaguacaagaugaaacagcaagugcuaauggagaagcugcagcaaguuagccagaagaucuagcuaagauaauugaugaagcuggcuccacugaacaacagauuuuugauguaacuaaaacagccuucuauuggaagaagaucccauguaggacuuucauagcuagagaggagaagucaaugccugguuucaaagccucaaaaggcaggcugacacucuuuguuauggguaaaugcagcuggccacuuaaaguugaagccaugcucauugaccauucagaaaauccuagggccauuaagaauuaagccaaauauacucuaccugugcucuauaaauggaacaacaaagccugaaugacaacacaucuguuuacagcauaguuuacugaauuucuuaagcccaccauuuuagaccuacuacuaagaaaaaaacauuccuuuuaaaauacugccacucauugacaaugcuccuggucacccaagagcucugauggagauguacaaggaaauugauguuguuuucaugcagauaacacagcauccauucugcagcccguggaucaaggaguaauuuugacuuccaagucuuuacuauuuaagaaaugcaucuuguaaggcuauggcugccauugguaguaauuccuccgauccaucugggcaaaguaaguugaaaaccuggaaaggaugcaccauuaaguacauuugugacucaugggaggaggucagaauaucagcauuaagaggaguuuggaagaaguugauuccagcccucauggaugacuucgagggguucacaguuuguggaggaaauaacugcauaugugguggaaauaggaagagaaauagaaagggagccugaagauaugauugaauugcugcagucucuugauaaaacuugaauggaugaggaguggcuucuuguggaugagcaaagaaaguguuuuuuuuuaguuguuguuguuuuaucuuaauuuuuuuaaauccaugaaugcaggugaagaaagugguuucuugagauggauucuauuagugaagaugugaauauuguugaaaugacaacaaaggauuuagacuauuauguaaacuuacauaguaaguuugauaaagcaguggcaggguuugagagaauugacuucaguuuugaaagagguucuacaguucuacuguagguaaaauaugucaaacaguguugcaugcuagagauaaaucuuucaugaaaggaagaaucaaaugaugcagcaaacuucauucuugucuuauuuuaagaaauagccacagccaugccaaccuucagcaaccaccacccugauuaguaagcagccaucaacaucaaggcaggaacuuccaccagcaaaaagauuaugccuugacucauugaaggcucauuuuuuagaaauaagguuuuuuuuuuuuuuuauucuuugagauagggacucucucuguagcccaggcuggaguguaguggcaugaucauaguucguugcagacuugaacuccugggcucaagcaauccucgcacuucagccuccugaguaauugggacuacaggcgugcaccaccacauccagcuaauuuuuaaaguuuuguaaagauagagucuuacuauguugccugggcuggucuugauaaaguuuuuuuuguuguuuguuuguuuuuuuaauuuuuugcccgugacacagccccgggagauucugagaaaaugugccccucguaaaguauuuuuaaauuaagguauguacauuaucuuuuauagacauaaugcuguugcacauuuaauagacuacgguauaguauaaacauaacuuuuuaugcacugggaaacaaaaaaauuugugugucucgcuguauugcaacauucgcuuuauuucaguggucuggaaccgaacccacaguaucgcugagguaugccuguguauagcuguauuucgugucuaaucuaugaaucagucuuugaauagguggauuuaauuuauuuauauuuauuauuacuggaguguuuggacuuguccuaucuuauuuugugguuuucauuugccuuauuauuuauuaccuuuacccauauuuuguuaaauuauucaagcuuucuuugcucuuuccccaguagugguuugcacgacauguaaucuguuucucucuguguuggcguccaccuuuaaugucuagagucagacaguaucuacauuauuucuccuacccuacaaauaagaauccguuuguuuuuacuucuuuuuugguuaauaacauucuuauuugcuuguguuugucuguaauaaauacuuacuuuuuacuuaauuuuaugaauuucuuggccucccugucccuuucuuggauuauuuuuauugugcuuuguuuuguuugaaacccuuucagagaggauuugugaaaaauucaaguccuuaugugucuaaaaugucuucacauuuuaaugauaauuuggcuggauauagaaauauauauucaaaaucauuuuucucccaacuuugaagauacguuuuucacagauacuugucugucaucuuuuugcuuuuaaaguuguuggugagaagucugaugcaagacuaauuuucuuuguagaacuacauuucauugauucgguggagcauauuuuguuuuuuuuauuuuaacaguuccgaaagugcuucauuaagcagguuuucuugggugcugcugcuucuguuugaugaacuugguuccucucucucauuguacucaauuuuuccuacguucuuggggauguuaguuguuuguucaucucuguuuuugagauuuccagauaccuugucugugaauauggugucugaguacucuagugauaugggagaggagcagggucauacagcuaacugggaagcccugguaucuggucuuacuauuuguuagguuguuaauauaccucuuggacaccaucccucucucuguguuccuaauguccacaauagagaggaacauccucaacuugauaaagacaaucuacagaaaaccuggaacacaugucugcguggacaugguuggggcuaguguagaauuauaagguaggaaauuaguccucaguuaauccuucuaaugguugucugggugcaguucuuuccuguuugcagugugccucaucuagaaaagagcaccacagaagcucccccagcuggguuuuggggcucuggcuuccucuuucagucugauccuaccugccuucuacuguuucugucguaucuagggauuugggaaaagggaggguagcuagaucaugcucaugcacuauugauucagucagcucucugggcuuucaagaauguguauuaaguugauuucacagagucagaaaggauagggggaaaaaggaucugugugaaaaauccuggaaucucucauugcagucuguggaauuccugugguagagugcagugcagugguguacaccuggagagcucauugcugcuugucacaucaguuuauucaguggaagaagagacaaggcaaugaaccugugccugcugggcuaagacaggaguaaugucuuugcucugagugaccaggcucugcugaaaccgauggaugucuggcugcuuguccugugggguggccugcuuguagugagguuccaagugaauuucuugguaaguaaagguuuugucagagcagcauuaggaaagaacuuacucuuuaaaaaaugauacuuuaaaauuuucuucauuuuagaaacucuaaaaugggaaaauuguuucuuaaauaauagauucacaacuuuucaauaguuguaaaacccugacauuauuuaugaccuuuuucuacuuuccuaaaaauucuuauuuucaaguuaaaaugaguuaaauuugguauugggaacuucgccaucucaccuaagguuuggagucuucuaggauguuacagaucuggauuuaaaaacccuuauuuuaggcguuuccuaguauacagacuauuucaaagaugaaauauucagucucugcauuaauucuuacuaccaauuaugcaauaaucaaugaaagcugaauuacuugaaacauggcuccauauggauacagugcaaauguuuggauuuagauuaagucuugaauauaaacaaaaagccuauauacacucucuacaacauuucucauuugcaguucagcauuuaauggaaauuguuuagagucaugggguguguccucacacauauugguguguaaaaaacuagacaucuuuucuuuauaaaucuguauuuuguccuacauuaaaauauuacucuuugccugcucuaaguaaacaaggaauagagaggaacaucaacuuuauaaagagaaucuacaaaaacccuacagauaacauccuacuuaauggugaaagacugaaugcuuucauccuaaguugagaaacaaggcaaggauauacauauaucacuuuuacucaacauaguacugaaaguuauauaaagauaggaaaagaagaaauaaaacuguuucugcuuccagaugacaugaauguguacauagacaaucucauggaauccacagaaaaauuccuagaauaucaaaugaauucugcaauaucacagaauauuagaucaacaccaaaucaaucgcuuuucuguacugauaaugaacauguagagacugaaauuuaaagucaugccaaagaaagugaaauaccuagauacacaucuaacagaacacaucuaacaaaaaaauaaugauagaaaucaaagaaggcguaaauaaauggagagacauguguucaugaauuggaauaaacauacuacagaugccagucuuccccaaauggaucuagauguuuaacauaauuccuaucaaaacucugcagggguuuuauagacauagacaacauuauucuaaaauguaucuggaaaggcaaagaaccuagaauaacuaaaacaauuaugaaaagaauaacgagagaaaucacuaccacagacacucugaaaaauaguuugacaguuucuuauaaaaguaaauaugcucuuauaaaacuaaauaugcaauugcacuccuggguguuugucccagagaaaugaauaccuguauucacaaaaaucuguacauggauguucauagcaguuuuauuuauaauagccauaaacuggaaacagcccagguguuauccuucaacauguuaauuguuauacugugguguauucauaccauggaauacuaugcagcaauaaaaaggaauaaacuauugauacaacaacuuggauggauuucaaggggcaacaacaaucaucucagguuacaugcuauauaauuccauuuauaaaauucucuugauauaacaaaacuauaaaaauggagaacagauugguggcugccaggaauuagagaucgugguggguggugugccuguaaaaagauagcaugaaggagccuuguggugauggagcacuucugugucuggcgguuauagaaaucuccacaugugauaaaaauuucauagaaacuacauacacaaauaaauacaugugaaaugaugaaaucugaauaagcucuguggaguguaccaauaucaguuuccuaguuuugauauuuuacuguauuuaagcacaauguuacuauugggggaaacugggugaagaauacaugaaacuuaccuuuccauuuguuuuguuggccacucuugugaaucuauaauuauuucaaaaugaaaaguuugaauauagauacauauuauucauuaacuggaaggcaaguaucccagugugaguguuucuggcuuauuguguagugugguuuuaguuuuuagcaguaaugccugaugauggucugggaaagaagguugaugugacagaaacacaguauauuuugcaguguucaaaugcauucuaacaaauaucagucuuacgcugguauuuuuuauuuuuaaaaaauaaauauaaaaccagauaaucagcagaaaaauuucucuacugagggagagcauuuaccccucaccauguuaaaaguauguacuuguauuuuagagcacugauucuuaacuuuuucugauucauaaugccuuaaaauccuccauaaugaggaaggauauagacauaucuuagaauuguguucuuaagcaucuuuauuuauuuggcuuaacuuacuacguguaaagaacauuuuaaaauccaguaugcauuuaaaaauugcuaucccuggucuaucugaaaugaauugccuugucuugugaaaagguaaauuaauaaaauauaaauugagacauucuuuauagcuauuaacuuacuguuucuuaucauuuguauaauaugccagcuuuuggaaaucuugacauauucaagccaagaguuguacuuaagacugucauuucuuucugucuacccuagucugugauauaauagcuccucaguagacucuuuccuauaaaagagucuuuuagagaauuuuggaaauggguguccaccaaaagaauugugauuauagcauuaaguauaauguuaagauguuuaaauauuuuuuaaaggaucacuccugcuuguaagauaguacagccuaaguaagccguaaaaccuuuugauagaacuuugaacuauuucagaaggacauaaaugaagucaggccucguagugugugccuauagccccagcuacucaaaaggcugaggugggaagauugcuugagcccaggaguucaaguccagccuaggcaacauagacuccaucucuuaaaaaaaaauuuuuaaaaaaaggucauaaaugaaucaaauuuucucuuugguuuauaaauaaucugcaauuauagcuggguaugguggcacacaccuauagucccagcuacucaggaggcugagacaggaggaagaccacuugagcccaggaguucuaggcuguaguguauuaugccggucgguugccugcacuaaguuggacauuaauauggugaccucuugggagccaggguuaccacuaggcugccuaaggagagaugagcuggccuaguuuggaaauggaacaaguuaaaacuccuguguugaucaauagugggauagugccuggaaauagccacugugcuacaagccugggcaagguagugaggccccaucucuuaaaaaaaaaucugcaauuauaaguuguacagaaaucaauaacaccuuuauuucagauuccagagaugcuauuaauguauuuauuuuuacaguccuucccaaguggcaccaaauuugaauguguaguuucaugucccauuuuaagucauuguuuauuagaaacaaauguuuuaguaacguuucaguuuuucagaggaccuucucuucccagaggcagaauuuguuuaacuuuuauauuacuuccucuuguacuauuuaccauuuggauauacaggcccugaugaguucuagauuagaagacguuaggcuuuugucacagggacuacuccugacuaucgaguuugggauuaucugcuuuaaagggaugauuugugccucuucuaugguuagggaaagaaguuugaucuacuuuaaaguagcaccucaguaaguuuuauuaaaaauaauaccugccugguuaagugugcccagcacaaacugcguugcagccuggggcccaggcauagucaccaguguaauauuaaauugucaagaaacgaacaacguauccauagaaauguagcacacaccuucugucacccagcugccaaaugaaaugucacauacucugaaagauacuuuauacaucuauaauguuaucacuugucauauaaaacgagaaggaaagaaugaaaaucuuuuccuaagcuuccugaaauuucacacgccuauaagaaacaaauauuucugaaaccacaauuaaaaauugaucuggcauaaacccucuguaaauaaaaaguauuuagaauuaguaaagauucuugagcaugaaauguuuaugggagguauucuauagguaccauauagguggguuuuucagucauuuaaaaguauuugagcagacugaaaaauaugauagaaaucauuuauauguuuuuuauuuuccccacugauuuuuagcugugguacuuauuauucucacuguguuauaaggcucagaucaaacaaaauauguugauacaaauguauaauuuauucuaguuuagugguaggguaggauuuaaacugguggcucucaguggucaucauccaucaguuucaccugggggagauuuuuaaaaaauaccuauguugccugggccccacccccagagauugugauucacauugacuuggcuuagggucauauucagaagcuuccaugcaauuauaauaugcauccagccuugccuacugcugauuuuaaccuauagaaucaaauauuuuuagacauuaguggaaaaagauauuuucaacauuuuaaauucugauguucuuuaaaaauuguuuuuaacuucuuuaaagaguaaacaggaauauuucuuuuuugauguugauaauuggagcuuaauuuuuuuuuucuucccugccucccauuuuuaaccacucucugcucauuuagggauaagugaaaaccauguuuuagaccccuuggaaauuuuuucugauguguguccucagaaccagugucuggaacuucaagcuagaccccccuccccacccccuuggaaacuccucugcauugauugcuuguccuuuccucuucccugaggagcccagagaccuuccugccugcuuccuuuccacugcuguucccuggagcuucugauuagugccccugguccugugcaggucagauuaccacaccgccucauuccaacucauuuucuuggguucauaguaccuuugcaguuuucuaagggcucuuagugcuuuuaacuagaaagggguuuuucguuuguuuguuuguuuuaaaaggguccuuagugccucuuacucccuuccuguaaaauccuguguaaaaugacaaaagugcacaauugaucauuguaaguucuaguacaugaacaaaaaccaaaaguuaauauuuauauaaauuucaaagcagaacucauacgcugaaucuggguaguuugucugaacuuccuaauggggcugacuggcauaaguguguguauuuuagaaagacaacaagagaaaggagggauuuuaggggcagguuuucuuuccuuuguucuaccacaguucucugauguggaaaguuccagaugagaggaggaucuggggcuuugugcaagaguaugucgggaauugcaguggggagcagcuguaaggagagaauuccuugggucagcagacugagguagcaguuucagguaacccuuacucauaaggaaaacaauguuuacccuuucuuuguacaauucaaguuggaucauauuauuccucugcugaaaacuauuuagagaccuuccauuucagucugaaucaaaaccaccauccucacuguggccaacacagcccaaaagauuggcaucuccauuucuucccagacuuuccucucacuaccuuccugguugcuccuucggcuccagccacgcugccuccuugcuguuaggcacacuccaagcccgguccuaccucagggccauccaucucccuccucugccuagccacucuugccccugauuuucuugcccacaugucaccccucagugaggccucagcuucuucuccagagguguagggccccagcacugccuguuaucuuuccccacuugacuugcaucucugggcucuguuaccuccauuugugaaaugggguucauaguuccugccuuuaggauuauugaggggauuagaugaaugaauacauguaaaguacuuagcauaacgccagacacaaaauuagcccucaguccaucagaugucacugucucagugcugcugcuuugggaaacgucaugggaugcuuuauguuucuaugguguugcugcuguggucccagagggacacuuaacauuagauccuggccuuauuuuccuuuccugccucuuucucaaugugggaggaagaguauccgagguacccuuguccccuuuggaaauuuguccucgggaauuucugaaauguuggcugccgugggaaaauggggaggaagggcaggccugggaccuuugcuccugugguuuucucacauguuuuuaguuguauuuaacuuucagaauguuauguuauuuguauuuagggaauagguuaacuucuaaaguagggauuuuucuuucuuuuuuaaaauguuagauaaaaaaaaaugaaagucuugguguuuauuugauagcagguuaguuucuuagaacuucagaagggcuuuucaaaccacucaaaacaguagcuauuuuaguacaaaaauacauauggaagcugaaucaacuuacauucaccuuaggucauaacaugggaaaccuuuagggaguugaaaauauuaaauuuucuuuuuuuuuuuuuuaaacuuuuugagguaagaaauguaugccuguugaagaagaaagauaaguuugcaagacaaaaaaaucagcauuagagcaaacuuucuaacacaaauuuggaauuguguuauucgcauugcauguugccgaacagacugaacuguuaaaaguuguuuuagcguuuuagaauguacuaaagaaucgaguccggcgugguggcucaugccuuuaaucgcagcacuuugggaggccgaggcaggugaaucacaugaagccaggagaguucgagaccagccuggccaagcagaugaaaccccaucucuacuaaaaauacaaaaauuagccaggcgugguagcgcaugcauguacucccagcuacucaggaggcugaggcaggagaaugacuugaaccugggagguggagguugcagugagcugagaucgugccacugcacuccagccugggcgacaaagcgagacuuugucucaaaaaaaaaaaaaaaaagaaucaguuuguuuguuuauaugcaggcugcuaugcuugaucacucucuugugcucacugagaugggccaggugggacuaguuagugaccggucucaguuccuggagagucccugucccagcauguuaggagguugcauguguggucaucagguugaucuauuagccuuauauaggguuguaauaagaaaguauuucuaguguaguguaaacagugccuaauuuaauauuuuuaaaauuuuaauuuagaauuauuuuaaacucugaaaccuaagaaaaaacauuacaaguucucagccuuuguaauacuguaucugguaagucggaaaacaagaccuuuuagagugagacgcucuucguagauauaucgaaaucucggcaccuggaaugcagccaggcacagaguaggcauacuauuuugcuggguguaaaaauaaaagaggggcuguggauggcuaaaaaaggaggaugaugaaguuaggagaaugcaugcccugauugcucuuucucuuuggaauuggauggggcggugccaagccugccucacuccagauggcucacuugucccccuugcucaauaguaagguccuugagagaggggaccauguguuuguuuauauuuugucaguguccugucaccuggcaaacguaacaagcucauaauauuuauuuaaauuaauguuaacagagaugaaccaaggaaaugaagauuacauuaauuguggucacccucuguggcucuucccaaucucuuugcugaugucguaauuccuuuuccuugccuuguaucuguuauauuuaaugaguccuagacucuuagaggacccagugaaagcugugauuccuguuuucagagagauacaaacaugcauuuuggguuaguuucagagguguuuauugaacacuaugaagcccuuuuuuggaucugaucuugcaagcuuaugagguugagaaacaaguggacccgcaacuauuuggaugaacacaaacaguuuugaaauaagcuuuggaacauaaaauacacauguaaaauaguguucuuauuuuugugccuuugaauacgugacucauucauugcuguuuuauauacuagaucucccauuuucccuauuguguuuuaaauuucauggauaugacuugaguaggagauuguaauggaaaauuggagguaagguuauaaaugggucuguuuccaaaggaaacaucaagucauuggguacaguauucuuuuuauuuccuaaagucagacagacuuguagauguuugguauauuuuauaugguuuucuuaaaaacccauuuuguauaacagaguucguaugcgucaacucuccacugacauuuggaggcccuuguuaggguuuaagagaaacaacauggauugggagcuccaguagguggaaggaagccccugagauggugugacugauucaucaccacguuccagguugugauucucagcuuuguauucaguagugauuaguuucuagaggacugaaacuggcuuaacaaaguguuuuguauauauacuaaugaauacacuagaacaccaaucaguugauuuacaaugagacguauuaaauguuagucaacgccaagcuuguauuguaucagaguagcuggguuuuuuuuuuccccaaauuuaccuauuuucagaguuuuaauaagauauucuaccaaaaaagccuguuuauuagugcauaauguaaguugauuagguuuaaucauuuuuaggaacauuugugauccauugaaacuccugaggucacacuuuuaagauucuuauaugaauuuuugcuuuagaucuagaaagggcucuucaugacuuugaauuuuagcucauguauuccuguuacucccaaaacuuuacaaacaugauuuuuucaagguuuuuuuuuuuuuuuuuuaaguuauuauagcagaaccuucauuuggcugaaacccauuauguuccaucuggaggcagaagauucucuugguuuuagauuaguucuaguuuuguacucaguuaucaguuugugaggugagguaccuugcccuguaucccauucaaggcuguauuaucagugucaguaaacaacuucauaagaauuucuuggguuuaccaucuagcuucaguaucaaaaugaauuuauuaauuaguagaggcaagaauagagagagaacuugaguguccccugacuuuguaaccuuugacucuuccagcuguugucaggagaacaaaggggacagcuuuucuuaugguaaggagucuuuccaaaauuguuuuuauguuacuuuauguaagauaaacaaucuucagaauccuuagcuauccaugaaucuuaccaauuagaggacugccuauugaucauuuaccaguuuuugaguuguccuaaacccaggagagcaccaggaggcaagcaaauaaagacuccugguagaugaaauggacuguccuaagugcauguacaaagcucauguauuuugcucguagcugucauucagggucucacucagacccuuauuuaguuaauuuuacguauaauucuagcaaguucaguaaauucguauuuccagcugucagcugauagguaacagggaccuccuaaagucaagugcccugacugauagcagcaagaugagaaagaaucaugaaaucaucaucaaaaacuuaaaaaacacggugugcgccucuccuugccaccugaaguccgaguguuuaacagugcuuaugggcaccucuggagguaaggcgaggcgccuacuuaccauggaagcagcucuaaaaggggaaucuuugauggaagauaagauggaggcaucuuuuaaagccaggugguuguuacuuucugugugacuuaaugagcaggugaauuuuggcaagucccaggacacaaagugcgguggugcugucucaccuaggucccuucauugccaacuuuuuagguuucauuaugauuauaucucagcaccuagcacagcgccuggcaaauagugcugccgcacauuuguugaauauacauaucagugucugcuuuguggcuuuuuggcauagagacugaugcccccaggggcacugcuguaucuuagcaugguucuucagcuggucauucugagugaugcagaaaaaagaacagggucuaaucauuuuaaauuccucuauuauuagacaacauaagaggaagaauuaauuaauugacuggaaaaauucaacauuuggagaagaaaugauugauuucuauguaugucuauuucaaaauaaauuccaggugaauuaaggauuuguaugugaauaauuaagaacaaagugaauauucauaugaucuugaccuuucuaagaaagagucauaagaaaaaggguaguagcuuugauuacaguucguggauguaguacacauauuauucgaaacaaaauuauaaugcaaacaaguuggggcaauauuuguaauauaggaaaugguuacuauucuuaagguagaaagaguucuuacaaaucaaugacaaacuccccuauagacaaaugaaaagaaaauuuauuaaagaaguuauguaacuagccaguaaaagaagaaaaaguuuaaccuugcaaauaauuagaguauucaggacuuaguagaaaagcuacaaugauaaagacuguauugguaggccgggugcaguggcucaugccuguaauccgagcacuuugggaggccgaggugggcagaucaugaggucaggagaucgagaccauccuggcuaacauggugaaaccccgucucuacuaaaaauacaaaaaauuagcugggagugguggugggugccuguagucccagcuacucaggaggcugaggcaggagaauggcgugaacccgggaggcggagcuuacagugagccgagaccgugccacugcacuacagccugcgcgacagaguaagacuccgucucaaaaaaaaaaaaaaagacuguauuggcaaaggguagacugauagaucagugaaauagaauagaaaguccauaaauaaaccuacacauauguggccaguugauuuucaacaaaggugcuaaagcaauucaauggagaaauggccguuuuuuucagcaaugcuguggcaacaguuggauauccauaugcaauaaaaugaaccuugaucaguaccucacgccauguguaaaagcucgaucugugucauagacauacauguaaaaugaaaaacuauaaaacuucuagaauaaaacauaggggaucuuugcaaccuuagguuaggcaaagauauuuuguacaguaccaagagcaugauccaaaaaagaaaaauauugaauaauucaccagaaaagacauaauauggcauauaagcacaugcagauguuccacaccauuagucauuagggaaaugcaaguuaaaaccacaccuauuagaauagcuaaaauuuuuaaaacugacaauaccaagugcuggcaagggugugaauggagcaauugaaaugcucauacauuucuggugggaauguaaaaucguauaaccaguuagaaaaaucauuuggcaguuucuuagaaagauaaacauacacuuacccagcaauggcccagcaaacucacuccuagguauuuacccaagagaaaugagaauuuauguuuauacaaaagccuguacacacuuuuuuugugacuuuauucauaacugucccaaacugaaauaaaugguggaacaucuacacaauggaauacuacucagccaugaaaaauggugaccuauugauguguacaacaacaugagugaaucucaaugcauuauugagaaaaaccagacugcaaaacagucugcauuauugagaaaaacagagacuacguacucugugacuccauuucuaggcaaaacuugcaaggacacacaauagcugugguugucaggggcugggcuuggggaagggaugacuacacagaggcacaaaggaaauuuugggguaacacagcugcucuguaucuugauugugguaguuaugugacugcauuugucagaacuuggagaaaugcacccuaaaaauggugaauuuuguuguauauaaauuauaccuuaaagaaauuagggaaaaaauaaucaggccaguauacauugaaacagaucuuuauaauuuuaccuaauaggcuaauaguaaggauuaucuaugguguuggugaggauggggcccucccacaggcugcuaauaaaucuuacuggcguuaggccgggcgugguggcucacgccuguaauccgagcacuuugggaggccaaggcggguggaucacaaggucaggaguucaagaucagccuggccaacauggugaaaccccgucucuaauaaaaacuacaaaaauuagccaggccugguggcacaugccugugguuccggcuacuccggaggcugaggcagaagaaucgcuugaaccugggauguggagguugcaguaagcugcgaucgugucacugcacuccagccugggugauagggugagacucugucucaaaaaaaaaaaaaaaaaagaauaaaucuuacuggcauuaaauaugcacugcuuucauaaucugaaagaaguaaguguuaauuugaaaaacaggagaugugugguuauauuugagagaacuuuucuaaacuuuuaauacgaaggaaaaucugaaaguuauaauccuacauggaaccaaccagguuguguauuuauuguaauuccuagaaagauauacugauuuuuuuaauacaggaaaauagguugcauacauuuuaaaaccacaugucuaauuuagguguuaugcauggagaacuagccaaaacaaacauuucaagagcuaauauuuugaauuuugaaauuuguuauauuaaauuugcuauuuaaaguucauuucucuuuacucucaaaugaggaaguuaguuuccuggcaagcuuaaacauuuuagagaaaccugcauaauguaucuucuguuaaagaacauaccuugcuugauuuuuauccccagugcccagaaagcuuuguuucauuaaacuuucuuugcuuuuugaaagagaacccauuuucuuagccugccauuugcagcaggugauuuuuaucaacugguguuuuaauagcuuguauauucaucuuauguuagcacaccucagccucacacaaaagacuguguuuuuugguuuuguuuuuuuuguuuuugagacggagucucgcgcuuucacccaggcuggacugcaguggcgcugucuuggcucacugcaagcucugccucccggguucacaccauucuccugccucagccuccugaguagcugggauuauaggugcccgccaccgcgcccggcuaauuuuuuguauuuuuaguagagacaggauuucacuguguuagccaagauggucucgaucuccugaccucgugauccacccgccuuggccucccaaagugcugggauuacaggugugagccaccgugcccggcccaaaagacuguguuuuuaacaucaacuuaagaaaacaucaaaauacuccacuagcugucaaacuaaaacguuuaguugauggacacuccaaauuuauaaaaugcugauucauauaggucucuaaucuaguugcauuugacugacuagacaaauagaauuggacauuuuuagauguggugcuaaauuuaaauguuucuucuuucuaguucgaaguuaaccauauaauaagccuaaaaauugcauugcauuugucauaaucuugugggaaauuugaaaugugaaaucacugcuugaaacuaaauuuaaaaagccacucuguaucccuggugaagcaguucuccaauggguccccccuuggaugaguauccauauugaaacucagcuaagcagccaucagaggauuugaaccaggucucucugaagcuuuaggccaggcaugcuauuuucauuaggccacacugaaagaaaucgcccaaguaugauguuuucgccaucuuaucuuuccguuuucauuuguacuuuuccugagugguaccaacagcagguuuguaaaaugauuuuaugaaggaaugcugaguuggaagggugucugcugcuugucugguuuggauuugugugaaugugugcagucccacaauaugugauugauaacacuuugacuucuugaacuuuuucuguuuuaacuugaaaaaacaaguuugcacagggccuuaaaaaggugacugaaauaaacugcagcuuaucuucccugauuuaucccaccacagucugcucugagcacuucuuagucuccuuuucuucuuagcuuuguguauguguguguguguguaggauugggaauaaccaccaccuuccucuguacccuaaaacucugcuuuagcugucuuuugagggggccccacaauauuugcagaacucuuuugaaaaauuucagguuuucauucagcaaacuuguguugagcaggcccuggcugaguguagacuagggccugcucaacagaaggcccuauucugugcucaaggagcuccaaguauuggagggaaauagaauaucuguaaucacagcccauuguaaugaugcugaaauuguuagguagcccagguuucugaguuggagggcagugugggaagaccuuggggaagaugaggaucauuggaggauuugaagcacaucauagaauuggcagugccuucuugaucuggaagucagaggacccucagaguagggagucugggaugucuccuaaguuuagacuguacccaccaggguagauggggagaaauaaacuugggggaaaaaaaugauaagcuuaguuuuagcagcauugauuuuugaaguccccaagggacauuuagaugaauuaagaucugggaaaggaguguuuuaaaguagguaucagaugauggcauucguucuuucuaggggaaaaggaaacauuucccuguuaaauaauaaaaccuugcuucuaacuagaguaucgauaaaaccaggaauacuagacauaucagaaaauagaucuaaaaaacuuguccaaguucuucauuccucuucugcuucuuucguaugcuguuaguucagaugaucugacaguuuucuacuuuuggaaugcuuucuagucauguuccuuaaaacuaaccacugaucuuguuuuacaagaaagaaucuuuaguaaccaaagcucuacaugauuuugaaugcagacaaguaguucuucuguguaaauaggaauucagauggauaaacaugggcaauuagguuucucaguguuguacaaaaagcaaaggucuuagguuuuauuauagaacuccugggaccuacacacuucugaaacaguacuugcuauucuaagaaagcauugccuucuacauuaguguuaggucauaugucagugucuugugaccguaguuggaacugaaaagugauugcauaaauccuggcagcugugaaguggucuuguaaaaggugccccuauuuuaucugcugugguuuuagaacauucuaguucuauugcuucuuucauuauuuauggcuauacugauaaaagaaagcugauaaaaggaaaaaaauagagguuucuaccuaaaauccuucuucuggacuucccauuuuuauuauuuucuaauccuccucuuuuguuguauagauaauucaguuuagaaaugacuuuuuaggaaaccucucaguaguccugaaguccccuccccacccuguuggcauuugcuuuuccucagaugaaugauuagcauguucuuuuauucuguuuuguuuucauuuugaucuugaacucuaccccaacccuagaaauagcauaauucaguuauauuauauagaccugcugaguguuagccagaugagacuucagugcucauuucugugaccuuauuuccagcuagcuugaaggcagccaguaaggggaacuuguaacucccacccuuuauauuaugaaaaacuucauuaucucuuuacuccuucccauaguuccaugaguuggguuuuuuuuuuuuaaaccaagccaauuacauuuauuaaauauuuccuuuuuuucauuuuuauuaaccaagugccuauagcugggucugaaauaaaaacauacacuucagauaguuguaucuauaugauauuugauucagaugguugauguuuguuaacccguggaucuuuaauaugaagagacaguuccauuaacauuuuuuggaaaugauuauaauaagguccccuguacauuucgcuccauuacacccccaucccccauuuacgguuucagugaucccuugcagucuuaggaucucaagcugaggcuguggucuauaccuuaggaguuuguaguuuuguuaacacgguuuuuuuuuuuuucuuauggaaaaagauaauuuaaaauauucucuaaaaugaaugguuuuucuuuuuucuuaagagauggggucuggcuauguuucccaggcuagagcacaauggcuauucacagaugugguuuagcacacuguggacucaaauuccuggguucaagugauccucccaccuuaggcuuccugcuagcugggacuguaggcaugcaccacugugccuggcuuaaaaugaauguuauauuaagacagguaccacuucccacccccauuuguggaggaauaugguggauaauuuuuguugaugccauucuuaguccuauaauaccagaugucuaguucuggggacccaagcuccugaaucaucaccuuuuuuuaaaaaaaaccugaauuacuaagaauaagaagcuuucccuguuucuucucucucccaucucaaacuguguuggcuuugugccugcuugaacuuaccuacugucuguuucccacaucuguuucacuaauuuccacuggagcauccuuaguggcuugggaggcuuguaagggcaagggcaucucuuacucaucucugucugcuaugccaagaacagugccugccacagaugaagcagggcagggcagcagcagccaccuuugaauguuuucucugugcugaauacuuagcauggauucuguuuuaauucauuuaauguccacagcagcuuuacaagaaaguagauuacuauuaguacuuccauuuuaaagauugggaacacauuuuaaaauaauuugguuaaagucguagcgcucuguugaguggccuguuuuuaucucuuuccuuuggcccuugggaugaaaaaguaaaauuauucaaagacaaaaguaaaguaagaagagaaauaaaaagucuggaaaaugagguggauggaucaugaggucaggggaucgagaccauccuggcuaacacagugaaaccucgucucaacuaaaaauagaaaaaauuagccgggugugguggcgggugccuguaguacuagcuacucgggaggcuaaggcaggagaauggcaugaaccugggaggcagagcuuacagugagccgagaucgcaccacugcccuccagccugggugacagagcgagacuccgucucaaaaaaaaaaaaagucugggaaauaaauauauggaauaaauggccccuugaauaaucacauugccucagugggagagucauuugcccucucugaaacuuaguuacccugcuguucuuuucuaguuuaaaugcuucaaauuaugucauuuagcuuagccaacuacuugacauagaauuguauuucuaauuuuuucaaucuuuuagcauuucuauauuuagaaauuauuugagcccuaacugaaaacugugggacuguauauuuauguugcuuuucuucuuuuuuauuauucuaaucauguaucacaucauaacaagccgaguguguuaaggggauuggacaaaucauccugaagagaaaauuuccaaauaauuggacuucuuguuguuugugaggcuaaucuuuaacagaaaaagaaaguuuucuucggucaaauaagaauguuggguaauuguuaguugauauuuauauuauucauuauauuuuuaaaacauuauuuugaauaauugcacuaucagauauccaguuuggcauggacaagagguaaaaaaccaaacuaguuuauguacaguuauaguaugagauaguaguggaaauaaugucauuaaacucauuuuauaaaaguugauguuuuauaggacuuauauggaaagauaugaauuuauuguauuucaaauacauauguauuagugguuagguaugauuauaaguagucgcauuaaacauugucaauauuugaacaauagaagaaaaaguuuuuaacuaccuggauguuuauuguuuauguauuuucauugucagccauuuaaaaucaccccuuuuuuuugcuguggagggauagccaaguauauauuauuuuuuaaaacuugguagguuucccuccuuggauaauggacauaguuggaaagguggcauuuacuuuacagugaauuucuaaaacauaacuuuuuguaaaugaagugcacauugcaauaaagggagaauaauuguaauugccacuuguucacagugguggcuugggaguugggacaagugacccaaaauagcagauuugagugguacaaagaggaggauuuaaguuaaacauaaacuauauaaauuuccuuuaaaaaaucuuaauaagguacuacuucgacugggguuauaaauucguuucacuggcuauuuaaagaauagaugugacuagucgccauuauuaagauauguuugauuuuugaauggggauggcucucuggauuccaaagucagggcaaagaaaugacagugaauggaguggacuccugagucagcuugcuguccuagggcagauaaugcaugcauucaaaaagcaaugucagaccucuuagggagacugcagagccaaggguuuggacugaaugauccauaggucccuuucaucuucaauuacguaaauguuuaauuucagucugcuuuuuucaucugauucauuaguuuccaucagaguauccuuaguaaaauuuauuguacguauuaaaaaaucacauuguauguaacuuuuggguuucugccuuuguugccaaucuuuguuuaguuugaaccaaggaaaagauauuuuauuaaguuuuaauuaucuugggaaauaacauggaaccuacauuauuuuggguguuuuaaguuuaaauggaaacagcaguugaauguuaacagaugugaugacaaaggccauguggucugcccuuccauucucuuuuaagccuuuuguggucuagaauacuucuugaauucguuucuuauuaugugaauguuuauauuaucaugccuguucuuuaguuucuggaaugaaugaaugauuugugaugccuuuccuaaguccuuuucaucuuaaaaauuuuuuuucaucugaacaaaagaucauuuucccauaugauugauggguuugcuuuuuauuuaaugaugaaagagguaaggaguuguuuguuacugucagaguucgucuaaugcuagaguugagagguccuuagaugucagcuagcccagccuuaccauuggugcagaaaugccuuaugcaaaauuuuagacagauguuugcccugccuuugcuggaauacuuuuagugauggauaacucacugccuuuucugguauuguaacggcuccauugaguaguuccccauuuuuuagcugaaaugugucucuuaaguaaccaaguuucauccucuggaguaauauauaaccagucuuuuuccugauugacuauauugauggccauguuucuuuccuccuugagcuuuaauuuucuugcguauaaaaugacaugaguuacaucaccugguuaccucacuagcguugagguaaagaacaacuugacauaauugugaccuuaggcaaaauucuuuuccggucucagaguauuaauauauuaguuuuauuucugguauauauucuaaugggaaaaauagcaguguguugucuguuggcuugggcaccuggauacuuuucaguugauauuauugcucuguuaccaaaggcauuaauuugucucuucaucgaacauuuauugaccauucacuguguacuagcaauuacuguaaaaacauugaagaagauagacaccuucccugcccuauuggggcuucuuuuccuucauggauguuuguacuuugagauauaaaugcuuuugacugcucaagauaaaauaauauuguuagcgcacuuuuaauguuuuugguuuucuaauuaguccaauauuuuaaaguaugucuuugauuuauagauauuuggagucugggagugauccuuuucauguuggugugugggcagccgcccuuucaagaagccaaugacagugaaacacugacaaugaucauggauugcaaauauacaguaccaucccaugugucuaaagaguguaaagaguaaguaaaacaaaguauguggaaaccuuaaggacucagauuaaaaccagaaguuuuaauuccauuaauaugucaagaaaauuugagaggacuucaaacauccaagcaucuggguugauuuuaauuuuugaauuuaauauuucugcuguuguuucagaguguucggucggcgggggugggggugguuagccccugaauaugaucugaaauuuaauauuagaguacaaaauguauucaucuauuucuuauucaagaaaucuauuacaugccucuucaaccuucaggaguggugguuauuucacuugaacugaagaaauaccaugggaacuaccuuucucugcaugagcaaaaagcaagaucaccuggaauuguuuuaaguuccagagaagaguuagggcauuuucuuuccugaauagaccaucaacacacuauuuuaggguuuacauaguaugucucauaauuuucuucacacaccuucugcuaauugacuaaagagcuguuuagguuuaugugacuaugggaagccagcauaaaaaguauacucaauuauuuggaauuuaaaguaguacauaguacuaugauauguguagugagaaauauaguaauggaauagaacuguuggaaguucaguauugacauuuuaagugacauuuuuuaaugagcucagcugagauuauagccacuacuuacaggacuuugcuguagaaacagaguuuugaguuucuccuaucagcugguaagaaggaaaucugauugcccaaggacuuuuuuucucuaaaugaagccccaucucagguggauguuuaagaacuuagguauucaaggccgaggcaggcagaucacaaggucaggagaucgagaccauccugacuuacauggugaaaccccgucucuacuaaaaauacagaaaauuaccugggcgccuguaguuccagcuacucaggaggcugaggcgggagaauggcgugaacccuggagguggagcuugcagugagccgagaucgcgccacugcauuccagccugggcgacagagcgagacucugucucaaaaaaaaaaaaaaaaaaaaaaaaaaaaagaacuuagguauugaaacucuggauucaaauauugacuucuccauuuacuaaugaugucagagugguagaaacuaccauauaggguuauugugaaaauuaagugaauuaauauguguaaagcucuuagcucgguccuuagcacauaggaaacuaugaauauugaugaugauuauuuuuaugacguuacuguuaacuauucucuaccccaagaagcagggcaguugucugggggcauacguugucugcauguuggauguuugugaugcauguuguaauucaaggaguauuuccacagcuucuacugaaaaagcuuauuuuuauauugauauauauaucauucaaauaaguauacaauguauauguaguaaaaugagggccuguguacccauuaucuagcuuaagaaauagaacaguuccuaguaucuuaguagcugucugugucucccuccuagaaggauuauuuuuaauaauuauugaggcugggcgcaguggcucacaccuguaaucccagcacuuaaggaggccgagacaggcagaucacaagaucaggaguucgagaccagccugaucaacauggugaaacccugucucuacuaaaaauacaaaacuuagccgggcaugguggcuggcgccuguaaucccagcuacucaggaggcugaggcaggagaaucacuugaacccaggagguggagguugcagugagcugagaucaugccacugcacuccagccugggcgacagagugagacucugucucaaaaaacuaauaauuauuauuggggccaggcaugguggcucguuccuguaaucucagcacuuugggaggccaagauggaaggaucauuugugcccaggaguucaagaccagccugggcaacauagggaggcccugucucuacuaaacaaacaagcaaaaagaaaaauuagccaguuacgguggcucacgccuguggucucagcuacuggagaggcugaggugggaggauggcaugggccuagagggucgaggauacggugagcugcgauugcaccacugcacuccagucuggguaacagaguaagacccugucucaaaaaaaaaaaaaauuauugggacuauuuagguuuuuaaaauuuuuuccuauuucaguuuugcuaagcuguguuuuuuaagggacaugucugcuuuauauaauuuuucaaauguauuaaccucaaguauuuauauuaucuuuuuuuuuuuuugagauggagucuagugguguucccaggcuggagugcaguggcacagucucggcucacuucagccuccaccuccuggguucaagcgauucuccugcuucagccucccaguuagcugggacuagaggugugugccaccgugcccagcuaauguuuguauuuuuaguaaaggcaagguuuuaacauguuggccgggauggucucaaucucuuaaccucgugauccgccugccucggccucccaaagugcugggauuacaggcaugagccaccacgcccagccuauaauaucuuuuaguuauauuuuuuaagucuauaagaaguguggauauauuguccuuuuuaauuucaauagugauaauuugugccuuaucuuuuuuuugucuugaucaguuuugccagaaguuuguuauuuuauuagucuuuuucuaagaacuaccuuuugcuuuuauuaacaauuauaauuuuuguuuuauguuuuauuaauuuucuuuucucuugucuguaguauuucgugccacucacuuccaugggcuaauucuguucuuccucuuucuguuguuggauacuuagcucacaaauuucccuuuucuguuguaauaauuuaaggguauaaauugccuacugauaccauuuuagcugcaucccacuaguuuugauuuauaguccuuuuguuauucaguucuaauaaguauuuucuaguuuguguugauuuauuucaugugugaguuguuuacagggguguuuuacauuuccaaauguauggcguuuuucuaauuagcuuuuuauugauuucuaacuuaauuguguugugguccaauaauaauagccucuaugguaccaguguuguuuuuguuuuuuuguuuuuucaaauugcugagacuugcuuauggccuagcauaaggucuuuuuguucuggaaaauaguguauauuuuccaguuuuggaguucugcauaaauccuuaagaucaagcuuuuuuauuaugcuguucaaaauuauuugcauccuguaugaguuuuucuuucuccuacuggaucuaucaguuacugagguauucuuccacugugaugguggauuuguuuuuuuucuuggagcucugucaguuuuugcuuugaguguuuugagguaauguuauuaggugcaaacaaguugaaaagugucguaucuucccauucuaucaauuuguaucaaugagguaauggcccucuuuaguacugcuuuuuugccuuaaagucagucuguguugucuaauuucagccacaccagucuucuguuggcuaccauuugugugcuguagaguuuuucuuucuuuucuuaaacuucccauuguccugguuuuaaauacaucuuuuuuuaacaggcuggagccgaguuuuucuuuaaucccaucugaucauuuuuguguuuuaaauggagaguuuauuccauuuacauuuauuguagucacugauagauguagaucuauuuaugccaucuuuuuauauguuuuauguuuguccuacuucaguuuuuuuuuucuuuuuaccccauucuuuggaguugauggaggauuccuuuccuuucccuuccccuucauucuuucucuuuuucuuucuuucuucccucccucccuuuccuuccuccccucucuccuucccuuuccuccccuccuuacccucccuccacccucucucccuugcucucucccucccuugcucucucccucuguccgccuucccucccucucuuucuuuucuuagacagggucuugcuuuguugcccaggcuggaauacagugguaaaaucauacauagcucacugcagccuucaacuccugggcucaagugauuguccugccucagucuccugaguagcuaggacuacaggugugugccaccaugccuggcuaauauuuaaacuuuuuguagagaccgggucucacuauguugcccagacuguucuugaacucauggucucaagagauccuccagccucugccucccgaagugcugggauuauagacaugagcuaccacacccugccaagguuuuucuuuuuccccucauuugacuuucccccugaauuagcuaggaaguuauagucuguuauuuuagugauuuuucuaccuguuuuaacacagauacacauuuuuguuuguuuguuuugguuuugguuuuuuucgagacggagucucgcucuguugcccaggccggagugcaguggugugaucucggcuugcugcaagcucugccucccagguucaagugauucuccugccucaagccucccaaguagcugagacuacaggcgcccgccaucacgcuuggcuaauuuuuuguauuuuuaguagagacggguuuucaccguguuagccaggguggucucgaucuccugaccucgugauccaccugccugggccucccaaagugcugggauuacaggcaugagccaccgcgccuggccaaauauacauguuuuuauaccuuuuuuuucuauuuuuuuugagguggagucucgaucugucgcccaggcucgagugcagugacacuaucuuggcucaccgcagccuccaccucccaaguucaagugauucucaugccucugccucuggaguagcugggauuacaggcacacgccaccacaucuggcuaauuuuuuguauuuuuaguagugaugggguuucgcauuuugcccaggcuggucucgaacuccuuagcucaggcaguccacccgccucagccucccaaagugcuaggauuacaggcaugaaccacugugcccaggggccucauguuuuuauacuuaauuuaacaaaauuuauagcuuauucuuauuuuuuggagggugucgggggaauggucucacccugucacccaggcuggaaugccucagugcaaucauggcucacuacagccuugaccucucagccucccaaguagcugggaccacaggugcaagccaccacaccuggcuaauuuuuuuuuuaauuuuuuuguagagaugguguauuaguccauuucauacugcuacaaagaacugcuggguaauuuauagaggaaagagauuuaauugacuugcaguucagcauggcuggagaggccucaggaaacacagucauggcagaaagugaaggggaagcaaggcaccuucuucacaaggcagcaggaaggaaaaggaacuuaggagaagcuacugaacacuuauagaaccaucacuaucagaacagcauggggaaacugcccccaugauucauuuaccuccaccuggugucucuguugacacauggggauuauggggauuauaauucaaaauuagauuuggguggggacacaaagccuaaucauaucagacaaugucugauauguugcccaggcuggucugagacuccugggcucaagcagucccuccgccucagccuuccaaagugcugcgaugacggguaugagccacugcgucuggccucuuuauucucuucuugaacaacacaaaaucuuuagaauauuuuaacuaccauccaauauuuuaauaacuuuucaaaugccacaaaguagauaugauuaucauucuacacaguuaaaaauuucauauuuacccagaugcuugacagaaacuguuuacccuuccaaguggaaucacacuauccugucaaaauaaaauuguuuagaauuuguuuggaugagcauauguuggugauaagcauucucaguuuuuauuuggaaugucuucauguuauuuaugcuccuaaaagaugguuucauugaguauggaauucuagauugacaguuauuuucucucagcucauggaagauauuauuccacuguuuucuggcauccauuguugcuguugagaagucagcuguccaucuuaucaucuucuugucuccacguagguguccugucuucacuuaggcugcuuuaagauuuucuauuuauugugcuuaggauguguuaggcuuagugguucaagaugugugcucuuugaugaauuuuggaaaauucucagccauuaucuuuucaaauacaguuucuuccucauuuucucauuucccucacucuguccucuucuuuuuauaaaauuguuuuguauuuccuaacgcagucuauugauaguuauuuccuuaauuuuaucuuacauuaauucugugucuuuuuaaauuuuguuuauugauuuuguuuuuaguuacacugauuauuuuucauuuuuagaagcccuauuuaguuuuuucucaacugccuaguaauuuuauguauaguagcuuuauuuauaguauaaaguaucaucuuuaguucccuggcuauauuauuuucaagauucucuuucaugucuuaaacauauuuaacacaguuacauuuuacaucugaaaauuucaguaucugaaguauucgcauucugauuuugcuuguguuuccuaggucuugcuguugguaccuuguuucuuuuuuguuuuugacugauauucuuuguaauauuauuuggagaauuauuugaggcugguuuuaaguuacauuccuacaggaaggguggguguauuuacuucucuacuaguugccuaggagugcuuccagcugaaagcacuauaaauuaacuucuguguaccacacagauaucauuaguuuggaacacagacuugugugaggaccagcuuguaguuagaagaucuaaguuguuucucauuuuucauuuauccuuacacugaagcuggaguccuagcucuuugcaagggcucuaguugugcugucuaccuucaguaggccuuacacauuauauucuguuauaugcacccaacauagcuuguaaagcugaagcagaaacaggccaaaggccagcuuugucauucauuucguaaggguucuguuuuacuucauuuuuaguugcugaguguuacuuauuuauucugcuaaaauggugccuuuaaauaaaauaguuuccuaaaaauacauuacaugggccgggcgcgguggcucaugccuguaaucccagcacauuggaaggccgaggcgggcgaaucacuaggucaggagaucaagaccauccuggccaacauagugaaaccccgucucuaccaaaaauacaaaacuuagcugggugugguggcacgugccuguagucccagcuacucaggaggcugaggcaggagaauugcuugaacccaggaguuagagguugcagugagccaagguugcaccacugcacuccagcuuggcaauggagugggacuccauuuccaaaauauauauauauauauauauauauauauauauauauauauauauauauauauauauguuacaugguauuuuaguuguugucaucagaagcaucauucauuuuuuucugaaacagaagugggcuuguauacuuuauucuguaugucauugcugauccuugaauuuaauucugguaugucacuaagccagcaguuaauucaagaacagauguugauaccuauaguuaauucuggaugauagggagcucuuauuugugcauuuggcuuaucagcguaccuggagguugugauuuuuuauuuuaugacugcaguggcacuaaauuuuuauuauucccaucugccccacugccaccacuagugcaccuaauuuaauugaugguauaggaaaucauuuuuguuaauaaaaugauccaucauuacugauccuugcaagcaguuugcuuuaacaauggacuuaccuuccuuuccagccuaaucacacggaugcuacagagagaucccaagagaagggcuucuuuagaagagauugaaaaucauccuuggcuucagggaguggacccuucaccagcuacaaaguauaacauuccccuugugucauacaaaaaucucucggaagaggagcacaacagcaucauucagcgcauggugcuuggggacauagcggaucgagacgccauuguagaguacgucaaugcccgucaguacagagggccacagguuuaggauucuuggaaugggcucucucuacuuaacacagccuuuggacaccuguguaauagauaagaguucccaguuggcaagaguugugucauuuaucucuaaaguucuuggcccagggccugacacagguuuuuuuugguguuuugguuuuuaugcuagugaacaaguaagccauugcugggugguuucagugagugcuguggccuuuuccccauucuauagggguggaaugaaacagcuuguuuuguaucccaguauguaccuuaucuguggcacuauucucauuccucugucuccugccgguccccacagugauagggagaacaguaccaccugccuagaguccucuaagucaggaguugguaaaugcugcuggccacacauuuuuauaagugaaguuuuauugggccacagccaugcccauucauuuaaguauugucagugguugcacugugcuauaauggcagagugguugugggagagaccacuuggccuacaaagccugaaauauuuauuaucuggcccuugagagccccugcugcagccaccuggagccugcaaguuauacaaguuguuaauuacauccuuuaaaaccaaagccaguuguuuuuuuguuuuuguuuuuuuuuuuugagauggagucucgcucugucgcucaggcuggagugcaguggcacaaucuuggcucacugcaagcuccgccucccggguucacgccauucuccugccucagccucccaaguagcugggacuacaggugccugcaaccacgcccggcuaauuuuuucuauuuuuuaguagagacggaguuucacuguguuagccaggauggucucgaucuccugaccucgugauccgcccgccuuggccucccaaagugcugggauuacaggugugagccacugugcccagccccaaagccagauuuuaauaaacaguuuggaaucaaagauaauacagaggaaagaggcauuugcuuuuuucugauaaugauuaauuucuauaagagguccugacuguaaaaacaaggaauauuuccacaaauuaaaggucagaaguuauuuaauuuguugaaugaaacaguuggguauguucgaaagagaguaugcucuaggaggcaaaaaaggggcucccaucaggagggcccuuucaggauuugauccaguucccugacuucggggaagagaagccuguuggcuggaccugcagaccccugcugugugucuucgugccacacacaugcccacugggaggcucugaucccugagaagggcagugucuguauaaaggacacuuuagaguguuuuacauuacuggaaagaaagguuuauaaaaauaaacccagguucuuaauuuugguuuaagcacaauuuucuauaaguuuccaaauguauuaugguucuuuacaguauugacucacagcuacuuaaaugaccuaaacaugugguggagacgggacacuugcuguuucugcuacagacacugacuuuuggaauguguagaaaaugauuuuucacuuuugaguggguaaaaggcuguuuguaucucucugaauuggccuuacguucuuagcuuaaauaaauacauauauacauguaguagugucaucuagaacuacuuaauauaaauucaauuauaaauccaaaagguagugcaauuuaaaugguucaggugacuccaguuugccaguuuguugguuucccgauagcugggugagcgucuugcuguccucucagcuagccucacuccgugcuugcugcucacaucaugagaagcugcuuguucugagggugacuccugaguuccaacacacaccuuucucucacaauacauuuccaaacccaagccaacuccuguauuuaguacuuggcugaagaaacuaauaagucauucuacccuugaauuucaccuuggauacuuccuuuguaaucucaugccucagccugcccugcccccauuaguugugaccccaguguacauuuugaaaaauggugucucuugcuucuuuccuaaguguucauugugugaguauuuucaguaacuacagaaaguuucugaaaacguaguuacguauuuccuggccuuguggaauccgccaaagccaaagcacacuccuaguauguauguccugugacaggucagcuacaagagagugggcagggcugugggccuuggugggccuugugucccagcaccgugucuagccagacuagguacucggugaacauuacuuuuuaaacggaucaaugacuacauugauuuuauucaaagcaauugauggugacaugcuuucaauuucuuuaauaauucuguagugccuaaauugccaguaaaugcagagggaguaugaaaauaaaaacauuugcuaaguuuucugacugauauuaguacuucagugcacauucauguaacacagacuucgucuucauguacuucuaguggaagcaaguaaaccaccugaacaaauacaaacacuguacacacaaauucaaauuuugaauaaugcgugcacuuaucuuaugugucuaaaacugacgucuaacucagcugcuguuggcauuuuggauuuuucucucauuuacgaaaaaucuucauaaaaauaugaacauuuuuaugcaguuguuuuuagaacuuugagugaccuaaauaacuacuaguuugguuuuuuucugguuugcauuuuuugcauaauuuuaaagauuccagccauugaauuuaacuugcuuguacuuuuaaaaaucaauucugcuucuuguaaaaaaaccuccugauauggcugacguuugcucucaccuuguuuuccucagagcccuggaaaccaacagguauaaccauaucacagccacauacuuccugcuggcugaaaggauccugagagaaaagcaagagaaagaaauacagaccagaucugcaagcccgagcaauaucaaggcccaguuuaggugagaaaaaaaucuucacugauuuuaguaaguuuaacguuuugaaauagcgaacuuuuuuuuuuuuuuuuaaugcuuccuaacucuuuggggcaagagaguacaaacagugaugacggccucauuggagaggccacacacgggcucuucagguguacaugagggucuggguucccucgucaccagggaugccguccccuucugggcucaguggggaccggggcugugucuguuggcauggucaggaaaacauguuuggagaagcagccucaagccagagugucuugcuaguuauuuucauuaaauucuuccaaauccaacauguauuaaucuguuauuuucuuuaguuuuucauucuaggaacaaggcugaauuuucccucaguuauuugaaguaauuuuuaaaacuaaauagaguauugcuaugccacaguguucucucaggauuuccgggauuggauagucaacauuagcuaguugauuucuuagcugcuugaccuugggagguugcuuaaccucucuaugacuuagcuacccgaucuguaaaacaaaaguaacaaugcuauuuaccucaugggguuguggagaggaaugaugaauuaauauauguaaagcacuuagaaccagggcuuuguguguuugccaucacugcugggaauauuuuaccaccauugucuucaauaaagucaugaacgugcugcuccccaagccuuuucuaacccccucucuccuccuccuccucucccccagccuucccacuuugcuuuucugccagaguaacuuuccacuuaaaaucaaagcauggaaagggcuuacuuuuuucauuaucaucaugaaauuuauuucgaguuuaugcacucagauaaaguaacccauggaacuguaguucgaaaacagaagagugcugcugauucugaguaaaucuguguguaccuccaaguauuuaugaauauaugugugugaauauuauugugaauaauaauauuaugauuguaaaagauuaagaaagccauuucgauuuuaaguuacuugcaguuggcucgccaugugaacuuuguugcuuggguggaauggcagaguagggggaggaaaacauucccagcuugccaaacaguaaagauuuagaagucuaguuuaacuagaacaugaauuuaguaacuuuauucauaucuuggaugcauuccucuguaauaaaaacuaggcacacugucuagugucugcuuagaagaggacugaacccagggagugaggaaauucuuggggaugagauaaaccagagacugaugcucagagguuacggucaaccuaguccugaccugagcucccuggcaagaaagaguaaccccaaggcagaucaucacuacucgccaggugcaccgagacuggagcuaccaccaggcuucuggaagagaauauuuagauuugaacucucuucuauucagugaaacauaccagaacucagucuaaagcugauuguauaugugagaccaacauuagcuauaaagaaauaguaggccaggcacagugguucaacccuuugggaggccaaggugggaagauccuuugagcccaggaguucaugacuagccugggcaacauagacccugucucuauaaaaauuaaaaauaaaaaaaauuuaaaaauaccagagcuuucugaacuguuuuccuuuugcugucauggagacucugaaguggagaagcuaugagcaccuuuuuuucuauggcacagggcccacuggcaguggcagugucuccugacuugccuucucuuuguugucacuguaacguuaucgacaagacccuggaccucccuugguuccauugcuggguaugccuuguggucagaaugaccuaggagguagaaaccuggacugagucaggagacuguauuuaaaauggcaacuagcugggcagggauggaggaagaagggucaggccagugagaaccacagccacagagaacagauacaugcucuguggccaguggguagucuggaagaauuugugacaggccaguugagaugagugguuaacaggagacugauauccagucuccuagccgggcugggugucuucacaagcaguucgguaggcagaaagaaacagggauuuggccugcagguucuggaguccaggggcaggguccuagaccuggaauugagggagaacacagggacuccacuagagaaugaagucccagaugccaucucaagaauguagguauaagauguggcuuagcugaaaggagugguguugguacagauaggauccugcagcagugagguggugugguauugggaguugucaaaucaaguagcuuaagguuucuuaaauucuagaacagauucuguuucagauauaguagcacuaacuuuguuaaaaauaugaauaauuguagggcugccccaguacauucguauggaagaacaugaggucugagagaagggccuaggcauuuagaauuauuucuaauugagaacucuuaggacugacuguguccggggccugucugcagacuccggagacucuuccuccagccugcccuguagagccgaggacagcacuguuggaacucucuagggaggagccagauagcaggguaggcaucucauagacugcacccagauaguucuggaauggaaaaccaagaaguuaacccauaagcaggacguggccacacaguguuagucauuguucgguuaugaccacuucagagaauacugcuucuuagcuucaaauuuaaauuuuuuuuuaaugacagguuuauuuuauuaaaggggaaccugugcaaaacaaaagaaaacuugcacauagcaagucuaguagauauuccacauacaguggccacugguaaaauuuuguuccugcuuuauuauuauaacuauaugacuauaccccccuggggagagaggauaguugacaguucagagacguuuauucagaauagcagcuagagagccucauuuaaaaaauucaucuucuuuggguaccaagcaguauucuuguuacuuuggcaacuccagcuccagguugggagauaaaaugaaaguuuaaauaauggugaauuuuguuauucacuacucuuguaugggcauuuaaaaauauacuuauuuaaggcuggcacgguggugugcgccuauagucccagcuauucgagaggcugaagugggaggguugcuugauaucccagggggucaaggcuguagugagcugcauucaugcccuugcacuccagccugaauaacaaagagugagacccugucucaaaagccagauauuuauauuuaacuuaguuuuuuuuaauuggagaagagauuuuuauauguuuuuguaugauguauacguguuauaacuuuuuuaaaauucagauccauuaaacuguuuccauuucauuuuauaaacaccaaguucuuaccccaugguaaaaucaggagcccuggaaauuucaggugaauuuuauuuguaguaauauaccuuuaugugaucuaagaaccaaagaaacaagacgugguguucagguuuugcuuugccaauaaccuccaugggcuucuaaaaaauguuuaguauaaagcuuuuguauagaaaagauggaguagcucuuugcccuauuuucuuuucugacaccugugaugaaguuuucacuuggccaauaagccacaaacugaaccauguuucaaaaccacauuugcccuucugguggccuugcugauguuuacaggauguugaauggguuugcaaggcugcugcuuuuuucuuuaagucuguagauuuugucccaguaaguucauugugauguacuuuacuaucaucugcauaaugauuauauggcuuuuuuccccccaaucuaucuguuacauaggcagucauggccaaccaaaauugauguaccccaggaccuugaggaugaccucacggccacuccuuugucccacgcgacugucccucagucuccugcucgggcugcugacaguguccucaauggccacaggagcaaaggccugugugacucagcuaagaaagaugaccucccugaguuggcuggaccagcacucucuacggugccacccgcaagcuuaaaacccacagccagugggcggaagugucuguucaggguggaagaagaugaagaggaagaugaggaggacaagaaacccaugucccucucaacacaagugguuuugcgccggaagccaucuguaaccaaccgccugacauccaggaagagugcgcccguccucaaccagaucuuugaggaaggggaaucugacgaugaguuugacauggaugagaaucugccucccaaguugagcagguuaaagaugaauauagcuucuccagguacaguucacaaacgcuaccaccggaggaaaagucagggccggggcuccagcugcaguaguucggagaccagugaugaugauucugaaagccggcggcggcucgauaaagauagcggguucaccuacuccuggcaccgacgggauagcagcgaggggcccccuggcagugagggggauggcgggggccagagcaagccaagcaaugccaguggagggguggacaaggccagccccagugagaacaaugcuggugggggcagucccuccagcggcucggguggcaaccccaccaauacaucggguaccacacgccgcugugccggccccagcaacuccaugcagcuggccucucgcagugcuggggagcucguugagagccucaaacucaugagccucugccucggcucccagcuucaugggagcaccaaguacauuauugauccacagaauggcuugucauuuuccagugugaaaguccaagagaaaucuacguggaaaaugugcauuagcuccacagggaaugcagggcaggucccugcagugggcggcauaaaguuuuucucugaccacauggcagauaccaccacugaauuggaacggauaaagagcaagaaccugaaaaauaacgugcugcagcuaccucugugcgaaaagaccaucucugugaacauccagcggaacccuaaggaggggcugcugugcgcauccagcccagccagcuguugccaugucaucugacuguggccccaucuggccgcuagcacgcuuccugcucagagcagugaagaccggcucacuucacuguuccauuugguuuuacuauuuuaaagugggcguuaggagcaauuauuuauuaccuuuccauuuguucgccugaugaugugacaaugcauggucuuugugcaugcugcuagacacuuuucuuucccagccgaaaagccuauuauguaauuuuuacauucauaauuuuaauguggaugaucaggauuaaaucaagauauauaucuggaaccucuuauaaauggagcacuuagaaauuuguuguucugcacuuaaccuagagagagaaaaaaugcuuuucuuugugaaaaaucugaauuccuguccugaccuucugugauguggaaacccuaggcucugagacacacucucuggugucugagacagaaccaaagcaauaacguugugaugcccacaggccuggagccagcuagcgaccuugugccgcccagcuguccauggcccgugcagagcagaggacagugagugucugcacugagaaccuuaaaccacaguugaacauacccacaccuguuugucuuaagcuauaguguaaaaacaaaguuugggcucugaaaauuuaacugaaaaagauuuccuuguuuuuguaauaggugagauaaaguacuuagauuuauaaggcagcuuccccuguagugauaaauuacaagcagacaaucuuauuuuguaaugugaugaagugaugaugucuuaacucuacuuagagaguguaugucugucuaacagaacaaaaagaugcucuguguaaauuccuuccuguagggcacacugcaggauuuccauguagauagaagaacuauagggccuaguacagaaggugcacacaaauguuggcaaagucaaaaccccaugaauuaaaaccuacuggaauuugguuuuuaggaguuugguaauuagauuaucucuuuuguuauuuucauucaguuauauccuuuggcucagcuagcuuugaaauuggcugaugaaaaaauauacauaaaaggguaaaauucacacauacagcaaacaaaaaugcacaaagccugcuucguaacuuuuuuuucuggaauuguuuuucacuuugccuuuuucugccaaaacaauaaucaaagaacucuugcuuuaaccuauuccuguacaaagacuguuuuugaccagauaaucaucuguuguggcauucuaucuuguaggacacuguauauugcaaauugcugauuauggaaggggccaguugcuguuuuuucaugcagugcccugggagucuuaaaagcagugcuuagcaacauuggugauagcauguggcugggacccagggcccuuccccacucuucagccccgagucaugugucugaggugacggacugagacgcaucugguccuguaauucagagagugggcacaucaccaaagaacugcauugcuguggucacuguuucuucaaguacacacugacucugcuacuuuaggauaaauauauuuuacucagaacucugaauuucacaguauacuuacuaaacuaaguaaaaaugauacuuaaaauacuuauuuuacuuucuagaccuaggcuagauguuuuaagcuacagcucuaguucauugugauauuuauaauuugaaagcuaugagaauagaugugugggugaagccauagaacauauuugcuugaaauucuugagcagggaucuuauaaagggccagaaauaagaugugugguucacauagauagugagcguaacaucuguauuaaacauaggagagaaguuuauaaagggcauuggcaauaaacucuuuguugcagcuguuuuccaagcaguguaaauacuuuuuccugugauuauguauagccuuggaauggcaccuuuuaacuaacccauauguguuugguuucaaugguuuuuuauauucagauguauauauggugcucacuuuaggaucagcaguguugaccauuuaugcugcauagcuguauuauagccuuauuaguugugugguugacccuugggguauacaaaugucagucugaguggugucuuacuccuuuguuuauaagugaaugauugugcauguuuuguaugucauaguaugucgucacauaaaagggagggagcgaaaaaccauuacauuaagauaauauuggaccaaacuacuuacuugcucuaaacaguuacuuguaccccuuaaccugucuucaaaaguugcauauaguuacaguaguguauaaauuaaauauuguggaaaaacagucuuguauuuuucuguauguguguauauauauauaauuauguacuucuggcaauucuaucuguauuuaaagaugugacaaucuugacaccaauuuuaagaauagcugugagaccgaauuaaagauaaucccuaccaagugaaaauugauguguguuaagaggguacagaauuaucaacugauuuggucaguugcuuccaaugcugguugauuucccucauuguguaaacauugacagguaugugacaaaugggaaaaaaaauccaaauaauaaagugacauauugguguucagcaauaua

SEQ ID NO: 16183 - RNA, 16266 nt, Homo sapiens
gcggaagucgaggccucucucgcuuccggcucggccauuguuuuuggucuaacgggcaguagaguguccggcuucggugccgagugccaccgcgagugggccgagacgcggagggaggcgcggccggagcucgggucgccgacgcuggccaggaccgcgcuucuucccggcggcaggcggcgcgguccccgugacucucagaagccgcccgauguagagccgcuucuuugucucauaccccugaccauucgugcguggcacggagccggguaucugcggguacagcgaugaacagggcagacguggccaggugagcggcgcugcugaagccugguuuaacacgaaagguagaucgcuguuuucccagcucuugcaguaggaaacuguaugaacugucauauuugggucagacccaggcucagaaucgcaaacguggagcgugacuuggaaaugcaaaaauccaauugagauuuuaaagugcugagcauucggaacacuaugggaagcaggagaauggccugaacuuucuacauauaugggaucuuagagcagaguuuacagauuauuuuaaaguccuucuuugucuuuuuaaagagauugagacacagggaucugggcucuuggugaacuggaagcacagcacagaugcccuaguuaccaguaaggugcugauuuuaaaacguucaaaguuuuccuccacuucagugucagcuaaauguaucauauucauucauuucccaauuaugugugccaugugcacacguguacaaagaugacuggaagucagcucugcccuuuguauccucccagaaagcaggggagacagucguguaaaccacaaacgauuacagugugagaugugcucuacuagagguuugaaugaaaaagguaguuugggaucacugagacaauaaccaccucucuaagccuagcgugaucaggaaggcuuucuaggggaggugcauugaguaaaaaaaggucuaguauuuucugauuccauuugguuccuuuccuuugguggccgugcagcaguuuggagggugagaguggugaguugugcauaaaccaguuaaaggguuauagugagagguacacaaagggaagcuaccagcacucuuccugauggggcaaucaggaaaaccaagaaaaaguugccuuuguucauggucuugacagacaaguuugccaaaaguugaagaagaaaaauucaaagaaagaguauguguggcuucuaagugugucucuagagcuuuagcuccaaacuuucuuuauuuugcauuucuaucaguagaagagguuugaucacuuacucccuacauugguuuauuuguaauuuaaacaugaauacuacuauacaaauuguaaugcacauuauaaaacauacauuaaauaggaguuaaauaacuuaguauuuucucuugcacccuuugggauagccugcauuucccacauuggagaccauugcugucuuucuagcauggguacuuggggugagugguagaggguguggcugguugugaaggggguaaggccagguugugaagggcugugaaugcaaggcauagacauuuagauuuuauccuguagguaaugggagccacugaaacuuuaagaagggcaucauuuggagagaugcuuacuaagaaugccugguuguguucuuuuuuccuggagcuuuguuuuuuaacucaguggaggauugucaucagccuggggcugaauacuccaagaacucugauuucacucuuguuucuguaggccacacuaccaucaccccuuucuccaacccugaaaaacaguuccugagaccugaacuauugaccaucauuuuaaucggaccaacugcagcuguaacaagcuucucuuuggggucacaaugaccacugcaggcaggggaaauuuaggccucauccccaggagcacugcuuuccagaagcaagaggggcgccugacugugaagcaggagccagcaaaccagaccugggggcagggcagcagucuccagaagaacuauccuccugucugcgaaaucuuccggcuacacuucaggcaauuguguuaccacgagaugucugggccgcaggaagcauugagccggcuucgggagcucugccgcugguggcucaugccagaggugcacaccaaggagcagauccuggagcugcuggugcuugagcaguuccugagcauccucccuggggagcuccggaccugggugcagcugcaucacccugagaguggugaggaggcuguggcugugguggaggauuuccagagacaccucaguggaucagaggaggugagcaguugagucuagaauggcggccugaugcuucucuaaugcuuggguuagccuaggaauaggcauucuccacuucccaggcccuaggccaguuugccuuuaggguugcugaacuuguccuguggauagagggaaaauaguuuugugcuccaagccauaaacacaagugcacaucccagcuaagcucugugauucacccugugaaauacuguguucugagccuagcuucauccuggagauucgcaugguacuccuggcaggcgggggaucugcaugcugguuagaauagggcgaucgggggaaggcgggccuuuggguaugcugauaauacgagccuucauuugagacauucucuuugcucacuuccuuggacuucucagagucaauuuucucuuuuucugccucuuugauucccugaaaggugacauuuuugggccuuguaauuauuuguuccuuuugcuagcucuccaaaccuaacugggaucuuuuugcaucuuuaauucuaauuuaaguuuucccuauuuccuggaguucuugcaaauguaauaccaagguaauuuaaacuagaggaauaguugggaagagugagcaguaagacacauuggaaaaucugguuucuaggaccauagagccaacuagcucugugcccauguguuucagucaggguuuagccagagagguagaaucaguaggagagaggggugugugugugugugugugugugggcaugggcacacaugcaugugcauguguaaagagauuuauugguggcugggcaugguagcucaugccuguaaucccagcacuuugggaggccgaaggggguggaucacuugaggucaggaguuugagaccagccuggccaacauggcaaagccccauugcuacuaaaaauacaaaaauuugcuagguaggguggcauauaccuguaaucuuagcuacuggggaggcugaggcaaaagaaucacuugaacccaggaggcagagguugcaguaagccaagaucacgccacugcacuccagccugggugacagagcgagacuucaucucaaaaaaaaaaaaaaagaaaagaaagagagauuuauugcuaguaaguggcuuacguaauugugaggcugacuaggcaagucugaaacccauaggcaggccaucgacaagggcagcccaaaacaguggcacaagcugaagcugcagugcacagguggaauuucuucuuucuucuuuguccuuucuucuuuuuccuccuccuccuccuuuuauucucuuucuucuucuuucuuccucgucugcuuucuccuuucuucuucauuuuuuuuuuuuuuuuuuuuugggucuugcucuguugccuaggccagaaugcaguggcaugaacauggcucacugcaagcucagccuccuggcucaagugauccucccaccuuagccuccugaguagcugguaccacagucaugugccaccacaccaggcuaauuuuuuuuauuguagacauguggucuuguuauguugcccaggcuuguucuugaauuccuggcuucagaugauauucuugccuuggccucccaaagcacugcgauuacaggcaugagcuaccacgccuggccuggaauuucuucuucauggaacuuuuagcuuugcuuuuaagggcuuacaacugauugaaucaggcucaugcauucauccguuaucuaguauaaucucccuuacuuaaacuuauuauguacuuuaaucacauuuuuaaaauaguuuacagcaacaccuggauugauguuugauuaguaccaaguugacacaucaaaagaucaucacaccauggauaaguuaguucuuccuaaugaguuucaaauuguuccccuauaauagaagcagggugaacuagagguccccucuaccccuuuguacuuuaucaggggaaaacaguauagagaauuucccaaguacccaauauaucauuuuauucaaugcuuuuuuuccuagagagucucacccuaucacccaggcuggagugugguggcacaaucuugguucacugcaaccucugccuccugggcucaagugauccucccaccucagcuucccuaguagcugggaccauaggugugagccaccacaccuggcuaauuuuuguguuuuuaguagagacgggguuucaccauguuguccaggguggucuugaacuccugagcucaagaaagccaccugccucauccucccaaagugcuggaauuacaggugugagccaucacgcucagccuauucaaugcuuuuuaaaaaaugauuacauaucacuagggaaucaguucuaguugaucaggauccuggggcuagacauuuuuccaggauuauuagcaguacacauuugucauuaucaaccaucauuuucuuuguguaaacaaguaagcacauaugaguaaaucaaccaucacaagggucuagagagcagcugggccagccauggcaaugacagguggcugaagacauauuuagagaaccauuuagugaggguggcagaaggaaaaugucccuauuuccugcuugguuuugcuuaagaaguuaaugcuuccuccauuaaaacuuuuagugcuuuauccagcuagcagccucagaaaagggugacuguugagucacaacccaagaaaaugacuaacaguagacagugaggcagcugaaugcucauggcuccagcuuggguguagggucuuuggaguccauuucuuaaucucccacuacugucaguguuauguuuucugacacgaagacauaagggcaggacuaucuuucaucagcaggcguucagaaaauguuuacagaauggcuaaaugaauaaacaagcuuuuccauggaaguuugccaagaggagauuaaggaggguccagguaaauuggagucauuuugcuuaucaggagcaagccacuuuauugcugcagaaggagcauguacaugugugcacauuguggcugggaaagguuuguauagugaucccugcugggcugcagagucaugcaacuugcagaauucuuuuguuuccuguaucuuuuuuuuuuuuuuuuuuuuuuuugagacaaagucucacucuguugcccaggcuggagugcagugacacaaucucagcucacugcaagcuccgccuccuucacgccauucuccugccucagccuccugaguagcugggacuacaggugccugccaccacgcccagcuaauuuuuuguauuuuuaguagagacaggguuucaccauguuagccagaaugguuucgaucuccugaccucaugauccucccgccucguucucccaaagugcugggauuacaggcaugagccaccacgccuggccuguuuccuguaucuuuuuucaucuccugccaggguuacaaaacaggcagugcaguaaucauuaucuccauuugacaagugaagugagcacauguaguaagcauucccuugcccgaaagauuuagcugaggugugguuguuucugauuaccaucaagugggaggaccaggauuuuccaucucccuaguuucuaagccaacagcuuuucucuagggucuugcuguggaaugccauauuagaaugagguuuucaugucuucaaggaagggaaaccugugauucuguauuagucuguuuucacacugcuauaaagaacuaccuggguaauuaaaaagaaaagagguuuaauuggcccacaguuucacaggcuuaacaggaagcaugacugggaggucucaggaaaccuacaaucauggcagaaggcaaagaggaaggaaggaccuucuucacauuguggcagaagagaaugcagggggaagugacacauacuuuuaaaugaucagaucucaugagaacccacaagaacaccaaggggagaucuaccccaugauccagucaucucccaccaggccccuccuccaauucguugugagauuugggugggaacacaaaucuaaaccacuauuauucugcccuggccccucccaaaucucauguucuuuucacauugcaaaauacaauuaucccuucucaacagucccccagacuuaacucauuucagcauuaacucaaaaguucacaguccaaagucucaucugagacaggguaagucccuuccaccuaugagccuguaaaauaaaaaacuaguuaguuacuuccaagauacaauggggauauaggcauuggguaaaugcucccauuccaaaugggagaaauuggccaaaacaaagggguuacaugucccaugcaaguccaaaaccaagcagggcagucauuaagucauaaagcuccaaaauaaucuccuuugacuccaugucucacauccagggcaugcugaugcaagagaucaguucccaaggccuugggcauccuggccccuguggcucugcagguuauagcccccauggcugcagucaccaacugacauugagugccugugccuuuuccaggcacauggugcaagcugcuuguggauuuaccauucuggggucuggaggaugguggcccucuucucacagcuccacuagggaaugccucagcaagacugugugggggcuccaaccuugcauuuccccuucacacugccuuaguagagguuuuuccaugacaguuuugccccugcagcagacuucugccuggacauccagguguuuccauaccuccucugaaaucuaggaggagauucccaaaccucaacucuugccuucugcacaccugcaggcccaacaacaugugaaagcugccagcuuggggcuugcacccucugaggacacagccugagcuauaccuuggccucuuuuagccacagcuggagcuggaguggcugggacacaggggaccauguccugaggcugcacagagcagcuaggcccugggccuagcccaugaaaccauuguuuucuccuaggccuccaggccugugaugagagggggcugcugugaaugucucuaaaaugcccuggagacguuuuccccauuguguuggcuauuaaaauuuggcuccucuuuacuuauucaaauuucugcagcaggcuugaauuucuccccagaaaacggguuuuucuuuucuaccacauggccgggcuacaaauuuuccaaauuuuuaugcucugcuucccuuuuaaauauaaguuccaguuucagaucucuuuguucacaaauaugaguggacacuuuuagaaacagccaggucacuucuugaaugcuuugcugcuuagaaauuucuucugcuagagggcugggcgugguggcucacgccuguaaucccagcacuuugggaggcugaggcagguggaucacgaggucaggagaucgagaccacggugaaaccccaucucuacuaaaaauacaaaaaauuagcugggcauggcggcgggugccuguagucccagcuacucgggaggcugaggcaggagaauggcaugaaccugggaggcggagcuugcagugagccaagaucgcgccacugcacuccagccugggugacagaaugagacuccaucucaaaaaacaaaaaaaaaaaaaggaaauuucuucuacuagauacccugaaucauuucucucaaguucaaaguuccacagauaucuagagcaggggcaaaaugcugcuggucucuuugcuaaagcauagcaagaaugaccuuugcuccaguucccaauauguuuuucaucuccaucugagaccaccucagccuggauuucauuauccauaucacuaucagcauuuuagucaaaaccauucaacaagugucuaggaaguuccaaacuuucccacaucuuccugucuucuuuucagcccuccaaacuguuucagccucuaccuguuacccaguuccaaaguugcuuccacauuuucaaguaucuuuauagcagugccccacuuuccugguaccaauuuucuauguuaguccuuuuucacacugcuguaaagaacuaccugagauuagguaauuuaugaagaaaagagguucagucgacucacaguucugcaggcuuaacagaaagcaugacugggaggccucaggaaacuuaaaaucauaguggaaguugaagaggaagcaaggauccucuucacauuguggcaggaaagagagagcacacagaggaaagugccacacacuuuuaaacaaucagauuucaugagaacucacuauuacaagaacagcaagggggaaaucuucccccccuacccccaccccccgugauccagucacuucccacugggccccuccuccaauucaacaugagauuugggcggggacagaaauccaaaccauaucaaaguccuagauaaugaacaggaacuuuaccaggauuaaauuauuaguggauuacaaaguugaauuaucacagugcaguaaguucuaccuucugccaauacccagagcuccuguauugaagagcugugacuuccauuuuagagagucuuucaguuucaaagaaccuuucaguaggagagcuugggaacuacagaauccagggagccugcugguccuaccacuacacuggugagauauauauuaaaggagagagucccuuaacaucucagcagaugcagccuaauagggugaauccugugugguuuauugaaggagaaguuauuuuuaccucaugcugugcuauguacauaccagagcaagugaacuuuaaaaugugccuuauuuagauaauauuuuagguuuucugcccuacaugcugguaaaaggagcaaccaugagauugugaggagcugguuugaugacaauaagcaaggguuagaaauaaaaugucuauguucugagguauucucaagaucucuacagauuagugugucugaucuuauuuggcuuuuaaaauauaaauuauuggggagaaguaguacauauugaaaacugaguuugcagauaaccuuaaagucuuuuagcaaaauaucaacaggaagucagucagcagauauuaauugaacaccauuguagggcuauauguuguuuuggagcuagugaucaagacaaaaguucuuacccucaaaaaacucacacucuguuggggaaacauagacaauaaagacauaaguaagauuacuuaaagauuaauacaugcaaucuagaaauuauaauugguuaauugagucugacuaucccugcuuugucagugugcucagagaaagcuucucugaagaggagauacuuuugcucagagaaauuggaaaagcucuccugguaugccagccacuguucuggguauugcuucagcuguuagugucaguagcauuauuugugcacauccacaaaucuuaucuuuuuuuacacuuaucuuuuuuuaccuccuuuguacuucuuuuuuuguuuguuugguuuuuguuuuuguuuuuuuuugagacggagucucgcucugucacccaggcuagagugcagaggcgugaucucggcucccugcaaacuccaccucccaggaucaagugauucuccugccucagccucccaaguagcugggacuacagcugcgugccaccaugccuggcuaauuuuuuuguacuuuuaguagagacaggauuucgccauguuggcuaggcuggucucgaacuccugaccucaggugauccaaccaccucggccuccaaaagugcugggauuacagaugugagccacugcgccuggccuauccuuuguacuucugauuauuccuuucugucagcuaaggcccuagagaauguacugaauugcucuccuggcucccuuuuuaaaugguucuucauaagaaaauaugugucugaagaccugacacagaguggaaaugguuauagaaucugguccucaagccccuaccaaaagggucaacagagggauggcaaguagaauugcaagcuuuagauucugcuuucacaguuuuuuuuuucccccaguagacuguagugguggggcuggaaggacacccuggcucuucuuuucccuggcuuucuuucuggagggagcugcuuagagguuuuggguucaguaccuucaaggaugcucuuuugaacccaauuguauuucccucucucuagguuucagccccagcacagaaacaggaaaugcauuuugaggagacaacagcucuggguacaacaaaggaaucuccuccuaccucaccccucagugggggcucagccccuggagcccaccuggagccuccuuaugacccagggacacaccaccuccccaguggggacuucgguacuuaucuccccagcuuuggccuuaagucaugccucccuucucuccucuggagucuccuuuccuuuaucugcccaucuccuacuccauggaaucccucauugcucugcugucuguccuucuucccuagugacccuguuuguuccuuuugcuuauucucuaaucauucguguaguuaguaaguuuucaucaagggcaugucguaggaaaggcacugccagagaccagagagauguaguacaucuauugucacugauuucaaagagcuuguuaucuagaugguaggaugaguuagucauguguaagaagaggcaaccucauaagaugcacaugaaugauaucuauccucaagcauuugauccugucacaaaugagcaaugugggcauuggaaaaagugaucacuggguaaaaagcaagaucauugugggcuggaacugguaagggaugcuucaugaaggagguagcagaguauugggcaguaaaaauguggaagaauuuugaaggggagaaaaaaguagcaggcaugccauuagaagacacaacaaagacccuaagcuggagauuccuugagcccugauugagguggagucaggaaagacuguauuugggaaccugggccuuguuuguacaggaccuugagauugaggcaggaagauuuugggagucagaggauaauguguuagaaauaguauuucaggaggauuacucuggcacaggugagcauuauggauugaaggggaaggcgccuuaguuaaaggcuggugcgguagaauagaugugauuaaugccugaagugcaaagagaggaacgggcaaggauaaaauugaaaaauauuaucauggaaacauccgugggacuugaguuugaaaggggaggcaggggaauuagaauguuuuggccaaugauggaaucauugagggaaauugagaaaucugaaagaaaggugauaagaacauuuuauuuauuuauuuaauguuauuuauuuauuuuuuuuaaagagagauagggucucacucugucacccaggcuggagugcaauggcacgaucauaauagcucacuguagccuugaacuccugggcucaagaaauccucccaccauggccucuuagaacuacaggcaugccaccaugaccagcucuuuuuuuuuuuuuaacuuuuuauagaaauggggucuccuacugggagcaguggcacacacaccuguaaucccagcacuuugggaggcuaaggcagguggaucacuugaggucaggaguuugagaccagccuggccaacaugaugaaucccuuccuacuaaaauacaaaaauuagccaggcauaguggcagguacuuguaaucccagcuacuccagaggcugaggcaugagaauugcuugagccugggaggcagagguuucagugaggcaugaucaugccacugcacugcagcagagugagacucugucucaaaacaaaaagagagagagagagagaaagagaaagaaaggaaagaaagaaagaaaaagagaagagaaaagaaaagagagaaaagaaagagagggagggagggagcaaaagaaaagaaaggaaaggaaaagaggaggggaagggaagggaagagugaaggaagggaaggaaggaaagggagaaaaagacaaccuuauguuguacaugcuggucuugaauuccuagccucaagccagccucccaccuuagccuagaacauccauccauucuagacacugaacuuaaaguguugcaggacacccaagugaaaugucccauaggcaauaggaggcaugugguaggggucuaggagagaaguaagaacugugagagcaguauuaaagcaaugagaguuggucagauugcugacggaaagaacaaggaagcacuagggccugaguugcaaggaguguccauaaugagagggcaggagcaggcaugaggaaccacaacugugaggggaaaaucagggcuggcuggugcuagggaaaccaugggagagagaguggccagaauagcuucccugaaaaaaguugaagagagugagggcuuggaggaacacccaguucucagcuugauccgggaccuuguacuguacccuccagggaaaauucacaccacucuugggauaaugccuuauggaagagguuaagagucaguguguguggaggugccuggguucucuugaauccacuuauugggaauauagaucuuaugggagccagaagcagggcuugucccacucauagcuuucuuuccucccucagcucaauguacuucuccaguuccuacccuuccucaaguggggaacucaggagaccaagcaggggcaacuguacuucggauggucaggccccaggugagcuugguucuuuguguuuuuaccaaguccccaugagucugguccaagaauggcuagaggucucacccccaggacucugccccaucuaagacuauuccuguggcucuccugccucauuacuuccccuggagguaauggacucuaucuugcccuggacuuguccuuuucgaggugucaucucagcuccucucucccauacuuuugcccaugaagagcccauacccugugcccuucguaccccugaugacucugcccuucaggcugugaauguuccugagcgauuggagcuugucauuccaggauacuguggcauaugaggaccuaucuguagacuacacucagaagaaauggaaaagucucacacucagucagagagcccugcaguggaacaugaugccagaaaaucaccauagcauggccuccuuggguaaugauucuguuuccuagucacuuaaagucugcaugcugcacaaucucuuuucuauauuccuugucucuuuaaacuuuuuaccaugaaaauuuccaaacauaguuaaacuagagugaauaauauagggacccuuucugcauucaucacugagauucaacagugaucagcauacucuucaccucauuaugaauugauauagugugguuuagguagggcuucuuaguuguaaggaacagagagccacucaaguuauuguaaguaaggagcugugagucauaggcuuaaaggaaugagaaccuggaagaaacugaugagcuagaccagacugugggaagcagggccuugacccugggagccugagcugcaaaagcaaaugcauguugaugccuguguuccagugugaauguaaugcagcugcucgcaguguaucuguuuucucucugcuuguccuccuccucuugcccauuuucuucacugugaaucuuuuguccuuuucauagcucuuuuaauuuuacuuucuguucuuuuacacuuguugcuugcuguguuuccuaauggcuuggcuucucuccaugcgccacuucagcuuccauugcuacucguaagugccuuaauuuugcccuaccuccaguuccaaauuuccucagagauggacuuucauugcuauagccauuacgcaucaucucauuugggcacagggguuuggcccaggccacagcagaggcugaagccuaaccuacaaauagacccuucagucuaguaccuggugccaguccaaucaccuguggcccaucgugggaugcucagggucacuuggcaccaagcaugguugccuaagcaucccucucugcaaacacuggggcagaacaguuuccugaaagggcuucuuggaagggcagauccugugguugacgaguuuagggcagucuuuuuacuguccuaucauguaagaucuguucuuuuuguacacuuuccuuaucauaccuccauaauauaaauuuccagucaauucacucucauuuuuuucccugucucuuucuuauguuuggcuugagguauuugccagccuccucucucccaacauguuuucugagaacaauggaaccaugcaauguuaugguuggaagggaucuuagaguucaucacuuuacuaaggagacauagcacgagaguaacuucuguaagaucacagcaugcuuugcaauccacuuuuuugcuuuccaguggcccuucugacuugguugugcuggcuuaguaucuuuuuuccaccuguuuucacugaccaccuuccccuuccuuguuuuccugucccuagggaaaaaaaauugagcuauuaauauuucccauuuugcucuuguucucaaugugucaucucauuucuuaaccauaaugugacuuuuuuucagguauguuagcucuuaaugauucucuuucuuaaacaggauaagaaauggguaaaaguuguugucuucuuucuuugggcagcaggugagaacaugaugaaggguucagaguugacuccaaagcaggaauuuuuuaaaggaucagagucaucuaacaggacaucagggggacucuuuggggugguuccuggggcagcagagacuggagauguuugugaagauacuuucaaggaguuagaaggacaaaccucagaugaagaagggagcagacuagaaaaugauuucuuggaaauaacagaugaagauaagaaaaaauccacaaaagacagauaugacaaauauaaggaaguuggggaacauccaccucugucuuccaguccuguugaacaugaaggaguuuuaaagggacagaaauccuaucgaugugaugaauguggcaaagcuuucaaucggaguucucaccuuauuggccaucagagaauccacacuggagagaaacccuaugaguguaaugagugugggaagaccuucaggcaaaccucccagcucauuguucaucucagaacccacacaggggaaaaacccuaugaaugcagugaguguggaaaggccuauaggcacagcucccaucucauucaacaccagagacuccauaauggggagaaacccuauaaauguaaugaaugugcaaaagccuuuacucagaguucccgacucacugaccaccagagaacccauacuggggagaaaccuuaugaaugcaaugaguguggagaggcauucauucgaagcaaaagucuugcucgacaucagguccugcacacugguaagaaaccuuacaaaugcaaugagugugggagagcauucuguuccaauagaaaucucauugaccaucagagaauccacacuggggagaagccuuaugaguguagugaauguggcaaagccuucagucggaguaaaugucuuauucgacaucagagccuccauacuggggaaaagccauacaaauguagugaaugugggaaagccuucaaucagaacucucaacucauugagcaugagcgaauucauacuggagaaaaaccuuuugaauguagcgagugugguaaggcauuuggucugaguaaaugucuuauucggcaccagagacuucacacgggugaaaagcccuauaaaugcaaugaguguggaaaauccuucaaucaaaacucacaccuuauuauacaccagagaauucacacuggugagaaacccuaugaauguaaugagugugggaagguauucaguuauagcuccagccuuaugguacaucagagaacccauacuggggaaaaacccuauaaaugcaaugauugugggaaagcuuuuagugacagcucacagcuuauuguacaccagagaguccacaccggagagaaaccuuaugaauguagugaaugugggaaagccuuuagucagcguuccacuuuuaaucaccaccagcgaacucacacuggagagaaguccucaggucuggcuuggucaguuucuuaagguaugguucucugagacagagagcaacgaccuuugaguuaagcugucuuuauaagcaggau

SEQ ID NO: 16184 - RNA, 16266 nt, Homo sapiens
auccugcuuauaaagacagcuuaacucaaaggucguugcucucugucucagagaaccauaccuuaagaaacugaccaagccagaccugaggacuucucuccagugugaguucgcugguggugauuaaaaguggaacgcugacuaaaggcuuucccacauucacuacauucauaagguuucucuccgguguggacucucugguguacaauaagcugugagcugucacuaaaagcuuucccacaaucauugcauuuauaggguuuuuccccaguauggguucucugauguaccauaaggcuggagcuauaacugaauaccuucccacacucauuacauucauaggguuucucaccagugugaauucucugguguauaauaaggugugaguuuugauugaaggauuuuccacacucauugcauuuauagggcuuuucacccgugugaagucucuggugccgaauaagacauuuacucagaccaaaugccuuaccacacucgcuacauucaaaagguuuuucuccaguaugaauucgcucaugcucaaugaguugagaguucugauugaaggcuuucccacauucacuacauuuguauggcuuuuccccaguauggaggcucugaugucgaauaagacauuuacuccgacugaaggcuuugccacauucacuacacucauaaggcuucuccccaguguggauucucugauggucaaugagauuucuauuggaacagaaugcucucccacacucauugcauuuguaagguuucuuaccagugugcaggaccugaugucgagcaagacuuuugcuucgaaugaaugccucuccacacucauugcauucauaagguuucuccccaguauggguucucugguggucagugagucgggaacucugaguaaaggcuuuugcacauucauuacauuuauaggguuucuccccauuauggagucucugguguugaaugagaugggagcugugccuauaggccuuuccacacucacugcauucauaggguuuuuccccuguguggguucugagaugaacaaugagcugggagguuugccugaaggucuucccacacucauuacacucauaggguuucucuccaguguggauucucugauggccaauaaggugagaacuccgauugaaagcuuugccacauucaucacaucgauaggauuucugucccuuuaaaacuccuucauguucaacaggacuggaagacagagguggauguuccccaacuuccuuauauuugucauaucugucuuuuguggauuuuuucuuaucuucaucuguuauuuccaagaaaucauuuucuagucugcucccuucuucaucugagguuuguccuucuaacuccuugaaaguaucuucacaaacaucuccagucucugcugccccaggaaccaccccaaagagucccccugauguccuguuagaugacucugauccuuuaaaaaauuccugcuuuggagucaacucugaacccuucaucauguucucaccugcugcccaaagaaagaagacaacaacuuuuacccauuucuuauccuguuuaagaaagagaaucauuaagagcuaacauaccugaaaaaaagucacauuaugguuaagaaaugagaugacacauugagaacaagagcaaaaugggaaauauuaauagcucaauuuuuuuucccuagggacaggaaaacaaggaaggggaagguggucagugaaaacagguggaaaaaagauacuaagccagcacaaccaagucagaagggccacuggaaagcaaaaaaguggauugcaaagcaugcugugaucuuacagaaguuacucucgugcuaugucuccuuaguaaagugaugaacucuaagaucccuuccaaccauaacauugcaugguuccauuguucucagaaaacauguugggagagaggaggcuggcaaauaccucaagccaaacauaagaaagagacagggaaaaaaaugagagugaauugacuggaaauuuauauuauggagguaugauaaggaaaguguacaaaaagaacagaucuuacaugauaggacaguaaaaagacugcccuaaacucgucaaccacaggaucugcccuuccaagaagcccuuucaggaaacuguucugccccaguguuugcagagagggaugcuuaggcaaccaugcuuggugccaagugacccugagcaucccacgaugggccacaggugauuggacuggcaccagguacuagacugaagggucuauuuguagguuaggcuucagccucugcuguggccugggccaaaccccugugcccaaaugagaugaugcguaauggcuauagcaaugaaaguccaucucugaggaaauuuggaacuggagguagggcaaaauuaaggcacuuacgaguagcaauggaagcugaaguggcgcauggagagaagccaagccauuaggaaacacagcaagcaacaaguguaaaagaacagaaaguaaaauuaaaagagcuaugaaaaggacaaaagauucacagugaagaaaaugggcaagaggaggaggacaagcagagagaaaacagauacacugcgagcagcugcauuacauucacacuggaacacaggcaucaacaugcauuugcuuuugcagcucaggcucccagggucaaggcccugcuucccacagucuggucuagcucaucaguuucuuccagguucucauuccuuuaagccuaugacucacagcuccuuacuuacaauaacuugaguggcucucuguuccuuacaacuaagaagcccuaccuaaaccacacuauaucaauucauaaugaggugaagaguaugcugaucacuguugaaucucagugaugaaugcagaaagggucccuauauuauucacucuaguuuaacuauguuuggaaauuuucaugguaaaaaguuuaaagagacaaggaauauagaaaagagauugugcagcaugcagacuuuaagugacuaggaaacagaaucauuacccaaggaggccaugcuauggugauuuucuggcaucauguuccacugcagggcucucugacugagugugagacuuuuccauuucuucugaguguagucuacagauagguccucauaugccacaguauccuggaaugacaagcuccaaucgcucaggaacauucacagccugaagggcagagucaucagggguacgaagggcacaggguaugggcucuucaugggcaaaaguaugggagagaggagcugagaugacaccucgaaaaggacaaguccagggcaagauagaguccauuaccuccaggggaaguaaugaggcaggagagccacaggaauagucuuagauggggcagaguccugggggugagaccucuagccauucuuggaccagacucauggggacuugguaaaaacacaaagaaccaagcucaccuggggccugaccauccgaaguacaguugccccugcuuggucuccugaguuccccacuugaggaaggguaggaacuggagaaguacauugagcugagggaggaaagaaagcuaugagugggacaagcccugcuucuggcucccauaagaucuauauucccaauaaguggauucaagagaacccaggcaccuccacacacacugacucuuaaccucuuccauaaggcauuaucccaagaguggugugaauuuucccuggaggguacaguacaaggucccggaucaagcugagaacuggguguuccuccaagcccucacucucuucaacuuuuuucagggaagcuauucuggccacucucucucccaugguuucccuagcaccagccagcccugauuuuccccucacaguugugguuccucaugccugcuccugcccucucauuauggacacuccuugcaacucaggcccuagugcuuccuuguucuuuccgucagcaaucugaccaacucucauugcuuuaauacugcucucacaguucuuacuucucuccuagaccccuaccacaugccuccuauugccuaugggacauuucacuuggguguccugcaacacuuuaaguucagugucuagaauggauggauguucuaggcuaaggugggaggcuggcuugaggcuaggaauucaagaccagcauguacaacauaagguugucuuuuucucccuuuccuuccuucccuuccuucacucuucccuucccuuccccuccucuuuuccuuuccuuucuuuucuuuugcucccucccucccucucuuucuuuucucucuuuucuuuucucuucucuuuuucuuucuuucuuuccuuucuuucucuuucucucucucucucucuuuuuguuuugagacagagucucacucugcugcagugcaguggcaugaucaugccucacugaaaccucugccucccaggcucaagcaauucucaugccucagccucuggaguagcugggauuacaaguaccugccacuaugccuggcuaauuuuuguauuuuaguaggaagggauucaucauguuggccaggcuggucucaaacuccugaccucaagugauccaccugccuuagccucccaaagugcugggauuacaggugugugugccacugcucccaguaggagaccccauuucuauaaaaaguuaaaaaaaaaaaaagagcuggucaugguggcaugccuguaguucuaagaggccauggugggaggauuucuugagcccaggaguucaaggcuacagugagcuauuaugaucgugccauugcacuccagccugggugacagagugagacccuaucucucuuuaaaaaaaauaaauaaauaacauuaaauaaauaaauaaaauguucuuaucaccuuucuuucagauuucucaauuucccucaaugauuccaucauuggccaaaacauucuaauuccccugccuccccuuucaaacucaagucccacggauguuuccaugauaauauuuuucaauuuuauccuugcccguuccucucuuugcacuucaggcauuaaucacaucuauucuaccgcaccagccuuuaacuaaggcgccuuccccuucaauccauaaugcucaccugugccagaguaauccuccugaaauacuauuucuaacacauuauccucugacucccaaaaucuuccugccucaaucucaagguccuguacaaacaaggcccagguucccaaauacagucuuuccugacuccaccucaaucagggcucaaggaaucuccagcuuagggucuuuguugugucuucuaauggcaugccugcuacuuuuuucuccccuucaaaauucuuccacauuuuuacugcccaauacucugcuaccuccuucaugaagcaucccuuaccaguuccagcccacaaugaucuugcuuuuuacccagugaucacuuuuuccaaugcccacauugcucauuugugacaggaucaaaugcuugaggauagauaucauucaugugcaucuuaugagguugccucuucuuacacaugacuaacucauccuaccaucuagauaacaagcucuuugaaaucagugacaauagauguacuacaucucucuggucucuggcagugccuuuccuacgacaugcccuugaugaaaacuuacuaacuacacgaaugauuagagaauaagcaaaaggaacaaacagggucacuagggaagaaggacagacagcagagcaaugagggauuccauggaguaggagaugggcagauaaaggaaaggagacuccagaggagagaagggaggcaugacuuaaggccaaagcuggggagauaaguaccgaaguccccacuggggagguggugugucccugggucauaaggaggcuccaggugggcuccaggggcugagcccccacugaggggugagguaggaggagauuccuuuguuguacccagagcuguugucuccucaaaaugcauuuccuguuucugugcuggggcugaaaccuagagagagggaaauacaauuggguucaaaagagcauccuugaagguacugaacccaaaaccucuaagcagcucccuccagaaagaaagccagggaaaagaagagccaggguguccuuccagccccaccacuacagucuacugggggaaaaaaaaaacugugaaagcagaaucuaaagcuugcaauucuacuugccaucccucuguugacccuuuugguaggggcuugaggaccagauucuauaaccauuuccacucugugucaggucuucagacacauauuuucuuaugaagaaccauuuaaaaagggagccaggagagcaauucaguacauucucuagggccuuagcugacagaaaggaauaaucagaaguacaaaggauaggccaggcgcaguggcucacaucuguaaucccagcacuuuuggaggccgaggugguuggaucaccugaggucaggaguucgagaccagccuagccaacauggcgaaauccugucucuacuaaaaguacaaaaaaauuagccaggcaugguggcacgcagcuguagucccagcuacuugggaggcugaggcaggagaaucacuugauccugggagguggaguuugcagggagccgagaucacgccucugcacucuagccugggugacagagcgagacuccgucucaaaaaaaaacaaaaacaaaaaccaaacaaacaaaaaaagaaguacaaaggagguaaaaaaagauaaguguaaaaaaagauaagauuuguggaugugcacaaauaaugcuacugacacuaacagcugaagcaauacccagaacaguggcuggcauaccaggagagcuuuuccaauuucucugagcaaaaguaucuccucuucagagaagcuuucucugagcacacugacaaagcagggauagucagacucaauuaaccaauuauaauuucuagauugcauguauuaaucuuuaaguaaucuuacuuaugucuuuauugucuauguuuccccaacagagugugaguuuuuugaggguaagaacuuuugucuugaucacuagcuccaaaacaacauauagcccuacaaugguguucaauuaauaucugcugacugacuuccuguugauauuuugcuaaaagacuuuaagguuaucugcaaacucaguuuucaauauguacuacuucuccccaauaauuuauauuuuaaaagccaaauaagaucagacacacuaaucuguagagaucuugagaauaccucagaacauagacauuuuauuucuaacccuugcuuauugucaucaaaccagcuccucacaaucucaugguugcuccuuuuaccagcauguagggcagaaaaccuaaaauauuaucuaaauaaggcacauuuuaaaguucacuugcucugguauguacauagcacagcaugagguaaaaauaacuucuccuucaauaaaccacacaggauucacccuauuaggcugcaucugcugagauguuaagggacucucuccuuuaauauauaucucaccaguguagugguaggaccagcaggcucccuggauucuguaguucccaagcucuccuacugaaagguucuuugaaacugaaagacucucuaaaauggaagucacagcucuucaauacaggagcucuggguauuggcagaagguagaacuuacugcacugugauaauucaacuuuguaauccacuaauaauuuaauccugguaaaguuccuguucauuaucuaggacuuugauaugguuuggauuucuguccccgcccaaaucucauguugaauuggaggaggggcccagugggaagugacuggaucacgggggguggggguagggggggaagauuucccccuugcuguucuuguaauagugaguucucaugaaaucugauuguuuaaaaguguguggcacuuuccucugugugcucucucuuuccugccacaaugugaagaggauccuugcuuccucuucaacuuccacuaugauuuuaaguuuccugaggccucccagucaugcuuucuguuaagccugcagaacugugagucgacugaaccucuuuucuucauaaauuaccuaaucucagguaguucuuuacagcagugugaaaaaggacuaacauagaaaauugguaccaggaaaguggggcacugcuauaaagauacuugaaaauguggaagcaacuuuggaacuggguaacagguagaggcugaaacaguuuggagggcugaaaagaagacaggaagaugugggaaaguuuggaacuuccuagacacuuguugaaugguuuugacuaaaaugcugauagugauauggauaaugaaauccaggcugagguggucucagauggagaugaaaaacauauugggaacuggagcaaaggucauucuugcuaugcuuuagcaaagagaccagcagcauuuugccccugcucuagauaucuguggaacuuugaacuugagagaaaugauucaggguaucuaguagaagaaauuuccuuuuuuuuuuuuuguuuuuugagauggagucucauucugucacccaggcuggagugcaguggcgcgaucuuggcucacugcaagcuccgccucccagguucaugccauucuccugccucagccucccgaguagcugggacuacaggcacccgccgccaugcccagcuaauuuuuuguauuuuuaguagagaugggguuucaccguggucucgaucuccugaccucgugauccaccugccucagccucccaaagugcugggauuacaggcgugagccaccacgcccagcccucuagcagaagaaauuucuaagcagcaaagcauucaagaagugaccuggcuguuucuaaaaguguccacucauauuugugaacaaagagaucugaaacuggaacuuauauuuaaaagggaagcagagcauaaaaauuuggaaaauuuguagcccggccaugugguagaaaagaaaaacccguuuucuggggagaaauucaagccugcugcagaaauuugaauaaguaaagaggagccaaauuuuaauagccaacacaauggggaaaacgucuccagggcauuuuagagacauucacagcagcccccucucaucacaggccuggaggccuaggagaaaacaaugguuucaugggcuaggcccagggccuagcugcucugugcagccucaggacaugguccccugugucccagccacuccagcuccagcuguggcuaaaagaggccaagguauagcucaggcuguguccucagagggugcaagccccaagcuggcagcuuucacauguuguugggccugcaggugugcagaaggcaagaguugagguuugggaaucuccuccuagauuucagaggagguauggaaacaccuggauguccaggcagaagucugcugcaggggcaaaacugucauggaaaaaccucuacuaaggcagugugaaggggaaaugcaagguuggagcccccacacagucuugcugaggcauucccuaguggagcugugagaagagggccaccauccuccagaccccagaaugguaaauccacaagcagcuugcaccaugugccuggaaaaggcacaggcacucaaugucaguuggugacugcagccaugggggcuauaaccugcagagccacaggggccaggaugcccaaggccuugggaacugaucucuugcaucagcaugcccuggaugugagacauggagucaaaggagauuauuuuggagcuuuaugacuuaaugacugcccugcuugguuuuggacuugcaugggacauguaaccccuuuguuuuggccaauuucucccauuuggaaugggagcauuuacccaaugccuauauccccauuguaucuuggaaguaacuaacuaguuuuuuauuuuacaggcucauagguggaagggacuuacccugucucagaugagacuuuggacugugaacuuuugaguuaaugcugaaaugaguuaagucugggggacuguugagaagggauaauuguauuuugcaaugugaaaagaacaugagauuugggaggggccagggcagaauaauagugguuuagauuuguguucccacccaaaucucacaacgaauuggaggaggggccuggugggagaugacuggaucaugggguagaucuccccuugguguucuuguggguucucaugagaucugaucauuuaaaaguaugugucacuucccccugcauucucuucugccacaaugugaagaagguccuuccuuccucuuugccuucugccaugauuguagguuuccugagaccucccagucaugcuuccuguuaagccugugaaacugugggccaauuaaaccucuuuucuuuuuaauuacccagguaguucuuuauagcagugugaaaacagacuaauacagaaucacagguuucccuuccuugaagacaugaaaaccucauucuaauauggcauuccacagcaagacccuagagaaaagcuguuggcuuagaaacuagggagauggaaaauccugguccucccacuugaugguaaucagaaacaaccacaccucagcuaaaucuuucgggcaagggaaugcuuacuacaugugcucacuucacuugucaaauggagauaaugauuacugcacugccuguuuuguaacccuggcaggagaugaaaaaagauacaggaaacaggccaggcgugguggcucaugccuguaaucccagcacuuugggagaacgaggcgggaggaucaugaggucaggagaucgaaaccauucuggcuaacauggugaaacccugucucuacuaaaaauacaaaaaauuagcugggcgugguggcaggcaccuguagucccagcuacucaggaggcugaggcaggagaauggcgugaaggaggcggagcuugcagugagcugagauugugucacugcacuccagccugggcaacagagugagacuuugucucaaaaaaaaaaaaaaaaaaaaaaaagauacaggaaacaaaagaauucugcaaguugcaugacucugcagcccagcagggaucacuauacaaaccuuucccagccacaaugugcacacauguacaugcuccuucugcagcaauaaaguggcuugcuccugauaagcaaaaugacuccaauuuaccuggacccuccuuaaucuccucuuggcaaacuuccauggaaaagcuuguuuauucauuuagccauucuguaaacauuuucugaacgccugcugaugaaagauaguccugcccuuaugucuucgugucagaaaacauaacacugacaguagugggagauuaagaaauggacuccaaagacccuacacccaagcuggagccaugagcauucagcugccucacugucuacuguuagucauuuucuuggguugugacucaacagucacccuuuucugaggcugcuagcuggauaaagcacuaaaaguuuuaauggaggaagcauuaacuucuuaagcaaaaccaagcaggaaauagggacauuuuccuucugccacccucacuaaaugguucucuaaauaugucuucagccaccugucauugccauggcuggcccagcugcucucuagacccuugugaugguugauuuacucauaugugcuuacuuguuuacacaaagaaaaugaugguugauaaugacaaauguguacugcuaauaauccuggaaaaaugucuagccccaggauccugaucaacuagaacugauucccuagugauauguaaucauuuuuuaaaaagcauugaauaggcugagcgugauggcucacaccuguaauuccagcacuuugggaggaugaggcagguggcuuucuugagcucaggaguucaagaccacccuggacaacauggugaaaccccgucucuacuaaaaacacaaaaauuagccaggugugguggcucacaccuauggucccagcuacuagggaagcugaggugggaggaucacuugagcccaggaggcagagguugcagugaaccaagauugugccaccacacuccagccugggugauagggugagacucucuaggaaaaaaagcauugaauaaaaugauauauuggguacuugggaaauucucuauacuguuuuccccugauaaaguacaaagggguagaggggaccucuaguucacccugcuucuauuauaggggaacaauuugaaacucauuaggaagaacuaacuuauccauggugugaugaucuuuugaugugucaacuugguacuaaucaaacaucaauccagguguugcuguaaacuauuuuaaaaaugugauuaaaguacauaauaaguuuaaguaagggagauuauacuagauaacggaugaaugcaugagccugauucaaucaguuguaagcccuuaaaagcaaagcuaaaaguuccaugaagaagaaauuccaggccaggcgugguagcucaugccuguaaucgcagugcuuugggaggccaaggcaagaauaucaucugaagccaggaauucaagaacaagccugggcaacauaacaagaccacaugucuacaauaaaaaaaauuagccuggugugguggcacaugacugugguaccagcuacucaggaggcuaaggugggaggaucacuugagccaggaggcugagcuugcagugagccauguucaugccacugcauucuggccuaggcaacagagcaagacccaaaaaaaaaaaaaaaaaaaaaugaagaagaaaggagaaagcagacgaggaagaaagaagaagaaagagaauaaaaggaggaggaggaggaaaaagaagaaaggacaaagaagaaagaagaaauuccaccugugcacugcagcuucagcuugugccacuguuuugggcugcccuugucgauggccugccuauggguuucagacuugccuagucagccucacaauuacguaagccacuuacuagcaauaaaucucucuuucuuuucuuuuuuuuuuuuuuugagaugaagucucgcucugucacccaggcuggagugcaguggcgugaucuuggcuuacugcaaccucugccuccuggguucaagugauucuuuugccucagccuccccaguagcuaagauuacagguauaugccacccuaccuagcaaauuuuuguauuuuuaguagcaauggggcuuugccauguuggccaggcuggucucaaacuccugaccucaagugauccacccccuucggccucccaaagugcugggauuacaggcaugagcuaccaugcccagccaccaauaaaucucuuuacacaugcacaugcaugugugcccaugcccacacacacacacacacacacaccccucucuccuacugauucuaccucucuggcuaaacccugacugaaacacaugggcacagagcuaguuggcucuaugguccuagaaaccagauuuuccaaugugucuuacugcucacucuucccaacuauuccucuaguuuaaauuaccuugguauuacauuugcaagaacuccaggaaauagggaaaacuuaaauuagaauuaaagaugcaaaaagaucccaguuagguuuggagagcuagcaaaaggaacaaauaauuacaaggcccaaaaaugucaccuuucagggaaucaaagaggcagaaaaagagaaaauugacucugagaaguccaaggaagugagcaaagagaaugucucaaaugaaggcucguauuaucagcauacccaaaggcccgccuucccccgaucgcccuauucuaaccagcaugcagaucccccgccugccaggaguaccaugcgaaucuccaggaugaagcuaggcucagaacacaguauuucacagggugaaucacagagcuuagcugggaugugcacuuguguuuauggcuuggagcacaaaacuauuuucccucuauccacaggacaaguucagcaacccuaaaggcaaacuggccuagggccugggaaguggagaaugccuauuccuaggcuaacccaagcauuagagaagcaucaggccgccauucuagacucaacugcucaccuccucugauccacugaggugucucuggaaauccuccaccacagccacagccuccucaccacucucagggugaugcagcugcacccagguccggagcuccccagggaggaugcucaggaacugcucaagcaccagcagcuccaggaucugcuccuuggugugcaccucuggcaugagccaccagcggcagagcucccgaagccggcucaaugcuuccugcggcccagacaucucgugguaacacaauugccugaaguguagccggaagauuucgcagacaggaggauaguucuucuggagacugcugcccugcccccaggucugguuugcuggcuccugcuucacagucaggcgccccucuugcuucuggaaagcagugcuccuggggaugaggccuaaauuuccccugccugcaguggucauugugaccccaaagagaagcuuguuacagcugcaguugguccgauuaaaaugauggucaauaguucaggucucaggaacuguuuuucaggguuggagaaaggggugaugguaguguggccuacagaaacaagagugaaaucagaguucuuggaguauucagccccaggcugaugacaauccuccacugaguuaaaaaacaaagcuccaggaaaaaagaacacaaccaggcauucuuaguaagcaucucuccaaaugaugcccuucuuaaaguuucaguggcucccauuaccuacaggauaaaaucuaaaugucuaugccuugcauucacagcccuucacaaccuggccuuacccccuucacaaccagccacacccucuaccacucaccccaaguacccaugcuagaaagacagcaauggucuccaaugugggaaaugcaggcuaucccaaagggugcaagagaaaauacuaaguuauuuaacuccuauuuaauguauguuuuauaaugugcauuacaauuuguauaguaguauucauguuuaaauuacaaauaaaccaauguagggaguaagugaucaaaccucuucuacugauagaaaugcaaaauaaagaaaguuuggagcuaaagcucuagagacacacuuagaagccacacauacucuuucuuugaauuuuucuucuucaacuuuuggcaaacuugucugucaagaccaugaacaaaggcaacuuuuucuugguuuuccugauugccccaucaggaagagugcugguagcuucccuuuguguaccucucacuauaacccuuuaacugguuuaugcacaacucaccacucucacccuccaaacugcugcacggccaccaaaggaaaggaaccaaauggaaucagaaaauacuagaccuuuuuuuacucaaugcaccuccccuagaaagccuuccugaucacgcuaggcuuagagaggugguuauugucucagugaucccaaacuaccuuuuucauucaaaccucuaguagagcacaucucacacuguaaucguuugugguuuacacgacugucuccccugcuuucugggaggauacaaagggcagagcugacuuccagucaucuuuguacacgugugcacauggcacacauaauugggaaaugaaugaauaugauacauuuagcugacacugaaguggaggaaaacuuugaacguuuuaaaaucagcaccuuacugguaacuagggcaucugugcugugcuuccaguucaccaagagcccagaucccugugucucaaucucuuuaaaaagacaaagaaggacuuuaaaauaaucuguaaacucugcucuaagaucccauauauguagaaaguucaggccauucuccugcuucccauaguguuccgaaugcucagcacuuuaaaaucucaauuggauuuuugcauuuccaagucacgcuccacguuugcgauucugagccugggucugacccaaauaugacaguucauacaguuuccuacugcaagagcugggaaaacagcgaucuaccuuucguguuaaaccaggcuucagcagcgccgcucaccuggccacgucugcccuguucaucgcuguacccgcagauacccggcuccgugccacgcacgaauggucagggguaugagacaaagaagcggcucuacaucgggcggcuucugagagucacggggaccgcgccgccugccgccgggaagaagcgcgguccuggccagcgucggcgacccgagcuccggccgcgccucccuccgcgucucggcccacucgcgguggcacucggcaccgaagccggacacucuacugcccguuagaccaaaaacaauggccgagccggaagcgagagaggccucgacuuccgc

SEQ ID NO: 16185 - RNA, 1622 nt, Homo sapiens
agcuaaagaagauugaaaucuccuguagcauucuauagggcuaucuguuuuucuccucuugugugaacuauuauagcugagggcaucagguaagugcaugcccaguuuauuauucccaaaguuacaaaucaggugauuaaguuacugucccuuggaguggaaggaaucgagguguggaaagaggcuaucaagcuccuugacacacugggacagcgugguggcucagaccaccccuccuccuucccacaaccuugcagguugcucagcugucucccaugcgagaccucaguuugcuccuugaaagaaucccaugugcaagcaggguagagauuauuaccccacuuuacagaagaggaguuuggucuugaguaacucauccaaaacgacacaagugccagguaucucaaccaaauuuggaacucgggacuccauucucuuuccacugccacacuacagagcuuuaaggauaaaacaacaaggacugugagccccuugagagcuaagauuugguugaguuaggaccuaccuaacucagggcccgguacacagggacagagccaauacuugaaugaaugacagaguacuaggccaacaaaguuuuuuuuuuuuuuuuucuuagagacagggucuugcucuguuuuccaggcuggagugcaguaguaugaucauaguucacggcagccuccaucuccugggcucaaacaauccucccagcucugccugccaaagaguugggauuacaugugugagccccugcaccaggcugucuauaugcucuuaccuuugaagggcauguggaaaguucucugccucuguuauagccgggccacauuucuguugacauggggccaguggaacuaaaaggaaacaucugugccgggugaggguugcgggugggguagggggcuggaauggcuccauggugggccagaaguuugcauguuauucgggcuaauauggguggagugaccaaagccuguuuuguauaacugagacuuccagcagcuuugagaaaagaaacaacaccaccacacacacaaaaaaaccuugaaagcugaaauaugccuuuagagcucucuuccucugauuuuuuuugccuguuuuguuauuaagaucauucuuuguacagggagauuaguaugaaaagacugggcugugagagugguguguuagugaacagacacuuccuugaggguuggggucgcucaugaacauuaaugcagcaucacugucuuggcugaagccacccccacuugccgcgccaugggccaguugaggucuuguggacagugucagcagaucuuuaaugcaaggaagaugaaacugauaucaucuuccauauguagaagguaaaauuggcuccaccagggcuaucggugaauccauugcagguggcugcaauggcaguccacaccuggccagggagaguuggggguggacaagaggaucuggauauuuaauggccauaaacucaacaguggcaacaaaugaggcccaggugcuacaaagagcccaugaaucuguggcuuccugaauagagggucuagucugcucacaggaggcacuugcccuggcccagaggaaggcccgugaaagcaaguuuuguucugggaucugcacca

SEQ ID NO: 16186 - RNA, 2392 nt, Homo sapiens
aguucuuggaauuuuccucgcuugcugcgaggagaaucccaagugagucugcuguguuggagccauuaaaaagcagccaaacucuacagauuugagguaagagacaccguaaaaaggcagaaagagcuaguggcgcggacuuguuucuggcucaugaguuggccuagcgaggcccuuuccccucucucgaccucaguuuccccuucuguaaaacaaaggagguucgguagcacuaaggcgagacagcgaagcuccccucaggccugacaaaaggauggucuccgggcccuggagccucccucugagaacgcgauucacccggagcgcgggggcgcccgggcgcguccgcaggcuuccccgcccgcccgcacgcaccccgggcgauccgcucuccgccgcgcccccgcacccagccccgccccggcgauuccucucccagccccggcgcguggaaccccgcccuccccugaguccccgagccuggcgagcggagggcggggcggggcggggcacgcgggaggcggagccgagccggggaauccugcucugggauagcacccggccccgcagagcagcgcggcagcccaagggccccggcgccgggggcggcggggaaccccaaacgcaaccgggucuggagggauccccgcgccgagccagccgccgucaccgccuccgcgccgccccugcgggcuuggcaggcgcccggcgcgcccgcacugcgcccggccgccggcucccgcggucccaccgugagcucgccggcccgucgcccgcucgccaugcaaccgccgccggccucgcgcgcguaggcgcccgccgcaggccaugcugccccugcucgccgcgcuccuggccgccgccugcccgcugccgcccguccgcggcggggccgcggacgcgcccggccuccucggggugcccuccaaugcuucagucaacgcguccuccgcggacgagcccaucgccccgcggcugcuggccucggcggcccccgggccccccgagcgcccgggcccggaggaggcggcggcggcggcggcgccgugcaacaucagcgugcagcggcagaugcugagcucgcugcucgugcgcuggggccgcccgcggggcuuccagugcgaccuacugcucuucuccaccaacgcgcacggccgcgcuuucuucgccgccgccuuccaccgcgucgggccgccgcugcucaucgagcaccuggggcuggcggcgggcggcgcgcagcaggaccugcgccucugcgugggcugcggcugggugcgcggucgccgcaccggccgccuccggcccgccgccgcccccagcgccgccgccgccaccgccggggcgcccaccgcgcugccagccuaccccgcggccgagccgcccgggccgcuguggcugcagggcgagccgcugcauuucugcugccuagacuucagccuggaggagcugcagggcgagccgggcuggcggcugaaccguaagcccauugaguccacgcugguggccugcuucaugacccuggucaucgugguguggagcguggccgcccucaucuggccggugcccaucaucgccggcuuccugcccaacggcauggaacagcgccggaccaccgccagcaccaccgcagccacccccgccgcagugcccgcagggaccaccgcagccgccgccgccgccgccgcugccgccgccgccgcggccgucacuucggggguggcgaccaagugacccgcuccgcuccucccuguguccguccuguguccgcgcgcgcgggugccuuucccgccggagacucggccggugugcuucgugcuguaguuaucguuaguuccucuucccgagauggggccgccgagagaccccagcgccuuugaaaagcaagguuugugcugcgcuuccaguuccgaaaagcagauguuuaagcccuuggacugagggugggaucgcagcuccgaagacggagaggagggaaauggggcccuuuccccucuauugcaucccccugcccgacuccuuccccgcacccacgugcccuagauucauggcagaaaaugaccaaauccuguguauuuguuuuauauauuuaauaacuguuuuaaaugaaaguuuuaguaaaaaaaauacaaaacaaaaagauuaaauugcuauugcuguaguaagagaagcucuuuguaucugaacauaguuguauuugaaauuugugguuuuuuaauuuauuuaaaauuggggggagggcaugggaaggauuuaacaccgauauauuguuaccgcugaaaaugaacuuuaugaaccuuuuccaaguugaucuauccagugacguggccuggugggcguuucuucuuguacuuaugugguuuuuuggcuuuuaauacagacauuuuccuccaga

SEQ ID NO: 16187 - RNA, 3285 nt, Homo sapiens
uuuagauaagaaggcugacugcacaaucacaauggcugacucagacuuccuggcuuuaaugacugguaaaaugaauccucagucgguaaguaugauggagcuuauauccugcuaguagguaggucuuucagcccuuucuacuccaucuccugacucagacucuaaagugcaaaguggucagacucacaaaacucaguguuccccaaacaguugacagacgucuguggagcaagcugugugccacacacugucuugugugcuggaagugcccagaagaguaagaaaguucccacgcucagggcauccacagauguguaaaagagucagugcagccagagauccaaggugccacaccuggcuuguggucaggggaggaugaaggcaggagcagccauaucucucugggccaucagggagagcaccacagaggaagcagcucuugagcuuaguacccaggcggaaaguaggaguguuccaggaggagggagggguggcaugaacaaaggccugaccuuuuacauuccauuuauuugcccaugcucuucuuuuugccugaccuguccuuaccugacaaaugacuugucuuucaaaauuagcucagauauuaucuccaaggaccucuuuccaaguugcuggggagcuguaaccagucccucuccugagccacguacuggacugccagcuuagugccuguuguguuauguuagucauaauaugccucucucucuucccuguuaggcugugagugucucaaagcaucaaagcacaucuuauuugucuuuauguuuccagaauuuagcacaguaucugauguuuuuagguauucuguaaacaacuguuggacuaaauugcauuugucuaaaguguguuuaugccuuguauagauuuuccuaguccccaaauugucaaggguccucuuaggcucuucagcugcaguguugaauggacuugauauagugagcuuucugucaacuugauauauacugagcuuuccauuaauaaaaaagaaacuaagacguuucuuuccaauguaacuuaauuuuuucuguugucucagucugguuuguuuuagguuuuauuccugugguucucugguaauuuccaagauuggauaaaacaacuaaaucucacucccacuugcuuuuuuaaaaugcuuuuucuacguaaccaagcacauuuuaguugaugccaugacaagugagaaauuugcaucugugauguuucagcugaauacacaccauuggcacugacauuuccacugagccugcuccagaaaucuggacagaacagaggccaccaguauaggagcuggcugucauccuccuucccacccacugcacaugccaugcacagcuuuggcaggcuguucagacuucacacaucagcugccuucauucucucaauuuaucuuuguacugcccauuuugggggcaaggugucagcuuauuuuccuucagcaccuguuaacacccaaaggaauuaaagauaaaaauagcagaccuuucuauuaaugugcuaauggacuucccuuaugcucagaggauuuccagaggauuugacuggaaaucguuaaaugcaguggaaauucuaauuucaguguuuggcuccagcagcaagcguacaugaagaacaccuaggggccagauuaaaaucaucuuuauguauggacucucugaagggugaagauucauguuuucucuauuguuaguaaauaaaaagugauuuucuuuguuaacuuacaaaggagaaagguggcgaguuucuccuguacuacugguccguauuuuuaaaugauguuuguucaauauauuguguucugagacaccugaccuuuaaggcaucagacagaaggcuuugugccauauagaaaggaaauauuuaguuuguccagacagaggaaggggaaaaaaaggaauuagucacccuuaccaggagguacagaaaaaaacagagcuccuuacauucccauggaugauguagaagagcuccuagcuucuuaauguacuguuaaaaaccuaggacuaccagaagcuuuuuuuuuaaaucuagcccuuccuuauuuuaagcauucaguuaaaauacugagaucauggcagggaaauuaugcuacguucccaauuuugcuguuucucuuaaguuuuccugggauuuuguuacaugguaaauuuagcaaacaucaugugaucuaaucccaggcaguuguuaaauggaacaaauuguggcucugcacuucagauugguuugauuuuucuuguugagccaaagaguaacacaagcaccucauucucagcaggcucugugcccucuguagggauaaguccuuuaucauugguggcauuucauucacaugcauguuggauugaaucccaagaguuucuguguuuuuuguguaugcuuuuucucucagcagccugcuaaaaauuucaguucauauuucccaccuacauggaauguuuuaaaacauaaucaguguaguaugaacccacuuugaggaggacaggugaaaacaggcucaauuucuaugagaaauuugggaaagcugcuccuuucugcugaucugcaaaaaguguggccuuuacaaauucuuccuuuugaagaaugugguuccaaaucuauuccagaaagccaaguuucauauuuuagagaaagucaugugaccuggauaaauaaaugaucucagggcuagauaguguagaaacaucagcaaucuuaaaacaaaaaaacaccaaguaaugaauuuucuuucuucuucacaggccuucuuucaaggcaaauugaaaaucacuggcaacaugggucucgcuaugaaguuacaaaaucuucagcuucagccaggcaacgcuaagcucugaagaacucccuuuggcuacuuuugaaaaucaagaugagauauauagauauauauccauacauuuuauugucagaauuuagacugaaacuacacauuggcaaauagcgugggauagauuuguuucuuaaugggugugaccaauccuguuuuuccuaugcucugggugaauagagccugaugguauacuacugcuuugcggaauugcauacaacugugcauuacaaaguuaauaugguaauuauggucugggguaaaauugaguuucagaauaaaauuaggaacaguaaaauccaaagaacuauguaaacaaaaaagcuuuuguuuugcuuacaaaguauauuuaaggauuauucugcugaagauucaguuuaagaguuuuccuugggagaacuaaguaagaaacacaaugccaacagcuggccaguaauuagugu

SEQ ID NO: 16188 - RNA, 1380 nt, Homo sapiens
ucuuuuuuuuuuuuuuaaaaaaaaaagacauuuauccagcgucacgaucagacuauuacauuuagcaaucaacagcauggggugcaaaaaaaaaaaaucuacauuaaaacccuuuguuggaaugcuuuacacuuuccacagaacagaaacuaaaauaaccuguuauacaauuagucacaaauacaguccucgaguuuuuugccuauacacaugaguauuugucuaaaacaugucuucuuuguagcagcuaggcccugccaccacugugcuuggcugaguucacaaaucuguuguaaccuguagcuucccugucacuucucuggcucuccucuccugcuaagcuuuguuuccuaauuaaaaucuucugccacugccauagcuacugcugcugcuggaaccgccauagccaccuugguuucgugguuuugcaaaguauuggccuccaccgccaugggggccagagcuucugccuucaaaauuuccucccuucauggguccaaaauuugaagacugauuguuguaauugccaaaaucauuguagcuuccaccaccuccaaaauugcuuccaucauuaccaaauccauuauagccauccccacugccaccauauccaccaccaccacggcugccaccaaagccaccacgaccacugaaguuuccuccacgaccgaaguugucauucccaccgaaaccaccuccacgaccaccaccaaaguuuccagaaccacuucgaccucuuuggcuggaugaagcacuagccaucucuugcuuugacagggcuuuucuaacuucacaguuguggccauucacaguaugguauuucugaaugacaaucuuauccacggagucauggucgucaaagguuacaaaggcaaagccccuuuucuugccacugccucugucagucaugauuucaaucacuucaauuuuuccauacuguucaaaauaaucucuuaggugauguucuucagugucuucuuuaaugccaccaacaaauaucuuuuucacaguuaagugggcaucuggucuuugagaaucuucucuggagacagcucucuuugguuccacaacucuuccauccaccuuguguggccuugcauucauagcugcauccaccuccuccacaguggcauaugugacaaacccaaagccccuggagcgcuucguguuuggaucucucauuaccacacaguccgugagcguuccccauugcucaaaauggcuccucaggcucucaucaguuguuucaaagcucaacccuccaaugaagagcuuccucagcuguucgggcucuuuaggagacucugacuuagacaugacggcagggugaagagagacuuuaacgaugcuucuucggcggcguccaagggcagaaaggaa

SEQ ID NO: 16189 - RNA, 481 nt, Homo sapiens
cgccaugccggaaccgcgcgggucgucgcagcugcgggugaacgcggcguuugccgcgcgguacaaccgcuaccgggagcgcgaggaacugcagcggcgugagugcggggcgcaugcgcgcgggagccugcgcgcgccggccgguugggaaguggggagucgaguggccccgccggcugaccugggggggggcaucccgucugugucccgcagugaaggaucgcuacggggaccgagacagcagcagcgacuccagcuccgagucggacucaagcgacgagcgcguggugcgcguccccgccccguccuggacgugcggaggcguccaagccccccucugcaccccgaccccgauguagacgggggggaacccccaaccccagagcgcccugcgggagcgucccauccuccgcuccccaucccaugagggacagacagugcccccccucuccccaggggagccaaauccccguuauuuucu

SEQ ID NO: 16190 - RNA, 481 nt, Homo sapiens
agaaaauaacggggauuuggcuccccuggggagagggggggcacugucugucccucaugggauggggagcggaggaugggacgcucccgcagggcgcucugggguuggggguucccccccgucuacaucggggucggggugcagaggggggcuuggacgccuccgcacguccaggacggggcggggacgcgcaccacgcgcucgucgcuugaguccgacucggagcuggagucgcugcugcugucucgguccccguagcgauccuucacugcgggacacagacgggaugcccccccccaggucagccggcggggccacucgacuccccacuucccaaccggccggcgcgcgcaggcucccgcgcgcaugcgccccgcacucacgccgcugcaguuccucgcgcucccgguagcgguuguaccgcgcggcaaacgccgcguucacccgcagcugcgacgacccgcgcgguuccggcauggcg

SEQ ID NO: 16191 - RNA, 18708 nt, Homo sapiens
gguguauucuuuuccugucuuuguacucuccacauauauuauaaaauguggaccagaagaauucuauauuucccuuuuuuuaauuugacaauguuaugaguguauucccaugucaauaaaaauucuuuuaaaaauuauuuauaucugaaucauauaccaaauuuaccaauaucgaauuuaaucuuccuccaguccuugaauuuuccagcuguauuucauuuugcuauuaucugucaauauuccuuaaaauggauuucuagaagcaguauuaccaaaugaacuucuuaaacaaucuugauaacuauuguuaaauugcuuuucagaaauaaugcacuaauuuauauuccaauaaaaaauacauggcaguggcuauuuugccacauucuuaacugcacuggguauuuccauuaauaaaauaaaaucuccucaccauuuuuaacaggcagaagaaauauuucauuguaauugacauuuuguuuuauuacuaguaugauuaguauuuuuauuuuaauggguauugcauuuauuccaugacuguuuguaucuuuguuuauuuaaauaaguuauuggccuguaaucccagcauguugggaggcugaagcggguggauuaccugagguuaggaguucaagaccagccuggucaacauggugaaacgccaucucuacuaaaaguacaaaaauuagccggguaugguggcgugcaccuguaaucucagcuacucgggaggcugagaugugcgaaucucuugaacccgggaggcagaggcugcagugagccgagaucacaccacugcacaccaacuugggcaacggagugagacucugucucaaauaaauaaauaaauaaauaagcaaauaaauaauuggaauauauuauuaguuuucuuauugauucguaaaauugccuuauauguuaggagaguugauacuuuggcaucuuugucuuaaucuuuaguuuauuacacuuuaaaauuuuuugguacaggaucuuuauaguucaggcuguauaguguaugucagcauacaagcaaauucucccccaauacaauacuguucuuuuuugaaacuuacuuagacugucucaucugauuauucuacaaaugaauuuuagauuugcuaaauuaaaagccaacacacaaugcuuuuguucaacgcuuucaaacaaaagcuauaaccaaccuuuguuggucaagaggagacucuugaaagcuggaugaaguuagacaccacagauauucucgaauagagagagcauaagcucaaagaaauucacugguguguauccagggccaaacagcgagucccugacagucuagagaacgcagugaccuuauuccagcaacuccucugguggcuccugcccaccauggcacaggggaagcuucagugcauggugggguggcagguccuucuucaaguggccuucauaccccugaugucugauucaaggggcuuguaccaaaugaagggaugagugaaugaguggguggaugagugacauuugaauggaugaauaaacaaaucaauggauaaauaaaauuuacgggaaaauucuccuuuucuccuuccaauacuuggcucccagaacucuguuuccucuuguucucuugggggaacacacuuagagguuucuauaauuuaauuguguccaaaaggucugcuggcagcuucagaacaucacagcuccuggcuucagggucccugugccuuaagucaucucaaagccuuagcacagggcaagcaagcccacucacucaugggagugggggcacugagaugcuccagguggguagagcagggcuaaaacuggauggaaacucuagguaaggaaaugcagacgggcaaggcuuccaauuauggaggcauagcagggggucaggagcauccuggauagcacccugccugcuuccaggaguugcagcacccaggaguggggucagaacacgagccugaggcucuucuuaguaaauacccuuguuccuuucaugccacccacguuucagucuucucacucuuccucagcuccuaccacagaaagugagaaugggaaaugaaaggaccagaaauaaauauugggcaacuucagaccuggauaacccugucaagcccagauucuuacacaacauugagauuuuauuguacugaacuaggucugcacagagcaacagcuguggacuuaaaaaucaguuuucuuuuuucaaaaauuucucaaagaauuucaugauaaaagauguuacuuaucaaugggguuaguguaucauuuuaaguagcuaauuaaggggagaaaugagugugaagggaaggaaauguaaaaucagccgacaucaggauuucuuauugacuugaugcugaguccuuccacucugggaaaaucaaaauguauuccuucugguucauguuucucaagcuuuaauuauuagaauuaccuuuuugauuuuugcuauauuuucacauauugcauuguuacuuaaacauuauacuuaaauacauuuauuuuaauuauaauagcaaucacuuacaugguacuaugugccaggcacucuuuuaagcacuuuacaugcauuaagacauuucauccucaugacaaccccauuagaugagaugcuacuccauucaaugauggagacgaugagucucugagaaguuaagugacuugccauaguuacauaccagaauaaagaccuaaauaagaauugaaauacuauuaugguaauagaagaaaauauaggacaaaauagaaaaacaauuguacuuaagggugagaaaggagccuuuaaacuacauugagcuaguauaagccaaaagacaacauuuaaugaauuuuaauuuaaauuuuauuacaucaaaaguauuucuauuuaaugaaggauaccauaaacaaaguaauauacauauaagacaaugauaaaaguuauuugcaauaucuuaaagcaauaaaaaauuaaaauccagaguauguaaauaacucuugauaaucaacaagaaauagcgggaaacccaauaaaaaauggucaaagacacgaacagguaauuuauaggagaaacucaaaagcuuauaaaaagauguucaaacccaucaguaaucagagaaaagcaaaaugaagcaacuaugagagucacguuacuuguucaacuagcaaagauuagagagcagcauaaugccaaguguugguaaagauguggggagaggaaccuuuuugcacaguuaguggcuacauagauugaacucauuuacaucucccugugaucuagcauuuccaguccaacucuguacaagaacguuguaauuguauuugccagaguggagagcuggcggcaaucuugguucccaugccuaggagaguaaauaaguagaauguggaagauauacucuguggaguacugugaagcaggugaaagaaauggguugaauauucuaaauagcaacauagaugaucaggcaagcugggcacgauguuaaaaaaaguaagaaacauauaucauuuaccuaaauuaaaaauacuacauacaaaacaauacauauauuuuaggacacauuaaaaagaaaaugacacauauuaaaaaaccuuagaauaggacuucugcuuuuggucaugauggaguaacuggugccaaauuugccuuuccauuguaagcaacuaugaaacuggacaaaguaugagucaacuauuuucagguauugggcaacagcaaauagaggacucguaucccugagaaaaggaacauuuuccugugguaguacagggagauggagcccaggcagagcagaggguucacugagcugaggaggcagagauuagaccuggguugcugaagcagcuacaauuuucagggcaggggacuggagagaaggcagcuccauagagaagaggcucagaagucuccacagggauuuucuguuggauccuuggcugaaggaaggauugcacuagaggaaagugagacuccuugagguauaaguguguggcuacugaggagcugagagcugaacaaugggauaccgggguuugcacaaugcugagagaaaauucccagucaggguggauagacuucucugccaccucuuaugagcaaaggcuaugcccuacagcagugguuuuuuaaugucagcauguaccagggucgucugaaacacuuguuaaaauacggauugcugggucucaccccuggaauuucugauucaguagcucugaaguagggccugaaaauuuguauuuuuaauaaguucccaggugaugcuguuguuguugaagaccacagcccuagaguaaaggcaagcccuaaaacuaaagccaaaucugaaauagacacauccuaacaaaacauaaaacugagucugaugagacugaaaggaagcaccaaugauuuuacaacccugacaaaaugacacccagcacuuuuuaaaggaagauaauaguccagacuccguacaacauaucaccuauaaugcuugacaugcaauaaaaaaguaauugaugugaaaaagaauuauagccauaauucuaaaaaaaaguccauagaaacagaccccaagaugacugggaaguuguaauuagcaauuagggacuuuaaaucaacuauuauaaucaaggacuuaaagaauuaaauugucauaaugaaugaacagauguggaauuucaguagauaaauggaaacuauguaaaagaaccaaauggaaauucuagaacuguuaauuacaguaucugaaauaaauuggagggucuuaacaaccuaguagagacaauagaagaaaggucaagaaaugaauauaaauuacuguaaaaaaugaguuuuaaaaggagauaugaaacaaaauuaagcagucuaauaaagguauaguacccuuauccauuggugauauguucuaaaacucucaauggaugccugaaacugcugauagugccaaaucccagccaaggaacaucaaggucaccuuuucacuuaaggaagcacuuucaaguuucucuuugacauauccagauugccagcaucacuacucuuagggccauuacuaaguuaaaaaagggucacuugaacacaaguacugcaauaucacaagcgucaaccugauaacugagacagcuaaauggcuaaggggcagguagcaaauaaaguguagguauaugggacaaagggaugauucaugugcaggcaggaugaagcaauacaguguaagauuucaucaugcuacucagaauggcgcauaauuuaaaacuuaugaauuccuuauuucuggaauuuucaauuuaauauuuuuagaccaugguugaccagggauaacugaaacugcagcaagcaaaacugcaguuaaggggggacccacuguauaacugguauauauaaaggugaagagaaagcgauaauuaagcagggaaaaaaauguauuugaagaaaucauggccccaaauuucucaaauugggggaaaaucaaccuaaaacucaauguuucauaaacaccaagaauaauaaacacaaaugaagcaaaaaaugcuaaaaaaaaaaaaaaaagggaaaggaauaacauuaaaggcagccagaggggggaaaaaaacacauuucguaggagauaacaaugauaagagcaauugcuaacuuuuuaucagagacaaugauguacagaugacaguagaaugauuucuuuaaaggacugagaaaaaauauugccaauucagaaugcuguaucuggaaaaaauaucucucaaaaaugaggguaaaauaaagacauuuucaaauaagugaaaaauaccagauucuuugccaacagacucaugcucaagauauaguaagagaaguuauucaggcuaaggcaaauugacaccagauagaaacuuggauaaauauaaaagauuacauuuuuugucuugaugucuuuuuaaaaaugaauuuguuuaaaauaaaaauaauaacauuguauuaugagguuuucuauauauguaaauguaaaauacaugauaacaauacagagaaugagaggagguucuuacauuuuauaugaaauggcacgauauuaauccuaaauagucugugauauauuaaggaugcauacugaaaucccuacagaaaaucacuacaacaauaauauaaagagguauagcuuaaaaagucaauagagggacugaaauagacuacuaaacauuuuucaaauaaucaaaaaaaauuaagagauagagaaaacaaaauacaaauaggaaacaaaguguacuguaguagacuuaaacuugauaauaucaaucauuacauaaaauguuaauagacuaaauaauucaagugaaagggguugucagacuggaugagaaagaagauugagcgccaugcuuucuacgagagauucccuuuauauuaaaaaacaaaacaacauauauuuaaaaauaaaaguacugaaaaagauauacagucauguucuacauaaugauguuucagucaaugauggauugauuauaccaagguugucccaugagauuauaauggaauugaaaaauuccuguugccuggugacaacagagcuguuguaacaucguagcacaacucauuacucccguguuuguggugaugcuguuguaaacaaacuuacugcacuucagccacauaaaaauagagcacauacaauuauauacaguacauaauacuugaucacgauaauaaaugacuauguuacuggcuuauguauucaguauacugaauuuuuuauuguuauuuuaagaugcacuucuucuacuuauaaaaagaaaauuaacuguaaaacagccucaggcagguccuucgggaggaauuccagaugaagacauuguuaucauaggagacgccagcuccaugccugugauuaccccugaaggccuuccagugggaaaagauguagagauggaagacagugauaaugaugaucuugauccuguguaggucuagacuaaaguguguguuugugucuugauuuuuggcaaaaaaguuuaaaaaguaaaaauguuaaaaauuuuuuaaaauagaaaaaaucuuauggaauagggauauaaagaaagaaagcauuuuuguauagcuguacaaugcauguuuuaagcuaaguguuauuacaaaaaaguauaauaaaaaagucaaaaaguuuaaaauuaaaaaguuuauaaguaaaguuguaguaagcuaagguuaauuuaucacuggagaaauuguuuuuuauaaauuuaguguagccuaaguguacaguuuauaaagucuacaguaauacacaauaauguccuaggccuucacauucacucaccacucacucaguaacucacccagagcagcuuccaguacugcaaccuccauucaugguaaguauccuaugcagguguaccuuuuaaaaauccuuuuuauuguauuuuuaauguaccuuuucuaugcuuagguauacaaauacuuaccaugguguuacaauuggcuacaguauucaguacaguaacaugcuguacaagguuguagccugggagcaauaggacaugccauguggcauaaguguguaguaggguauaccaucuagguuuguguaaguacacucuauaauguucacacaaugacaaaauagccuaagagugcauuucucagaauguauccccaucauuaaaggacgaaugacuguaccaugugaagaagaagcauuaaaaaguuagaauagcaguaauaucagaaaaaguaaacuucuagacaagaacuauuaccagggauaaagggauauauuucuuaaugacaaaggagucaaugagaagacagaauagucuuauaugucuuucauauaauagagcucggacauauaugaagcaaaaauugacagaaauaaaggaagaugcagacaaauccauaaucauaauuaaauauuuuaacaaggcaacuuauuguucuaucuagcuagcugauauaacaaugaggcaaaaaauuaguauugaauagaagauaugagcaacacuauuggccaacuugacccaacugacauuuauuaaauauuauaaugcaagacacauagucuuuucaagugcucauggaacauuaaccaaccuaggcuacauacacacagaacauuuacuaauauagcucauucucugagccauaaaaggaaccucaguacauuuagaauuauucaaauuguguaagucacaucagaauuacauuagaaauuaauagcaaauauaucugaaaaauccacaaaucuuuggaagcugacaaacuuuuaaauaacuuacaggcaaauaaauauaaaaggauauuaaaaauuauuuugaacugaaugagauaaaaagauaacauaugaaaauuuguugaaugcagcaaaagcaguccuuagagguacauuuauagcucuagaugcugauacuggagaaggagaaugguuuaaauaaauuaucauagcugcuucuauuuuaauaaacuagacaaaaacaaaauaaaacaaaaucaaaugaacccaaaguaagcagaagaaaaaagauaagaaagaccagaaaagaaaucaaugaaacaaaagcuguuucuuuaaaaaagucaauaaaaucuuuaaauugugccuaugauguugggguggggagcagaucggggauauguggauuuuuuuaaaaggaaaagaugaaaaauuuaugaaaguaaaaggucucauccucgcccuggugccaagacuguguagagcgguucacaugcuggagccugagccaaaagacugagggguacucaagugauguacagagucucucaucauuggcagcaguaaggcauuagacuggccuauucagaagaacugugauuacucacuaaaggauuauguaaaaaggaauacauugacagcaaugagaaccagcuuucuuguugugagagaagccaguuucaacuaugaaaagguagaagaggcugggcgugguggcucacuccuguaaucccagcacuuugagaggccgaggcaguuggaucaugaagucaggaguucaaaaccagccuggccaagauguugaaaccccguuucuauuaaaacuacaaaaauuagccaggcgugguggcaggcaccuguaaucccagcuacacgggaggcugaggcaggagaaucgcuugaaccugggaggccgagguuguagugagcugagauggugccauugcacuccugccuuggcaacagagugagacucugucucaaaaaaaaaaaaaguagacuagaaagaacaaugcuauguaagauugucauugaagguauuggugugaacgcauggcuuuacaugugauagauuagauagauaugcuugugugugugugugugguguguguguuacuguauuuacacauacauagauauuuuucguagcucuguccauggagaaggcccaaaaacaauaguacuccacuaacaaugagcacaucuagcucuccaaucaugguuucuaaauauuaguuuccacuacaaaaagccagacugcuuggagaugugucuuucuguggccagggcagggaaaauacaagacagagcuggaaccucuuugcuaaagagggagggauugcucaaaguacaauggagacagaacaaaaggacauaggauccagcucccguuagaucaaucuggggugaucugugcaucaaaauaaagacaacauuaaacuauauuccacugaauauaguuuaaccccaugagacgcugcugauacaaauaauaaaugaggagaagagaagcuuucacuuuucagaaagaagugaacuaauaauugucacuuauuaaguaauaaguacaaaaugcuuuacaguggcaaaaacugguagacaccuucuuaagcaagugauaaaguuuaacaucaccagucguggggaagauuggcauuaggugcguucugauauuaugcacugagaacacagcaacuguuuugugagauuccugcccuaguuucauaaccuggaucuaaggaaacaucagucagccaaaucgaggaauuguugucuaucagguaacuguaguguucucucaaaugcugaagucaugaaagacaagaaaagccugaggaacugcucuuaaaggagacuagaggagcagacaacuaaguaaaacaagcauuucuggacccugggauuauugaggacauuauuggcaaagugggcaaaacuggaaacagggcuacagauaauaugaugauauuguguccauaucaguuuccuguuuugguuacgugggagaauauccuuguugcuaguaaaagcauucugaggguaaugaugauaaugaggcaucguauuugcaacuugcucucaaaugauuguggagaaaaaauagcauuguauaucuaucuauaucuagcaucuagaucuagauauguauguauguauguaucuaauauaucaucuagagaaugaugaauuuaacacaaacgugguaaaaugcugacaacuggugagucugaauaggggacaagggaguucuuugugcucuucuggcagacuuucuguaaggaugaaaucgaagggacaacaauagcgacgagucuggggcugcaccccauuagcacaggaccagggcaugggaggggcaggggaggcagucaggaggagcuggaauuuccuaagugaccaaggaaaggugcuggcagacaucuuauuggauaauguuagaggaauacuacccgauuucccuaacuuuauguuauuuaauccucagaacagcagcaugagguagauaccaggcuccucuucacuuuauagauuaggaaauuggagcucagaaauugagcuucacucagccagcauuuacuuaguguuuacuaugugucaaacauuaccgagguuacacgcacagaaaauauuaagugugaucgucuauguaugugugugcauuuauaaaacaguacuagaaggaaauguacuaaaacaguaguauaauaagggaggcuauauuuggggagcagaauugcacagauguuuucauuuuucuccuuuguguuuuuuagcuauuucuaguuuucuacaacuagaaauucccuuuguaauaagggaaaaaacaagcauuacuucaaaacggaauuggaggaucuugugaaauauuucacauuaugauuucacuguuggaccaaauacuguuuucugaugcaguuuuauuuuacuaaagcaauagacaaauaugucuuaauucaguuaagccuccuuuccacacacugagagcugguggguuuacaacuggaaagcugacauccacuuggacuccuaagaccuauauuugucuauauuuucuguguggggguguaagccagguggcaugaccuccucuaucccagacaaaaguuuucaagaccaucaugacaccagcuucuuuguacaaagaccacaugugaacacaauucccacugaagggggugugugguuugguaagagugcagcucuaguguccacaaaaggagaaaagucagcccaauggugucacuguauuguaaggugggacacccgucagcuuagggugucuucugacugaugauuccuucuucccuuuuacugccuuggcacccugagcucugcaguccccccaacccccugccaugcugccugggcccuguuggcaucccugugucugucuggcucacugagcugagcacccugcaagaacagacauuccucaugcaccagugucucucauggcucaagagcuugcuuugaauggagcccacagucaucacugcuggguugaacugauuugugcaagcaauaguggguaaacagguggaguaaauuagggugcaucccugccaacgacuucagugcaggcaccaaaaacaaugcuuugaaaugauuuauucaccugggaaagugaucacaacuugcugcuaauuaaaaccaacaauagaacagugaguacaauugaaguccaucauuguuauuaucauaaauaugcacccaacaaaaaacaaacuaaaagaaaauacacucaaaagcacacagugggcacauuuugucuuuggguaguggaaguguagguaaugucaguguuugggguuuuucuuugaauuuuuaagcuguuuuagaaauaaguuuuguuauuaggaaaauuauuuuuaaagaaauauacaucugagggaaaagagaacaaaggcaugauaaauaagggguccuugguuggagaugaugcauccagaacauuuuggauaaauaagcuacuuugaguuaagggccuucucggccuccuacaucaacacagaaucucaccccacccuccuaguagacacuuuccucccaacccccuaucagcuacaaauacugucagcuuacacagcaggccuuauuauuauuauuauuuuuuuuuuuugcugacaaguccaagauggcagucggaacucugacccauaaaaccagaaggcuuagaugaagaacaaaaagaagggaaaccaacccugcuuccuuuugccuguuauuaaucgcugcaauaaagccauuagaaucuaccaacauaucacccaacuugaaaagaagagagauucugaaaaauagucagaaaagaaggguaaauggaaaugaugagucccuccccuuuauggcuauuuuaagaagcacaccauguuauucauauggcccgugcuuagcccacucccugaauuguuugauuuuaguggauauaaaaauucuuccuaagggcuuucuuaguuccacugccagcaguaguuccccauuucuauuucucguuaggucucaacucuuccgucaugaguucuauguuccccaggauuccaagagcccaaauccugcggugggagugaaggggaggcagaugcuggcuacugauuggcucugggacucagaguggagucacuguggaaaucacuauuuccaaguucuuuggcagugggaggguggcggggggggggaggugauggaagaacagaaauuccucauacaucagugucucccauggcuuaggagcucacuuugaauggagcccacagucaccacuacuggguuuaauugguuugugcaagcaauagugggaagugggugacuuuguugacaaaugcuaauggucacaaaucugaaaucuugcuugaguccaagcccuucucugguacacuuagucccagucucuggaauauuugguuuugcucauucaucuucuuucuaccaggggagaaguucauggaaaagacugaagccccagaagccucagaagccccaggccaccauuacauucccucucuaucccaaguggcugugacuccaugcugugccaagagucagaaccuggcugggagagccaggcugcuggcucagugugccuggcaggucacgccugcuuauuuuggguuggccuccuauggucugagucagaacccagcagagaguucaugcuccccuguggagggagauguggagcugacccucuccagccuguccacggagaggaaggggagccauuuaaccaggugcacagccacacgccuguggaacaacugccgcagguacuuccggaaccucucaccaacgaaggcguagaucacuggguugacacagcagugcguguaggcgaucaccuccgucacuugcacagccagguccaaaugucugcucugcucacacucaugggugaacaggaagucuuggaaaacagaaauaaguauagucaaauuguaggggguccaaaagagaaaaaagaugaucaugaugacaaaaaucaaacggacagcuuuggauuucuucucauuuggucgucuuagcagaaucuuuauaaucccuguguagcagaugaucaugaccaacaaaggcaauaccagcccaaagagguucaguuucagagccugaaacagcuuccacucucguaggcuuucgugaggaaagugaaggcugcagguguggugagugaauucccauugggucuuggaaaaguauaagccuggcauggaagccaagauggccagggcccaaaugaugaugcuggugaugacaccaaaagugacgguccgugcccgcaaggcaaacacggcguggacgauggccagguaccugucaaucgucagcaggaugaugaaaaagaucucgcuguacaagccuguguaauaaaacccagagaggaucuuacacauggcaucaccaaaaacccagucauccuucaacuuguagucgauccagaagggaagcgugaacaggaagagcaggucagaaauggccagguucaggagguagaugcuggucauguuuuuuagccucuuguauugcacaaggaccaggaccaccaggauguuuccaaccaggccaaugacaaauaccaaggaguacagagggggcagcaguugggccccaaaggcccucucguucaccuucuggcacggaguugcauccccauagucaaacucuguggucgugucauaguccucugugguguuuggaguuuccaucccggcuucuccuacagguuaaaaaaaaaaaaaagauuugucuuuacucugcuacuaaaggcagugggcacuggacaguaaagacaagggagagguaacauuuuuucagccacuccauaaauguuuauugagugccuucuguguaccaugcccuggggacaaaauggaguguuagagagacccagauccucucugccuucuaggaaucuuagucuaacagggaguggaagcaauaaguaaaugagugcacaaaucauuaauucaaucauuucagcaaagaguuuuguaagggauaaguucaauggguggaaagccagagggagaccuuaccauacuauucauaaccaacacuuccuaagcacccccauggccuaggcacuggacuuaggguuaaagagcccuggaggggucccauuguuguucuuauuuaagaggugaugaaacagagguucagagugguuaggaaacauguucaaggacacaccucuugugagaacagaccuggagcuccaacccagcugugcaucauucucaugcccggcccugacaccacuacgcuuuccugcugcuguccccgagcaguagcuuugcacuguggagcccacaggaggacucugagaaggaaaaugguccuggcucagagaaagauacaaacagauauucauggcuuuuggucuaagaagauucucagccgagagugaccuaguacccuuggggcacuuggaaaugugugggcauuuguuguuguugucaccaaaacugggggaugcuaccgucauuugguaggcagggccaaggauguccuacagugcagagaucauucuaccccaaacaccagugguguugccauagugaaauccuaguaggucaaccccauuauuuuggagaugaggacacugagggcaccagagugggcugagccugacccacauugcacaguccuuagguggcacagguagaucuaaggucacuuugcagaccuccugaaggagaggaaagugcaggcagagaagggggagguaaccuggucagaaaaagagaaaacugggcaucaggggaggaagaguucagaauggucuggagcuaugaggugauguuacacagugacuagcugaauucugcugagauaagcucuuagauauuuuuacccacggaugccuuaaagcaaacaaaaaugaaacaaaaaagaaucacucuguagguugccuuuguaggacuucucccagucccugcuuuuuuggcacuugaauccuuuccaguugcuuauuaaagaugccuccccaaauggagcauuggcuuugguguaaccuacgagcuuugugacuuuggauaaauuauuuuaccucucugagcuucauuccucaucuguaaugugggaaagcaacucuuaucuugcaaggcuacugugagguaauguaugagaaaagugcuaccaucacccucccaccaccaccaccuggcaacagccaggccccuuauugagggccuggcaagagccaggccagggcacuuuucuuggggaccuucccugagagaacuccuucacugcaggagcccuucccugaggccugacaccaccagcacaucccaggcaccaauguccaggaugucccuggcuggcugguauacccugucucccaccccccugccaaauuucuuuguaguuaaucuagaaagugauuuuucuugauaacgguggacaaugauggucccuuccaugugaaugacauuugaaauugucaaucuauugccgccaaucuaaauugauuugacccaaaugccaaucaguaaaguagguggcaccuacuuuauaauuucuaucuuaaaccugggucucugguguucuuccuucuacucuccuuaaggaauguuuccugcuuacacaauucacauuuuuuucaauagccauuguaaaggaaauuaaggcacauggaggguauagggcacccuggcuggaaagggagauacucuauuagggugagaagugaggagcuuuaauuuuuuaucaaacccauccccuggcccacuccuccaucuccagagagauccaaucagcccucuuucuggagagagucaggcuaacggucacuaacaaagcuguguuggcaguuucuaauuucugcagccacagccauugcugaugagggcagacaguucgguuugauagucagcacuuuucggugggcuggcagguuaacaguggaaguaugcaaauagcuuggaaagcacaaagagcagcuagugcaagccugaucccaugaguccaguuucugggaagguuuggcaaaggcaaaggcaaguugagucaacauugucagguggcauuuuaaaccgagucaccuccauacacccccuaccuccaacccauuuguuauuuccccaacuuguuaagccccaggcaaccacuccaaggcaugcuguuccuaaagggaggugaucugggguggggcccgagaagagaaaccaaaggaccauguugucaucuaaucugccagcccugcuguagucuacugcagaagucugccucaaggccacugcacaguggucagcuauagcccuggauccuggacccuccacugcuaguguccuccagccugggaguuggugaagucucugagcagagauagagcagucugugauggugaaagacacccaggccuauggugcgcuggcuggcuuauacugguuuauaaaugccaauugcgugcaucucuuccccacuccacauucagcauguugguagcuugaaacugaccacagugggggcauuuauaccaugaaaaucaacaaauguuauaaagcagggaucuuuucuucagaagagucaguuguugaacauuuaccagcacaucacugcccaggccccacauucugaacaguccagcacugucccacugcucggugcgggaacuaaaggaucagugaguggcacauagccuggugccagguugugcaaacuuuugggaguuuccaucucuucuuugaaaucugggacccaccaagaccaccuaugaaguagauaccuauacggagccaccaugccccucuaucuucagaacaaaauccugaccugugucuuuguuaguagagcagaacagaugccccccaagaucaccuggccagcuccuugccuuugggugagugaaagccuaccucuuccaaagauagcagugccaauuuugaggauccuugguucuagucuucuuaagagauagguucaguaucaaaucauccuugcaucugccaagauuuuucuagcuaauauuucccucuugcuauaauuucuucauacaccauguuugguuuuccuuuacaugggggaauuuggcaagcaauuuuuuuuuuuuuuucagacagacucuugcucugucgccaggcuggaguguaguggugcaaucucagcucacugcaaccuccaccucccggauucgagugauucuccugccucagccucuugaguagcugggacuacaggcaugcgccaccaugcccggcuaauuuuuauuuuuaguagagacaggguuucaccauauggccaggauugucuccaucucuugaccucaugauccaccugccucggucucccaaagugcugggauuacagccgugagccacugcgccccgccaaguaauuucuuauugaauagguuuccacagaaaacaccuuuugucccuuaguacugacugacuuucuuaaucaguaaccaaaagccaauccuucaaguaagcuuccuuuuuagcaaaaaagccuauauuucaucugagcacccagcuuuauaaauccaccauucucaguauugcuacaguauuaauugccuuggagaugcauccaugggcuacuuagacauuugcccagccuacucaaagaauucccccuaccuuugaggagccccuagcugcaugcaugucuuugaacaacacugcccuccacaguaacagauaagacagaaaagacaagugacacuuacucugguuccaagggacuuuguccgugaagucuuuguuucuggggcuuucuggguuuuuaugaauucaaguuucaagauccugaccaaguaggaaguacucagcuuccugugugaugauggagaauuggcuccaguuucacagucuuucaaaaugacaagaaagggacaaaguucuucuuuuugugugguuuggugcucaugaauggccacaacgcccaccaguggccacuuccuggaagccaaguuaacugcgaggauuuucucugcucacucugagccucuugagucuuggcccugggagcucagccuuaagggaauugggggcaggugaagcugaguugggugagguggguggcagugagauguucccagaauguuug

SEQ ID NO: 16192 - RNA, 12088 nt, Homo sapiens
uuuuuuaaguuaaaaccuaacauuuucuaacuaacauucaugaucaguaacaauugauuuaauaagagaucacaaucuucguaaauucuuuuugcuuuucuuuguaccaggcaggggaccuauuuuacaacuggcuuugaggagcuugccaucugaacagucuuuaguaguaugauaauuacagagacacuucguacaauaaucaaauccacagccuucucguuugcagguugcccguuguaaauagcaaucauauuuugcaggugaauuacagcgaauacaggcuuugaggcuuucguucuuuuucaaugucuuggcaaccuaaaaagaaaaaaaaaacccauuaacaaauuucagcaagaauuacauguacuuuaguuaauaaaaccaaggacacccuugcaccuuccccaauucauguaugaaauaucacugucacacauacgauaacuacugcccuaacuauugcccuuuaucuaugcauuaucugauagaugcucaauaaaugcuuuuugaauaaaucuguauguugcauuagucauuauggcauaaaauuuaagaauaguuuuauuauguaggauuuauauuuacugaucaacaugaaucagaaaauauucuauaauuuugguaaguuaucuaaauuaagcuugcaaaguuaucuacauuugaguagaaauuuuagcacacaucauucacugaucugaagguauaauagaaggccuucaaguucagaaagcuugccuuuuuccacuuaacucucuuccucgguucuuaaaagcggaaaaugcaaaauguaguacugaguaauuuuauaagaaaucuagguuuuucauuauuucuucaguguuucuaaauuagaacucaaaaucacugaacuuucaaacaaugccaagcaguaccuaauauucauagaaauacauuucuacguacuuuccuaauuucauguuucuuuuguuuuccacauugagagcgaaaugaagaggacacuaaugaaaucccuaauaguucuaauuauacuauaauuaaauuuaaaugaucauuaauaucagguuucuuaaugucagagaauaaauuaguuauuaucuagagcaaaguuacauuuugaccuugaaaguucuuuuacauuucuuacucuaaaucucuuauguuuuaagauuuaugauuagacaaaaaauuaccucagagaauucauugugucgacuauaaguagaaccuuucugaucaccuugauuggauaacuugguuugagcaucuuuuuugagagaagucugggcugcugauuucugaacagaagccagugggguucugaacauaacauauucucugguugaagcaugaggugaaaauuuauuguuguuuuccuaauuuaaaaaaaaguuuuaauagaauuuagaaauuauuuccuguauccucaaugagacauuuuuauguuuguacauauaagaaaugacaaacaagauuagguaagagacuuaucccuacaugcaauuuaccugcacguacuuaaacaaagcaaaaccuaaauacucacacauaucaagccuaacuuauagacagaaacugugaaccaaauacuaugggaaaucacuuuagaugcagucuauaugguacuuaauaccuaaaaaguaaaacagcuuuuccaaauuuuccagauguuauaaaauacacauacacacaacuggcaacuaagauugacuaaauggucgacucuaucugagaaaugaguaauuuucccuuuguuacuuuagacauucuauuucuaggaagaauccaagaaauaaauguugaguugagauuucuuuauuuuugaaugugguuucuaaguuccaguauaaggcugaaauacuuuaugacuguaaagaaggguuuccagauuaccucuuuucuuuucuauuucuagaagagcacuaacagugcauuuuuaacuaaaaacaucaucugcaaacacuuacgguaacucuuuguauugcuuuacuguacaacuggaaugcccccuuaucaucuucuaggaucuucuuccaaguugugcucacuuuagacacacuggaaaaguaaaucaccauaaaugaaauaauuaaagcaucacaaagagcuaagaugaauacaguagaaaaacaucagcagugcaaaaagauauuuuauauuauuagugcuucucaaaccugaccacauuacaauugccuggcgguuuuaacuggucuaaaaugaagcucagggcucuguauuuuuaaaaagcucccuccucauuaaguaauucugagugcauugaggcuuaagaaccacugcuuuguacaguauuuuuucacaauaucugcaaacaucaaauaguagcccccacuguauauaugauaccauguuagcuaucugguaaaaguaauagacaaauuucaaaguacucuaggcacacugcuauuagaaaucaacuuuagaaacucacuauguuaacagaaaaaguagaaucugugguacugauuugacugucccucaagaagcuguuuaggcucaugccuguaaucccagcacuuuggaaggcugaagcaggcagaucacgaggucaagauaucgagauacccuccuggccaacauggugaaacccugugucuacuaaaaauacaaaaauuagcugggcgugguggcacacgccuguagucccagcuacucaggaggcagaagaaucacuugagcccgggaggcagagguugcagugagcugagaucgugccacugcacuccaaccuggugacagggcgagacuccguccccaaaaaaaauuaaaaaaaaagaagcuguuuauaucuguuuugcuuuagcucuguuucauaaagaccaguguaaacucacacuugcaaagaguaccucuagauaauuuuucaaaaagccaaaaaaaaaaaaacaacuccaguuaaguccuaucuaauucuagccugcauaaucaccuuaauucucaaaguuaucugacuaagugauuuuccuugguagauugagaaagaaauggugguuagcaccagguuucuaagaaauugucauaaacagagccugggagguggagguugcaguaagccaagauugcaccauugcgcuccagccugggugacuggagugaaacccugucucaaaaaaaaaaaaaagucacaaaucucuauuuguggaucuuuauauuuucaucacugucaaaucuaggagagcccuagcaccaaaaauggcuuagaaagaacaaaaauuacuucauacuuucuggugugacaagucauaaugccuauuagacauguagacuggaacuaggcuguuuuacaguuaagccccaaagauguaacuuacauauuagaaauuucaaaacuaaaaggaacaaggauccuaauccaacagaaauaguuuuguaauagcaugaauauaaaauuugaaaugacuagguuaaaugcauaauucaaguuuucuuucaucuuaguggcacauagguagcaaaacaccagcaagucauuaccgcaauuaaacaacauuguaagguuaucuacaacagguugagcaucucuaauccaaaaaucugaaaacuuuugaaugcugacaugaugcucaaaggaaaugcacauuggagcacuugcggauuuuggauuagggauguucaacuguuuaaccuguaggguauaauacaaauauuccaaaauuugaaaaacaucugaaauccuucugguacuaagcauuucagaugagggacacucaaccuguacaacagccuuugcaugagcuggugguacugagccacuaacagcaauguucaguguauuaugcuaauauguauauucaaaacaguacuuacuugauuaaguccaugucacugaguugugcuaaaauaguugcuaagacaugucugaguccccuucgaaagaguucgcugagaauaucuacacauucuaggcccauuuuucugccaauuauauucugcagucuaaaauuuccucuggcuauaauuuccuucagcaucucccgaucuacuuuaggauuucguuuugcauucuuuuuuaauguugaacaaaccacuuuuucaaaaugaagaacuggcagcaaguuuuuguugggauauuggucugggcuuuguauuuguagcaggcaggauuguagacugucaccgaaauucuccuccaggaggcuaccuucuucauguucacugaggccacuuuguagagaaaaugaggaauagccacugucuucauaaagucuacuggucucuagugcuucuauuucauuuguacuauuaagugucuguugcacauguugauuuuccuuguuaugcaagcgcuugcuuucaguuucaaguuguacaauccuagggcucacaaucggugacccaauacaugacagccuuucauagucuuuaaugcagucuuuacaggaaccuuccaaauaugcagggguguaggaaacuagucuuccaaugucaucagguuuuaccaguuuaaguccggaaugaacaugguuacaauuaaaaucacacuucauuuugacagaaaggguagaacuuucuucuuuacaaccuauaaaaagaacauaacauuuacaucuuaauggcaaaauuuccacacaucccuacuucuuaaauugggauauacaaagauuacuuugcaaucucucagcauuagguauugucuacauguacuugcuuacauagcugugauguuauucaaguuuaauuauugauaugacaauaauaugugaaaauauuacuuaaaucuuauaaguacauacauauuauauuauucuugagaaggcacuucagaacagacugcuuuuggaucugccuggcuguaacaccugacuguugucuauaacugauugaguaaaaaauaguggaaaaaggggcuauauaauaaacaucuguguuuauggaacaaaugaagaaaugugauguaucaaaagaguaggcgcuauggucaaaguuauccuuaaaguaaccacaaauacuuuuagauucaguguuuauuccuuggacuugaaaugacauuaugguucucuuugacguaagcacaacccaagccacugacagcaaaagugguuaagauuaguacaggaggacaagguauaagggugggaauaaucuugauaaaaauaauaaaaauuuuguguauuauuucacuauuaacaaugauugcaagccuuaaaauaacuauucaagaaaucuauagguagcuuggagaaaagaacuaauaacacauuuaaacaucuauaaauuaaagucuaccugaauucccacagcucuuaucuccaaguuuuauucugaugggugcuccuggugaccuucuaauauauucaaagcguuugucuaccuuacuggauaguaaacucgaguaccgggacaucucccuguaccuugucuaauaugugcuggaaacugcucuuuaaucacugaacaaagacauuccacgacuaauuuaccaaagaaccguaaguaugaauaguucugcuaucaaucaaaaguaaguguugguaaauaagaaugacacucuaaucaauuaaccagauuuaagaauaugagugauagggcagcagguguaaauuacuguucaauugcuuuaaauaacuuaagauaaacuugcuauuaaugauaaauagaaaaaagggaaagacuuguucaggguuuuauuaccacccugcuccaacccccgggaucuaagaaaucaguuaagacacaauggagcaggcagcaucuuaagauagcuuuaaagcaagauuucaccaucccugugcuacagacauuuugcagugaauaccucuuuguucucagggacuguccugugcauuguaggauguuaagcagccuuuacccauuagacaccaguggcagcccccacucccaagaugcaaugucuccaguuaccaguuauugccaaauacugggcagggaaaaaggccagaugcaaaauuuccucuauucuucaguugagaaccacaacucuaaaaaaugauuaggauuuugucagacaacaguggccugggaagggcauucacaauuugagcaacggcacaaugcugggaaggaauaugguagauggguucagaaaacuguuuagcauuguugaaggcagagaguaagaguaggcaaacaauggggacaugagcuaagaaagccugaaucuuaaaugccagguuaaaaugugccccaucuaccauccccacacaagccaaucauauauagcuaacaauuuauccuguaaguaaauguauacagcaucaguauguuuagucugcacuaaauauugguaaugcguucauauaaaacuuaaccauuuuuuacauagagcaaaacuuuuuaacucaaaguagaaauggauaccuucauagaaaguaacuuguagagagaaacugcuuguaaauucccaauguuaauacagugaaagacacauaguaugugcuccaggauccuacuaaaccuaaaauuaaggguucagcugcauaaaaagcaaagaauauacaaauucuagcucccuaauuaacccuaaaccuagaacaaaugauucugagugguuuaguuuuauucagaggaaaaguaaaaaaugccaagagauugccucuauuuuugccucaaaucaacuaaagaauuagguuugauuuauauaugaccacaauuuacaugacaggauaaaaaagcagaagccacuuaugaagggcacacucugcuuuguuuagcugccuaaaccaaaaaggccugaaaauacuucaggaauucaaagucauucucuuucugcugucuuuagaacaguuacugggggguuguccuauagaaccucuuucauucaacacuguucuuugaauauggacaguuccuuaaaauuagagcuaauaaugaugcaaauccuuuauauuuguuuagaaguuugcaauuuccaaugcuuacaaaccuuuugagguaggauggggaauuguuauuuuuacaauugagcacacugaaguguagcuuaguuugcccaauacaggcaguuaauuaaaugagccagauuucucuuccucauuauaaugaggugcucuggaaaaacagaucuuacaaauaacauucauacuguuuauaaaaaugauagaaaagucagaauuuauguugcaagcgcacuuaagguacuaaagaagaaaauguguacguuucuuuucucaugugagcuggcccuuuuccaguccuuaguaacaaugaccuuuccaucccaggggcuuuguacaucaugccuuucccugcuuagaaucuuuuccacuuccuuugcuuauuuagcuucuaauccauuaaucauggagagcuucauuuuuuggggggggggggggggcgggggacuucucagaccucaucaaacucuacucuaaagcacuaccaaauugaaauuuuaaaaaguacuuuaauuuccuuaaaggccagacauaacuguuacugcuuaugacaaaauccaagcaaauggcagugccugacacaaugaagacauaugauauaaaaauguguuucccauuuuuuuuuguuagcuaauaccaacauuagaaucuguacucuuccucacgaaauuagcacuuaaggaguuaaaaugacuaccacguuccucuugcaacaacaguauuuucacauggauaauuagauuuaguauuuagguaaggugcaguggcucaugccuauaaucccaacacuuugggaggcugagguugggggacugcuugagcucaggaguucagaccagucugggcaacauaaagagacuccaucucuacaacaauuaaaaaaagaaacuagcugggcaugguggcaugugccuuugguaccaacuacuagggaggcugaggcgggagaauugcuugagcccgggagguugaggcugcagggaguugugaucauaccacugcauuccagccuggaagacagagggaaacccugucuuaaaaaaaaagaaaaaagaaaaaaaaagguuuaguauuuuaaaagaauuuuaauaaacuuauuugaauucacagaaaagcugcaaggauagugcagaauuccuguacacccauugcuuaacuuauauuacuaacaguaaugcaugucacaacaaauuaaccaauauuguugcauuauuaacuaaaaucccuauuuuauguggacugcuguaguuucuaccuaaaaucuuuuuucuguucccgggucuuauccaggauacauuacauuuagucaucauaucuccuuaggcuccucuugacuaugacaauuuccuuguuuauaauuaccuugacaacucugagaaauacugguuauuuuguagccuguuccacaauuaggauuugucaaguuuuucucagccuuagucuggggcuguggguuuuuagaccagagguaaggugcuaugauuugaacuguuguuagccuugauuacuuggcugagguaguauuucugagcuugcuccaaauguaaaguuacuccuuuuuguucuuuuuccauuugaaacuuuuuggaaggaagucacuauguacaccucacacuuaaaggaguggggaguaaauuuauaaaucauuuggaauucuucuuuacagcagauuuguccauuaaucuccuauuuauucauacuaccaaucauuuauaucaguauaaacucauagacuuuggguuauaauccaauacuauuuacuguauugcucaaauuguuccagcuuuugcuauugugagcucuugcaguugacauugguguccauuucacauacuuaaaucauuuuguguuuugaacaucccuuacuuucugggacuacaagaugcucuaagugcaucuuauaauuuccguuucagcccuagaaucagucauuucuccaagcacugugguuuccuuuuuuuuggaaaaagguauuaaaugagagugaaaucuggauguugguuguagauuuaauuuuaaaauaugaaauuaauguauuuuucauuuccauaacaauacugcagaagaaauagaauagcaucauauuuuauaaaaauggaagcugaagcaacuguuugcaaaagguuaaauccauuccuuuuaacuagcuaaguguuuuccaaugaccaggccaaauuugggaaauaugugaaguauucauauaauuauuauccagaaagacagaaaacauuauauggcuucauaaccucuugaaugaaacagaugagggcuaagaguucaguugaaccauuucacuuauuuauccaacauccauucagugacaggguagggagagagaaagauauuaauuagggaugaucuuucagcaaagcugacauucugagaucugaacaccuuauggaaaucugguggaggaguuccagauggugggaaacacaggaagcaaggaaaaaugugaguguucaaggaagagaaauaucuguagggcugaguugggggagguuauugaaaauuauaguugaagaaguagaaugaucugcagauuugugggguaggcugggucaaaaguggagaaauuugguuuacauuuuuaaaagaucauuggcaauuguggagaaugaauugcaggaagguaaguagaagcagagagaauaguuagaaguguuuaugacagaaguagagugugggaaacccagacuagaaggauuguaguggaaaugaaaauaacugcauaaauucaaggucuguuauuuagaaggguaaagucaacuugcugcuaaucuacuagaucuggauaugaagaaaaggagaguaaaaaaacacccugggguuuaagucuugaguaucgaagguauacagugcuauuuacugaguauggaaaacugaagaaguuaacucuuaaaaccucacuuuccucauccauaaaaugggaguaagacaaugaaacaggacuaaaugcaaggcaaagucccuaucacaagggucuagucaauacaaucuauuuuuaaucacauaagccaaaucccuucauauuccuuacauugacaaucauuaacauuugaaaguaguaaaacacauuucacaaagaaguauauauuucagaguaacacauacuuuuccauuagaauguauagauuuaagaaucagauccaaguuugaaugaaaauccuugcuuagccuuuugacuagcuuugugaacuuggaauguccuauuccuauuuuucccccaagugcagacacuaauaagacucauacauggcauuguuuaaacuucucauuuaccaacucccagcccagucauauagagaaaaguaaauuuuacaauguuugaucuuacauuuaacuuuucaauauagaccugauccuccauaucaaauaucauaaauaaggcugcaguccuuaaaaaucuuuguaacucuucuguuaaauaauuaaguuccagucucuaauaccuacagauaacgaccauguggucaacguuaggcauggcuauuccuuaagaauuuaagaggcccaaugcuugugaccauaaaguaaucuuuaagagaaaauuuuacaaaagccuccuuugaaaacuacuuggaaguaacauauauguauuuuuaauuucaucuccucaaaccuguaaacuggggaaaaaauuccaacaggcagucauuucuuucugaggagcaagguaguaaagacaauuagaguuaucaaaaaagaaaaaaaaaaaacccucauaaggccaucaagcuucagaauuucgaugguagacugacgauccaggaucuucuagaaauauauuuaaucuauuaaaauuaaaauuaaguauuuuuuucuagaguucuuuuuuaauaauagagucauuacaaaauaguacaaugccgaauugcuaaauuuuuucauuuuggguuauuucucagguaaaaauaagugcauauagauuuuauuuagagguagcaacaaagaggauaaaaauaagcauuugagugcauuccauucucugcaagcuuugaaauaaaggacuaucuaauucuucaugaguuaucgggaaaaagucaccaauucuucgauucuuacaaaaucaucuuaauacuauggacaaauucaagguucguaguaaaaauugcuuuuuuuaaagucuucccuuuccacuccaggcccugagacuggguuaacgggcaaagggagaaaaaauugggaaaaaguaacguuuuuguuuggaugucccaguugaguuugguccaaugaguugggggggugucucuccauuuggcgggaguggggagggagacccuggaacuccugagggaucgguggggcugccccucagggcgcgggacacgcggaggaggcgggagauaaccgcgagcgcgaucucccgcgcccgccagcaaggcugggaccgcgaaaaaucggggaaacugccuuuggcugugagggugcggggcagauguagaaaaggggcgcagggggagaaggugaggcaccuggccaggcccugggggcuucucgcucgcagcccugucaccgccgggggccccggggugggggaggggaggggcauuuggcgccuauucaagcagggugggguaggugggucuuccgaggaggaaaaagggcgcccugggaugccacgacccgcaccucccggggcuggaguccacggucggcguggguggcgggaccccgcggcccgccaucccgccccugcacaucuggcucuucuggcuuccccccgacacccagccgcccuccucccggacccaggaaccgcugccgccgcccgaggccgggcguguggcauggccgcgcguccaggcuccgagggacgucgggucagggucucaggcugcgacccuccccgugcaccccuccuggcgugcgcgccccccucgcgaccgcuccccucacucacuauccgagggucgagggcgcccggcggcugucacugcgcuggggcuggcgcugcaggagcagcgggguggccguagggcgcagcugcaggggcgccggcucaugccagccgacguggagucugccucagguggaggaaccgcuccgggggcagcugagcaaccugccugcuucacagaccuguaucucuuaaaaggcgccagcugguacuuuuaaaaucuuugaauuuggugccuaaauccgcgcgguccaaugagacgcgucgcuugcaugcgcgcaccaauaggagggcagugggugggggcgcccucguccgcgcccaauug

SEQ ID NO: 16193 - RNA, 5179 nt, Homo sapiens
agagauuuaaagaauacaaauuauaauauuacuagugauuuuccuuggguugugggauaaugauaaccuugauuuucuucuccauucucaucuguguuuuccaaauguaaaaacaaaugaacaugucauccugauuacuuuaauaucacaauggauuugauuugccuuuuccuuaaaaacaugcaacagaaauaaugccuguaaguguaaugaagacuguuauaagcauuaaaaucauaacauacuugaacugagggagucaguuaugauuucagauuaaucuuccuuuucuucuagaugaagcaugugaugaaaguucuagaaaaacaugaaauucagcccuaugaaaucgcacugguacacugggaaaaugaagaacuuaacuacauaaaaauagaguaagcaacuuuucaucaaauuuaugaaaggggcacuuggaauaaauuagguaaagcaauagaggagacaaauuauuaugcauauggaaacuuuuuuuuuuuuuuugagacggagucucacucugucgcccaggauggagugcaguggcacaaucucggcucacugcaaccucugccucccggguucaagcaauucuccugccucagccuccugaguaagugggacuacaggugugcaccaccacgcccagcuaauuuuuuguauuuuuaguagagacaggguuucaccauguuggccaggauggucuggaucucgaccuggugauccgcccaccucagccucucaaagugcugggauuacaggcgugagccacuggaccuggccuggaaacuuacuuuuaagaaaaaaguggccaggcgugguagcucacaccuguaaucccagcacuuugggaggcugaggcagguggauuaccugaggucaggaguucaggaccagccuggccaacauggugaaaccccaucucuacuaaaaaauacaaaaauuagcugguuaugguggcgggugcuuguaaucccagcuacucgggaggcugagacaggagaauugcuugaaccugggaggcggagguugcagugagccgagaucacgccauugcacuccagccagggugacaagagugaaacuccgucucaaaaaaaaagaggaaaaagauuacugguacaaauacaaagucuaaaccauauaauaaauauuagaagauaaacauaauuuuuugaacuucucaggcuauccacaaguuaaaacaagucaguaguauagccccaaaauggaaauguuaaguuucuaaucagccuaauccaauaaaauaguaugcauuuaucaaaugaaccuaucaaauuauuccaguaaauuuuucucuuaauccaguuuuuuccuauugauuuugggggguggggguaugaaaaggaaguauagugaggggucaaucuaagagacccacuuguagaagugugggugcuggaagaagugggaccugguguaccaguuucacuaagauaaauggguaggcaacagacuagcugauuuuccugacucagccagagggaaaaaaugaagagauguuagggccgagacagaggcaguaugaacaagaugguagugucuuuuuccucauggaguuaccugucuagugaaauaugagucuuugcagguucuuaagaaagguaguguuagccagauuugguggcucacaccuguaaucucagcacuuugggaggccagggugggaggaucaacugagucaggaguucaagacagcuuggccaacauggcgaaaccccaucucuacuaaaaauacaaaaauuacccgggcauaguggcgagugucugugaucccagcuacuugggaggcggaggcggaggcagagaauugcuugaaccugggaggcagagguugccaugaccugagaucgcaccacugcacuccagccugugcaacagagugagacucugucucaaaaaaaaaaaaaaagcguuaaaagcagagcuuugggaagacuuggaagagagacagagacuagcuauagaaagaccagauggggauaagagcugaguaaucagcgcucaccaccaauagggccagucacgguuuucuaaguaagugccuuccauguauuauuucauuuaauccuggggaaaacccuauaauugcagcuaacuggcuuuccgaugagauuuauugaauccugucuugccaaagggcaccugacugugagucagccugagcccagugguggcugcagucagagguaaggauauaaaccugagagagacagcaaaugagcagccuguaguuuuauuaucuuuaguaguuacucagcccuuggccugcagauacagcuccugugaauccccuuucuguguucuauuagguuuacauuaaaauggcaaaaaccgcgauuacuuuugcaccaaccaaauacuuccauauccaacuacugcuagacccuuguguguguguguguguacgcuuauccacacacacacacacacguuacuguacagucugugaggaguaaaauccucagugcuuaggaucccagagucaguuauuuuguuucgucagaaagacuguccuggcugccaccuacaugguuauuaugugaguucugccaugauuccagggaucugcucagcucuguggcaugggcccaguuuacucauaaagcaucuugugaccaagcacaguggcucaugccuguaaucccaacacuuugagaggccaaggcgggcagaucacuugaggucaggaguucaagaccagccuggccaacauggugaagcccugucuguacuacaaauauaaaaauuagcuggaugugguggugcacuccuguaaucccagcuacucaggaggcugaggcaggagaaucgcuggaacccaggaggcggagguugcagugagcgaagaucacgccacuacacuccagucugggugacagagcaagacuccgucucaaaaaaaaagaccucuugugacugcugucuuugcuuuccuuccuccaucugaggcugucauagcagaugccgcccuccaucaggccccuugucccccucccuuuggccgucacuucuugucugacaucuuuugugaagguuuacccugucuuuuuuccauuugcuugugauguuuauauucacacauuccgcucuuccccuguccccugucuaggauucuccacagucacauacucauuuuucacaacuuccuugccucccuccccaaccccaucaugucagugugauuuuagauuacacuccauauauaguuuuauaugcagcauuuuuucacauagaaauuuacugugaacguucuccuuuuuauuaacuauccuuccaaaacacacuuuuaaguuuuucuuguguggagugacuauuacugagccaaccccuacugaacauuugguuuauuuccuaauuuuuuacucuuaaacacugaccuuuuuuuuuuuuuuggagacagagucuugcucagucucccaggcuggagugcaguggcgugauuucggcuuacugcaagcuccgccucccggguucacuccauucuccugccucagccucccgaguagcugggacuacaggcgcccgccaccacacccggcuaauuuuauuuuguguuuugaguagagacgggguuucaccauguuagccaggauggucucaaucuccugaccucgugauccaccugccucggccucccggagugcugggguuacaggcgugagccaccgugcccagccaacacugaccauuuuuuuaaaaguuuucagcugggcaagguggcucgcaccuguagucgcaccacuuugggaggccgagguggguggaucauuugaggucaggaauucaagaccagccuggccaacauggugaaacucuaucucuauuaaaaauacaaaaaaaauuagcugggugugguuacgcaugccuguaaucccagcuacuagggaggcugaggcaggagaaucgcuugaaccuaggagacugagguugcagugagcugagaucgcaccacugcacucuagccugggcggcagagugagacugucucaaaaaaaaaaaaaaaaguuuucuuguauacaaauuuuucuuugcaucuuagauuauuuccuuaggauaaacuccuagaaagggaauuaccuggaccaaaggauaugagaacauuuguaacacucuugauacaaauugucaaaaugaccuccagaaagaugauauggugucuuuuucaaaggaaaaguuaaagugcuuuuuaagauuuagaagguauuaucuuuuugcuuuucacaggggacagucaaaacuucacaggggggaaaucaaguuaaauucagagcuggauuuagaugaugccauucuagagaaguuugcuuucuccaaugcucuaugccuuucugguaaguuacuacugcuuaugggauaggguacuacaguugucauuucacugagggaaguuuaaauagucacgauuuugguauauuuucagaauacucaacaaagccuuagcauuccuuuuccuuuuuuucccuccaucagaaaaaauaucuaguauaaaagauaguacugugcugaaguuacucauuccuuauuaauuguauuaauaaagcuuaaccucuccaaaaguauuuuuuagaugaugauuauauuagccuuuguuuuuuucucuucucucuaugcgauuguuauucuuagauagucucuaauccagacagagaagcccagccuugugugacugggcacaggucccaguguagaaaaacauacucuaguguuccauaggaaugggacccagagucacaguggcuauaaguuuguucugaaagauccacaucccgaauaaaacuauacaaguucuuuaagaauuucuuuugccagcagucuaccuuagguggcugcugcagcguccuguccaucccacucugaggggcuucggagauuucugagguuuacucuuaguccugaggagugaaggggaggccaggaaagucuuagucgcgcccuaucugcagagcuacccaugguaucaagguguacccuacccuccucaguuuccaagauguaauacuagaaaaucaagaguucuacuaaauguagcuuuggucuuccaauagggcauggaaagcgauucaguuuccucuauccacuuuaauucuguccuuuaugauaauuaacuauucuuaaauuauauuuucaagguuuuaguacuuuuucuuaaacuauu

SEQ ID NO: 16194 - RNA, 3491 nt, Homo sapiens
uaggaaaaauuccuuuauuccuaaauauuuuggcuucaauauuugaaaucugcaaaagcaguauuucuaucugucaaaaugaggccauuaaguuuugauuauucaaaccuggaaugaagugugugugucuggggguagaggagaugauauggacuucacuuugaauauaaauuacguacuggguggagcaaauggauuuaaagaaagaggaacccugguucaauucuauuugccagucaaggugacucacuugaacaucugaaggccagcguaccuguggaaagagacuauuuccuggauuuucuucugugagucaagaugcuuaaaacccaugucuuuuaguaucugucauuuuggaguuguaagggaaaauugaguuuuaagcauaaaggaaaaagcaucuuaugcugugagaaaaaaauugacaucagaauuucucagaaagaacuuagugaauuuuuuaaaauuauuugacguuauccuugaaugacugauuucguuguccaaagacuuaaagaaaggaguuggaauuccccagacuuugccaaacugugggauggcacaauagguauugucaggucccagggccagaaugagguagagauuuuauguaguuucuccuuuguuaauaacauuuaagcuguuuucguucugauuugcauucuccugauuagugcaguuggucaaagcuggugcuagcggacuuggccagaugucuggagccauauaagcugauucugugugggagaugcuggggcugguuccugcccuccuuucccuuccuccuugcagacagaguuccauuuugagguggucacucucuuggcuguguguucgggguuuacagugacccacccuaaaggcagaggggcagagguggugcagagacuggucaucggucucuaggggcaaucaagguaauucaucucccuugucccugauaggcucggugcaaaacccaucuucuaaagggcagcuggccucuucuagcggggcagagaucguucagcuuugaccccuuuguaauuauggcaggaguccagggccccacaccagccacccuauuucaaucuccgcagauccuuccccuucacauugugaggcuugacaugucccugugaagagccgcaggcauggaacacuuugggaaaaucccuauucaggcucucacuggaaaaccccagacugaggguacaaaggcaauggauccuaagccuggguagagcagagcugggcgcugguggaucgcagagccugaagcgccaggagaaaccugcugguuacuuuuauuuugucuuuguagugucagucuagaaccccacacaggaucuucuccaucauaggaaaguguuccgaggaauuugacuugguaucuauuuuaucucugagaaacuucuuugaguagcugccaguaaccuuuagggcucuuuuauuuaaaaacaacaacaacaacaaacaaacaaaaaaaguucauggccaggcgcgguggcucacaccuguaaucccagcacuuugggaggcccaggcgggcggaucaugaggucaggaguucgagaccagaaugaccaacauggugaaacccugucucuacuaaaaauacaaaaauuagcuuggugugguggcgaaagccuguaaucccagcucuucaggagggugaggcaggagaaucgcuugaaccccgaagucagagguugcagugagccgagaucucgccacugcuccccagccugggcaacagagagacuccgucucaaaaaacaaaacaaaacaaaaccguuacuaaaagccgcuuacuuguauucauucggacgucucugugguuucuaucaguuccugaacaggaauguauuguuguguacaagaagaauauguuagugucucccuaauuuuacacaugcaguuuucuguuuacaacuucccuccccaccuuauuguccuaacccuucugagaagcuccuucauguguaacuacuaggcugugauguuuugcaguagagucaggcagugcuguugcccuccuggguggaaggggcuguuuggaaugggauggagagaaagcuggcagugcacgggacgcaacacuagaaaugugaaaccaggacccugucgccgacccucuuagagaaauguuuacugucuggaugcccccagacgccuugccugagcgccgucacgcuuucugcccuuuggauacgaagauauccgaaugcugugcccaugauuaagcagacgcuuaguaaggaaagaaaacauuggucuggaaauaauuucucaagcgccgugacugccuuauugcacaaacaucgccucuucgauguuucucacaauccagagaggaaguggcauccaucguggcaugaauaggaauguguguuuggagccguggggcggggcuggaggggaggggacgcuacccagccaacagaggagacgguggggcuaggaaaaccuccugggggagccugcggcgcgguccuuuccuguguccccuucgcugcggguccugcccggggccgcgccagguggaggccccgagaggcggcgcguuuccugcgcuccgggauugcgggagaagcgugagucccugucuccgagacuagaggccacggacacccgcgcaggagcauccccuggcaccccgccccacgcccguccuuccggagucuacacaucggcgaccucccgugucuaggcgcacacauuucccgccccgcggagacucccacgccccgggcccucucugccgcaggcgccagaucccgccucugggggcuggaccgagaggguccucggcggcuucuuuaaggcugcgguccccgccccgucguccuccccgcccuccucccucucgccgcggcuccucccgcccucccagagcagccgggcggcugggcgcgcgcggcgcagagcaggugccggggagcccuucgcaugcggcugccgggccggaggugguagcggcgccgggcgcgcuccgcccgccccuccuccgggccgcacugaggcucgggcgcgcggggacaugucgguggcgacgggcagcagcgagacggccggcggggccagcggcggcggcgcacggguuuucuuccaaagcccccgggguggcgccgguggcagccccggcuccagcagcggcucaggcuccucccgggaggacucggcgcccguggccacggcggccgcugcagggcagguucagcagcaacagcagcggcgacaccagcagggaaaagugacagugaaauacgaucguaaggagcuucggaagcggcuggugcuggaggaauggaucguggagcagcugggucagcucuacggcugcgagguaccugggcgcggggcugggagggucggggaccucucuagcuccucugugcccgcgcaguaauuuucccgggcuccagcuccggggcgcgcaugucccugacucccggggaccaagugccaggagcgaggcgcggcgccuucucucccccgcggugcccucu

SEQ ID NO: 16195 - RNA, 1133 nt, Homo sapiens
uuccccuguaaaugcgauguuucauuuuuaauguauaacaguuuucugaaauauuaccguuguuuucaucguauagguacauguacaugugcacacacagacacaugcauguguguaaauacuaauuuuaaaaauaaugguuacgaggacauuuacaucgcuccaguuggaguccuguccaauccugagggcgggucuaaugaggggccguaccuuccaagauuucacuccgccccucgacgccgcgcggcgcugcgcgugcgcaaacgccuuucccuggcgagccggaucucggagcguccccgcgccucuccgcggccgcccggggaggggagggcccgucccgccccuccccgucucuccccgccccuccccgucccucccgccgaagcuccgucccgcccgcgggccggcuccgcccucaccucccggccgcggcugcccucugcccggguuguccaagauggagggcgcuccaccggggucgcucgcccuccggcuccugcuguucguggcgcuacccgccuccggcuggcugacgacgggcgcccccgagccgccgccgcuguccggagccccacagguagggcagggcgggccuggcuggccgcuuuacgacuccgacucuccgggaggcccgggcuguccacagugacgcuucccacaucccaccggcgggcaggggcggggguccgggcccccgaaggagguguggggagaagcaccccaggaaaugggggcggcgugggaggccgagguaagaggaaagggacccacuggggcugcgucgcugugagugagccucgagccacuccacaccgacucuccggcggcccaagccggcgcgcgaccugacggggcuuugccgucgaagcgcgcgguugccggugaucaggccuucguaauggcgccuucccgggguagagccagcgcuugggcaaggaauguuugugugcucgggaaguguggaaguugcccacuucgcgcauuuccaggccacuugugccugcucggccugcgaucgcgaggguccgccguuccgaggcugcggggcuccgccgggcucaggugggcagagggagagaccuggcccucgcgcgacguaauguuuuugucggauguuggaggagaag

SEQ ID NO: 16196 - RNA, 94049 nt, Homo sapiens
auccacauuagaauauaaguuuuuuaauuuuuauaaauaacuuaucuguuacaaagauaguuuacccagcuaaaucacaaaaccaucaacucaagauauccaaauuacguuuuauuaauaaaacaaguaaaaacugauuuaucaaucuucacauagaacugcagaugaagcugaaaaacaaggccuauuuuaaaaauaaauugcaucaaacguaagggcuuugggucuaugguuuaauuaccuaggauugucauauuucuucccauauacaaaaugcaaagccugaaaguuagggcucugacauucauagagaucaacuguaauaaucccauuuaaaacacagccacuugcaaacauuuacagugggugguagucuauauuaucuuccauccuuugcucuauuucagcacuucccuuagccccauucuaagcacucauauaauuucauaauucugucuuuuuaaaugcauacuguucuuuuucuugauuucaguuauauacauuccugaucaucugaauauuuuccuuacaaaaauauaucaucaaaauaaagagaugcuugagguugcuucaguguucaaguuugcuuguuuuuuuuuccagcuuuucuucaguuguccuaaauauggcuagccuuguuuuauaaauacacaugauacugucaccaagucaggauuagaaauggacugccccaacaguaaagcauuuaaacuucucuccaaaaaaagggcuguagguacugcugcuguugcugguuuugagacuguacuuucccaauaacaacugcuugugcaaguucugugggacaccaagcagaugaagcuuaaccuuguuguucugucaguggguuaaaaauaucuuuuguuuuaagcuucccuguggaagacaaacacuguguugugucacccacugcucaagucaguauuuaaugugaccuacagacaucacuucuguaauaucaucugcaauucacugugcagcaucugccugucuucacacaacauuggaacucaugagggcaaaguacagaauaaguagaggaaaguuauucugugcauacuuucaucucauuaaugcuuuuuuauuuuaaggcauuguuccucucagguaaggcuuaaaaagggacaugaucgugcuuaauuacuaaaaggaaaaaagaaaauuaguuaacaaaaggcuauuacacuauacauauagaaauauaagaaaauaaucaagaagaaaagaaaucacuuaaagcagacucgagagaucuguacaguaggaaaagcuuugggguauuucgcugcacauuuguacagacaaugcaugcugcuuuccuuugcaucuuuagccccuagaugcuggcuucacagaguggagacacguucagggaagacaaagacaaggccaagaguaccacagauuucugaaguucuucccuauccaauggcacuaugcggcagcaaaugguucuuaaauaguuaaaccuuguuccuuuucuucguguauguaguguuucacugaaagcuuuacaaauaaaacaagcuaucauucuauuccuuccuccugucaaaauucaguagugacaugaggggaaaaagguauugggaacaccuagguguuaacauauugagaauuauccauaaugggacacugguaacacuguacacaguuaggcagugggcaaccaagucuuucagcagauuacuuuucaugugaugaauuucaacugcucaugacauuauacugagguauuauuagcucugugggcugacauuuaacauuagcagaacaccaucuugucacaccuucaauuugacaaaauccuauguagcagugaaacuuuuucccgaugacagacuaguuucuugaacuuuagaugugguuuuagagaagauacagggccauuuggcucagaaaugccuuggcaucucacacuguucacagcgaauuaaggcuggaugguucaaaaaaguacaggcgguacaauuccacugagcucccucaucaucuucugugucuugagucuuugguguuuugaugauggaccuuugaucuguaagaaagaaaaaaauuauuuuauaaguaaaaaaucacaaagucuaaaaaauuacaggcaacuuuaaacaccauuuguagugcacagccugaugcagcuugcuccccaaauggggcaucuagcugacacugacacacaugcucgaucacuaccaaccucuaucuaguuggcacuucucccucugggaaauacaacaugaacaugauguaaucaccuccaaucuccuuaaaggagaaaacagcaucauuaccuacaauuuauaguagaauaaaggguaucuaauagcaaagauucccauaauaccacucaagauuguaaaaagcuguccuacugcaaaacaauacugucaguguacauaagucucauuagaguuucguuucccacugcaguaguauuuauauucguuuucuaccagaaagggcaguuuuuuuugucaauucauguucuccaucugccaaaaauguaagccuuggaugacacaaauaaaauauaaacuaguaucuaacgucuuauccacagacucuggagaaguaaaucuauguaaaaauuuuaccauacuuuauuuuuaaaaaccacauuugguaugguaaaguagaaagaacacuagaauugagaguugugagaauggaguucuguuccaggcucugcuacuaauuccugaauacuuugcucugugaucucagauaaaucauauacauucuaggucucuuuguuucuuacuuauaaaauaaaggucacuggaacucuaagagaccaauguucuagaauguuuauauggauagugguaucuuaaauacagagaauaauuauauuccucaaagguuaucucuaacaagcgauuacauuuauaaaacuacuuaaaaaaauuugggucccauaaugaaauuagaacaguauuccuacaaauuaauuuugggagguuuaaaguaaaaggagcaugcauuguugaauuuuuccugucaagguuauuaauuugaagaaucaaaccuauguuaaaacaauguauauuaauaugcaaauuccaccuacccuacugauaacuuuucuauuuuaaaagagagacuauuguaacaaguaaauaaaaauacagaagucaaauuuuaugacaaauuuuaaauaauuaagugauauuugguacuuuguaccccuuuagcagcaccuuucuuacucauuguacagaaauuuucuugcuaaguccucaacuuuagguguuggcuuuccauugucacaauuuuugccacaugcacaaccaacuugaaugguguuuauacaguauuuuccccaaacugaauaauuuuaaaacaaacaucgaauuaagucuuauccuaaguaaaaauaucuaaaaaaaucaagggucugacaauaccaguuacuaugcccugaaacaacugaaaagaaauacaguuuaaaaaacuuuugacuuuuuaccacguaaaaucaucucacauuccacaucugggaaacauuuuauagaauaauuguuuuaaucuggggauccauccuacuuacuaaaauuuuggucucaggcauuagaaaacauuuucaccugacacguuuuuaguaaaaccuuguugauucuguuuaacugcaaagguuaaaauuuuaggaagagugaccauaaggaagucccuuuuuacacuucaauguauuauuaaaugccagcaaauuuuugauuauuuaaguaauaucuaaggcaaucaauaagggaucuauaaaauuuuucuuaaaugaaaaaucuccagugguuuucuuauaaucucacuugguaaacuuagaauuaugauuuuuuuuuuuuuuaauuagagguguucggaaacuaaauaaccaaaauuggaaaaaagaggaaauuagaucacaaacaauggucuaaacacauuuaauuuuagcuguuaaaaaaaucucuacauuaugaagcagaacugacuucaaggacuaaauuucuauucaugaaguuaauguguauuuuagcuuuauugcaaaaaauuauugauuccuuauuucucccaaaacagccagcauacaaacuucuaucuuucauguaaaaacuuuuaaguaauggauguuuuuauuggaccuuucuuauuacagaaaauuucaaacauauauaaaaguagagaggacagcaaaaugaaccuucauauacucaucccacuucaacaacugucaagaccaauuuuauuucacuuaugugaaauaacagauuauuauuauucugaaguaacagauuauguugaagcaaaagaggaaacuuuucauaagaaaaaauucuuauuuuucaaaaaggguaggaagauuauacuaaggaaaaucauucagugucugaaaaacacaucuugcauauuuuagaguuagugcuuauaccgcugucaucucuacugcuuuauucaauuaacauccaaauagcaucuagucucugaacauuugcuuacugugucaaaugcccuaaucucacucucauccucuguaauaacuuuucauuguauuccagcuauauuuaaaaacauuuaaauaaaauaugaggacagagcuacaccuaauuauacauaaaaaugaaggaggcugggcgcuguggcucacgccuguaaucccagcacuuugggaggccgagacggguggaucacuuuaggucaggaguucaagaccagcuugaccaacguggagaaaccccgucuguacuaaaaauacaaaauuagcugggcgugguggcgcaugccuguaauccaucuacuugggaagcugaggcaggagaauggcuugaaccugggaggcagagguuguggugagccgagauugcgccauugcacuccagccugggcaacaacagcgaaacucugucucaaaaaaauaaaaaauaaacaaacaaacaaacaaacaaaaaugaaguagaguacaaaaauuagaaugugaaaggagaaugugaaaauucuuguaacaaacuaaagaccaguaauauacuaguucuuccuuguucccauuucuuuuucuuuuccugcaauaaaacuuuauugacaaaaacagacggcaggcuggauuugguccaugggucacuguuugccagccacuugucuaaaacccaguuuaacaugguauuccuaccaguauguagacaugugaacaacugccugauucauaaaauguccuaauuuuguuuuucucaaccucuccuuuuccuccccuacguaaggcacugaauuucucaaugacaguaaccauacauuuuuuuaggguguccuguucagcuucacaggaaaaauguacauuuuccuauccauaauucauacuuuccuaguccuacaaaccuuaauguuucuuaugaaggaagaaguaacacaaauaauuuuuaucucugaagacauuugaaaauacaaacauauggggaacaaauuguaagucuggaguauuuauugcagcauacuagugaggaugauguaacacuaugagugcugaccugauucaccacguguuugcugacuuccagaauuugugugaaugaaaacuuguuuugcugucuuuguuuuguuucccccacaacuuuauggauguauagcugacaguuaaaaauuauaagcuguacaacuugaugauuuauguauauacugugaaaaacuuauuacaaucaaguuaauuaacauauucaacaccucacauagcuuaucuccccaccccccaccguggugagaacacuuaagaucuccuuuagcaaauuucaguuauauaauaaacuacuguuaacuacagucacacuguuguacacuagaucuccagaguuuauuuaucuuauauaguugaaacucuguaccccuucgaccacaaucuucccauacccucuucucccagccccugguaaccaccguucugcucucuguuuccaggaguuugauauuuuugaauucuacauauaggugagauaaugcaguauuugucuuucuccggcuuaugucacuuagcaagacauccuccagguucacccauguuaucacaaaugacaggauuuccuucuuucuuaaggcugaguaauauuccacuguguguguguaucucucacguuuucuuuauccauauacagaaauuuauguuguuuucauauuuuggcuauugugaauaauacugaaaggaaaaugagugcagauaucucuuugagauacuuacugcauuuccuuuggauauaugcucaguagugcgauugcgagaucauacaauuuuaaaguuuuugaaccugcaugcuguuuuucauaauagcugcaccagcuuacauucccaugaaaguguacaagcguucucuuuucucuuuguccucaucaaugcauauaaucuuucaccuuucucacaguaaccauuccaauaaguuuguaaggugguaucucacuggguuuuaauuugcauuuuccugaugauuagugagggugaguaccuuucaauauaccuguuggcuaucuguauacuuucuuuugagaaaugucuauucugguucuuugcccauuuuaaaaucugguuauugguuucuauuacuauugauuugcaugaguuccuuauacauuuugaauauaaacccuuuaggaguuaaauaguuugugaauauuuucucccuuucugaaggaugccuuuucacugcugaugauuuccuuugccguguagaugcauuuuaguuuaauguaaucccacuugcccauuuuugcuuuuguuaccugugcuuuuggugucauauccaaacuaucauugcccagaccaggucaagaagcuuuucaccuauguuuucuucuaggaguuuuaugguuucaggucuuauguuuacauuuuuaauccauuuugaguuuauuuuuguauacagugugaaguaaugguucaauuucauucaucugcaugugaauauccauuuacugaagagacuacccuuuccccauuguguucuuggcacgcuugucaaagauaaguugaccacagacacauggauuuauuucugggcucucuauucuguuccauuggucaauaugucuguuuuuaugucaguaccauacuguuuuacuauaacuuuguaauauuuuuaaaaaucagggaaugugaugucuccagcucuguuuugcuuacucaagauugcuuuggcuauucagggucuuuucugguuccauauaauuuuagauuuuuuucuguuucuguaaaggaugucacugguauuuugacagggauuacauugaaucuguagacuaauuuggguaguaaggauguuuuaauaauauuaauucuuccaauccauaaacacaggcuacguuucuauuuaucugugucuucuuuaauuuccuucaucaauguuuuauaauuuucagcguauuccuaagcacucuucuucuugcuauugugaaugggauuguuuucuugaucuccuuuuuugauaguuccuuguguacagaaacacaauugacuucuguacauuguuuuugugucuugcaauuuuacuaaauucauuuauuacuuuuaacaguuuuugguggagucuucaggguuuucaacauauaugaucaugucgccugcaaacagauaauuuuacuuccuccuuucugauuuggauaccuuuauuuuucuugucuaauugcucuggcuaggugauauaguuuggauguuuguccuccccaaaccuuauauugaaauguaauccccaguguuagaaguggggcuuggugggaggugucuggguccuggggauggauccuucaugaauaccuuggugcagguuucucaauaaugagugagauauugcucugaguucaugaaagaucuggcuguuuaaaagguguggcaccucccacugucucgcucaccauaugacaugccucugcuugcuuccuucacuuucugccaugaauaaaaguucccugaagccucuccagaaacuaagcagaugucagugacacgcuuccuauacagaaagcauguggguaucggugacaugcuuucugcagaacugugagccaauuaaaccuuuuuucuuuauaaauuaccaagccucagguauuccuuuacagcaacacaaaaauggauacuacauuagaacuuccuguacuacguugaaaauaaguggcaagaauggcacccuugcuugugccagaucuuagugggaaagcuuucgguuuucuccauugauuauauuaccuaugggguuuuuauauauggccuuuauuaaguuccuucuauauguguauguguauguguguguguguguguguguguguguguguguguauauauauguauauauauguguguguauauauauauauauauauguguguguguguauauauauauauauauauauauauauauauauauauuuuuuuuuuuuuuagacaagaguuucgcucccguugcccaggcuggagugcaauggcgugaucuuggcuuaccgcaaccucugccucccagauucaagcgauucuccugccucagccuccugaguaccugggauuacaggcaugggccgccaagccaggcuaauuuuguauuuuuaguacagacaggguuucuccauguuggucaggcuggucucaaacucccgaccuuaggugacccacccgccucggucucccaaagugcuaggauuacaggugugagccagugugcccggccugagaguuuuaauuaugaauaaaugcugaacuuuuucaaaugcuuuuuagcaucuauuaagaugacuacaugguuauuccuuucauuuuacuucaaugugugugcuguaucacauuaacugauuuguguauguugaaccauccuuaagucccagagauaaaccccacuuggucauggcguaugguccuuuuaaugugcucaguuugguuugccaguauuuuacugaggacuuuuugcgucuauguucaucaguaauauuggucuguaguuuucuuuaguuguagugucuuugucugguuuugguaccagggugaggcuggccucagaaugaguuuggaaguguucccccuucucauuuuuggaagagcuuaagauggguugguauuaauucuuguuugaguguuugacagaauucacucaugaagccauccaguucuggacuuuucuuuguugggaauuuuuuuuuaaauuucuaaauccaugcuggauauuuguugggagauuuuugauuacugauucaaucuccuuauuuguuauuggucuacucagucuuucuaauucuucuugauucagcuuuaauaggugauaucaauuuuuuuuggauauuuuuuggauaggaauguaucaauuuuuuucuagguuaucuagucuguuggcauaaaauuguuccuaauauucccuuaugauccuuuuauuucugaggcaucuguugucuucauuuucauuucugauuuugucuccuuuuuuucucaauuuaucuagcuaaggguuugucaaucuuguugauuuuuuaaaaaaccucuuaguuuuacuauuucuuuuucuguuguuucuaaauucucuauuuuugcucuaauucuuauuauuuucuucauuaugcuaacauuaggcuuagcuuguuguucuucuacugguucccugagguauaauugagaucuuucuuuuuuuuuuuuuaauguaguauuguuuaucucuagaaacuucucucuuaguacugccuuugcuucaucccauagguucuaguaugcuauguuuuccuuuuugucugaagauacuguuaagauucccuuuugauuuccuucuugacucaaugauuauucaagacuguguuuaaauuuccacaaauuuuaugguuuucuugcuguuacugauuucuaguuuuauuccacugugguuagaaaaaauacguggaaugauuucuaucuucuuagguuuguuuaaacucguuuugugaacuaacauaugaucuauccuacagaauguuccgugugugcuuguucaaaucagcuguuucuuuauucauuuucugccuggauauucuauuauuguaagggggguauugaagucuccuacuauugcugucaauuucugucgucagaacugucauuauuugcuuuacauauuaauguagucugaugugggguguguauauauuuauaauuuuuauauuuuucuguggaauugauccuuuuaccauuacauaauaaucuuugucucaaguuuuagacuuaaaaaucuauuguuucugauauaauuauagccacuuuugauuucuuuuagcuaccauuuauauaaaaucuuuuuccaucccuucacuuucugccuaugugugucuuuaaauauaaaaugagucucuuguagauaguauauuauuggauccuguuuuuauuuuuauuucauuuuaaacaaaaaguuuauuuaaauaagaagccugacuugaaggaaaaacuuucuaggauucuuucuuuuuuuuuuagaguaauuuaucccuacuuaaagacagauugcccuacauguaacagcuauguacacaaaaguuauaaaauuguccuugguuuuacaaugauaaaugaaaaacaugaaaauccuccaauugaacaagguaugugagaauuuuuuuuuguuguuguuaaaacagugagagcaaaauaacuuacuagaauauaaagauaagaccugaaugaacaugccacuaauggauaaaggggguauuuucacagaaucaguauuuuuucccauccugucuccacuugaugucaaucaaaacauaccauuggcuguuugguuugaagaaaaaagcaauaugcuuguguacacauaccaguuacuucauguauaauaaaagaauguggaagggggaaacaaaagaauagagaaaacuauacuguaguagucagaaugugguggaaccaaauugcaguuuucuaauugagaaugcaguaaucuuggucuuuaaagaacagcguucuggaguaaagaagcagguucccuuuucaguagacaccucccguaggcuguugaaacacaucaauuguaucuucaucuuccauuuccaacugugcagguuugucuguuccacugauugguugcccaccaaaucggaaucugaucugcuucacugacaauccccgugguucacaauaggcuuucauuaguuuacuaaguggugucugccucuuaaucuuaaacugcaccacagaaccauccugucccgccaccuucaaauuaauaugauuguuguucucagucuugacuucuucugugggcuuuucguuggccauggugaacaccggagucuccucagcugcugcuucacaaaagagguggcggguccgcaccuaacgaguacacgagcagcaggaagagcagcaggaggugacagcgguggaugagggagagggugcgugcacauccugggcucccuccccucccgcugugugcgccagcacgagcuguuggggccucccauuggcugcugccagauccuguuuuuaaaauccauucauacaacuccuugugaguggugaguuuaauccauuuccaguuaagguaauuacuaauaagugaggacuuacuauuggcaguuuguugcuuccugucuauuugacaacuguuuugcuccucuuuuccucuuauugucuuguuauucgacaacguuuaaucgugauuuacuuugauuauauuugguuauacucuucuauuuuaaguugauaacaacuuaacuucaaaugcauacaaaaauacuacugcaucuuuacaaccuccacccucccacacuuuuguguucuugcaguuuucuucuuuuaauauuauguauccauuaacacauuuuuaccuuuuaacuuucuuauuagaguugaaaguaaauuauauaccacgguuaaguguuaaucuguaaauaugucuauauuuuuaccuucagcagugauauuuauguaccuguuuccauuucuacacacauuuuaaugccuggaucaaaacacacagacauacuuugaaaugucuuaguuuggugugcauauauucugagaauaucaaugauguaaaaugauagaagguagaaaacuauucaccuggaauuuaggguauuuugauuacuuaaaguuauauauaaauuaaacuaaauacucauggggggggggaacuucccuaagguaucuuccuuaucauuugucuaaaguuuuaaaugauacaaauuuuuguacuuaguaauuguuuuuuaaccaagacuugcuauuauugguugggaguacauaguguuuccuaagcucgugcauauuacuuuuaaaaagcuaagaauauuacaucuuugcauccuucccaaccccaagcauguaaaugaaaauaagcaaacaucuucuuaaugaauucauuuaagaaugccaaaguuugaagcaauucuagagaggaagguugcugaacaggaaaaauuuucuaaaauuuugcuuuucaaaaguaacaguuuucacauuuaauggauacacuaaccuuuggguuuugguggcacaggaccuacaaauccaauauugucauaaaaguuaugaauagcgcugggguuaaaaugugguccugaaauauauaaaaaguaaauauaucaaugcuuauagcucaaaaacaacuuuacuuuuuaaaacaaguauuucuuucuaaaaauaaacacgcuauaagaaaugcuuuucauuuauuuugccccucuaaccucgaauuauauguaagauuucaaaacauauuucaaauauauuaucuuagguauaauguaguacucauaaacacggguaagugguaaacugugaaagaagucaaauuaaugcugguaagacauuaauagaaguagaaguagaucccuguucuauguggcaaguuaaaauaacuuaaaauuucacaauuuaaaauguaauuuuaaacgaucaaacauggacuuaaguaacuaaacagcuuuaccucaaguaaauauaaaaaccuugcacuauguaauagaaugguuaaaauuuuacacaaaaagaguaaguucaaggauuguaguuucuagaacagcaccaacuuuuuagaguuaaauuaugguauuuuucuaugaauguuuaaagauaaauagcuuaaucaacauuuaaaaagaauaaaaauaaaaauaaucaucuuccaguugaacagauucuagaacacagucccaagugugauuaaagacuucucuuuugguuagauuccuuccccuuccugucuuuuccauuuuauaucuuuuuauuauuuauccaacuucagaauuagguuuaagugauaacauuuccuuuuaguucucuauggaacugaauuaaauuguaaacauuauuuacuauaagaaaacauugcuugucauuaauagcucaaguauaagaaacuaucauugucuaaagaauguauaaaccuuauuuuuacuaucuucuauauuuuaucaguuaagauagugccauugagaugggggugacuuuuuaaauauauucuuaaaagucugucuggcuccaaagccacauguucugagacaguaagauuaugauugauaagucuguuuuuagccacagaaaaacugcuggugaauuaaauacgaugaauuucagcuacaaauacacugaacuuuaccucgggcuugaaaaagaucaauuucuuugguuaagcagucaaugucaaucuggaguugucuauuacaacuucucagcugcugcauuucuucaagcugaaaaauaauucuauguaaguaagauuugcacugaauucuuagucauuaguuaauaaagaauggaguuuggcacaagaaaguaaggacagaaaaacaagaguuaagaacaucugaagaaaacuagauagagauauuacacuuauguuagauggccuacucucauguucaagcagagaucacaacaguuacauaaagacuuacggaagguaucugggauauagaauuugaucuuuucaggcgccuucgaguuagauuauuuuccauuucauuaaccucagauuuuaauuuauccagcuuuuucuuuugaaucucaaguucucuuugaagucguuccauucuggccuucugguguaccaaaagagcugcaacacacauuaguaaacaugaggacccacccacuuuaaucaauuaaccuuuaagcagacuuggaaaagcaaacaagaauuugucagaaaucccaaagcuacauuaaaacaaaauauuguaaguuuaggcauuuaaaauuucaauuuuuuuuuuuuuuugacacagaguuuuacucuuguugcucaggcuggagugcaauggugcgaucucggcucagugcaaccucugccuccuggguucaagugauucuccugccucagccucccaaguagcugggauuaugggcaacugccaccacaccccacuaauuuuguauuuuuaguagagaugagguuucaccauguuggucaggcuggucucgaacucuggaccccaggugauccgccugccuuggccuaccaaagugcugggauuagaggcuugugccacugugccuggccaaauuccaaacauuuuaacugaaaaauuguuuuagucauuuaaacaaaugccacuuuuuaaauguuuucuaggauuuggagaaauucacuuuaugaaugaagacagcauuuuuaggcuacagcuucucuaaagguuuucgucuuuucaguuaaccuacuuacuacuguaucuaauucacaucuacccucggaaaggacaagcucucuuacuucagaguuugucauguuuggucuaugaaugaagcauucuaauaugaaaauguuauagauauuuuagaagggaauguagaauccauuuugauguaugcaacaaauaaaacaggcagauugauuucacuccacauaaauguuaacauuaaauuaucccaauugccacuuauauuuuuguauauucagauuauauuuugugaaaauaucuuccaagaucuuuaaagaaacaaaauaagcaaucaauccugcagcaugaacuacuugggaaaccauaauaaacuacaaauacugguauauguuuuugugaucugucccuggacaugaaucucauccuuuaggauacuggacuggaagugaagauacuugaaucuacuuuuuauaaagaaacaacaugggaugauucuaucuugagaaaaauaaagcagauuuggaaaagaacuuuaaacaaccucuagaaauaaaagucacugaaaugaaaaagccaaacagauuacaguagauuacauacaaagacaguuggugaccugucagauagauguaagaauguuacccagaaugcacagauaaugugacagaaaaaaugaaagaagaguucugaaaggucucacagacaucuaagaaaaaaauuccaggcugggcaugguggcucacaccuguaacuccagcacuuuggggaggccgagaaggguggaucaucugaggucaggaguucgagaccagacuggccaacauggugaaaccucguuucuacuaaaaauacaaaaaguugccgggcguggugguggaugccuguaaucccagcuacuugggaggcugaggcaggagaauugcuugaacccgggaggcagagguugcaguaagccgagaucacaccacugcacuccagccuggaugacagagugagacuccaacucgggggcggguagggggagacagagagagaaaagaauuccagaaggagacaacagagagaauagacaagaggcaagaugugaagagauauuggcugaaaauguuucaaaauugaagggaaaaaaggaaguaacaaauuuuagaagauaaaauaauuuguucaccuaauuaaauuauacaagaauacaaaugaauaaagguauuuccaacaaagucuggggaaauucaacaaucacagauagcugcugaaauaacuacucaauauauguucugauaagaaggaaauuaaacacaaaagaauggaauaagaugaguaaaucuaaaaaaaaaaagcucugacaauaaaacaaaggaaaagacuauggcagggcaggggagcagcagacauugucuaaaacaaagugaaaauaaaacauuggaaaagaauaacaauacacuggaagugcaaaaaucagaggugaaguauucuaaggucuugaagguauuuaagaagaauacaguuaaauguugcuaagccaaauauacauguucaguauuuagggaucugugcuaaaggaaguuaaaacagaaugugcaguuucuaaauucaaagacagaaccuaaggagaaaugagggaaauuuaauuaaaccuagauagcaggaaaggaggggauaaaggaaagaaauacaaaacaaaaaccagacagggauaauuccaaauauacuagaaaucacaaugaaugcaaccuaauuaaacauaucuguugagaugagaucaguagacugaauuguaaaaccucagcuauaugcugcuuauaaaaaacacucaaaacauaauuaacuuaucuauuauuuuaauaaguugagggucuaugugucagauguuguuguaggcauuuuggaaguccaugaacaaaauaggaaaaaauccuugcccuugcggagcucacguuaccacgguagcagagauuggggccagggaguagggcaagagaaagacucuaaacaaaggguaaacagguaggcaaacuauggcccaugggccaaaucuagcccacugccuguuucgucauuaaaguuuuauuggauacagccuugcucauuuguuuacuuguugucuauggcuguuuccauuuuacaacagcagaauuaaauaguugugacagagauuauguggccuacaaaauccuaaaugauuacuaucuggcccucuaccagaucacguagagccuugcugaccauauuaaggacucugaauaaaauggggaucuaucauagcacagacagguucaaaauaaaaggacucaaaauaaauaucuugcacuucaggcacuacucuaagaagcauaaaguaauagcagucaauugcuggaaguaucugaagacuguggugcacugaaggcaacaacaaaacccaaacccagcuccacuccugacuaaauugaugcaaugccucauaauaauaaccugaaagaaaaagagauguccucauuucugggugcaaauaccauuuacuuuagucuccucuguuccuuuacacauaguguguggcauucaauaaaaaauuaugagacauacaagcaggagaaaaauguaauucaucaucaagagauaaagugaucaacagaacuauacucaaagaugaugcagcuggaauuaccugacagaaaacuuaaagauguaacuaugauuaauauguuaaaggaucuaguuuaaaagguggacagcaugcaaaaaaaagauucacaauuugaggagagagguggaaaucaugaaagggucaaaugcuagaaauaaaaaauauggcuagaaauaaaaaauucuuaucagagauaaagaauuccuuggacagacuuaacacacuggacacagaagaaucagugaacuugacaacagaaauuacccaaacugaacacaccaagaaacaagugaaaaaaagaacaaaaaaaacuuaagaguugcagaacaguaucagucuauguguaacuggcaaaagaggagagaaaaaggcaggagaaauaucugaggugauaaagaccaaaaauuuuccaacauuaaugaaauacaacaaaucacagaucuaagaagcccauagaucaccaaauaaugcuaaaacaaaacaccuagacacaucacagucaaagugcugaaaaccaaagaaagaaaaucuugagggcagcuagaaaaauuucauauaauuauuucagaaaaaaaucugacuuuagggcaaaacauaugagauaaagauguucuuuacuuaaugauaaaaggaaaaaaugcuaguaugcaacucugcauggaaaaucauaaaaauaaucuaauuuauuuuccaacaaauacaucauaaaguauacauuccaggauaagguugagcauucucccagucacagcuccaccagcaauccccaaucccauauuccuaauguuucuaucaaaacaagcaaguaaaucauagaguuugagagauacacagaaggccaauauuaguaggagacagacuuuaacagcaggcagaaaucugauucaaugaugauuuaggagacuugaaagagccacaguugcuacacauaugguugugagguguuuugagguuaaagaguaaauucuucagaauauuucugaauaaguauugcauccuuagaaauucacaaagggguuuugcaauggcugaagauguggcuuaccucugagaauaaaggcaaaguaucucuuaugauuagucugaagcucuaaaguaaaauauugcaaauccauuuacaauuacuuacaacuuauuuaugaggcauuucuuuccacuuuaaacaaaauuuuagaguuauaaugacuauauuacuuagaaaugacauaccuaguugguugacuugucuagguauggcuguuauaaacaaacuaaaaaugcuaugaauauacuaggaaagugguucucuauuucuuagcaauuuuuucuucuaaguggcugaauuuuuauguguuuaguucacuuuucauuugugguuugagauuuuuagauaggaaucugagaaagaugaacuacagggaaaaaaggggucaaagugaauuucuaaaaaucgcuguaaaaauucagcuaaagucgaaacucuucucuagcugugaguuuugucugcaaguuuaaccuugaguuuacaaaauaacacccaauauuuguccauuaugaaacaaugugauuagacucauuaugaaacaauguuaguagaucauuaaacagcagagacacuuuugcucuaauuagccuccacuaaaugaaaaaaucuucugucuccugaaaccccauaaaaaugagguaugaaugaaaaagguacaauccaccaacaauuaagaaaaagaaggcaauuaacucacaacagaagucaacaaguuucuggaaggcuagaagcagaugaaaugacagcugaaugaaggaguggagaaagcugaagucucauggacaaggagggugcuguagacaaaauggcaacucaucugcccugcagaaaccuugacuuuggaaaaugcagguaacaacagaaggcaggaguuaggaaagggccagaacacagaggcuuaaguagcuaucuguauaucgaacagucaacuucucuccauccuaaagggaagguagcuguagguuuaaggaucaccucauaguugaagaaaaucugauaugaaggcagguggaucauuugaggucaggaguucaagaccagccuggcccacauggugaaacucuaucucuacuaaaaauacaaaaaucagccaggugguaguggcgcgugccuguaaucucagcuacucagaaggcugaggcaggagaacuguuugaaccugggagguggauguagcagugaacugauauugugucacugcacuccagucugggcgacaaagugagacucuguccacccccgcccccccgcccccugccaaaaaaaaauaaaaucugauaugaaugugaaaggucugcauaaacaaagaaaaaaacuaaauccagauuaagugaagacaacauagcagagagacgagaacuuaaauucugauuaauaucauuaagagauuuuaagacacuauuguacccauaaaacaacaaccuuccucgaaaaggaaucagagaacuagcucuuggaaauuaaaaacaucacugccaaaaugaaaauuucauaugugagucggaaaaaaauuuaaggaaaucuccuaaaauguagaauggaaagacaaggaggggccggguaugauggcucaugccuguaaucccagcacuuucggaggccuaggagggagagucauuugagcccaggaguuucaccagccugggcaacaaacggagaugcuguuucuacaaaaaaauuaaaaaauuagccaggcaugguggcgcgcgccuguagucucagcuacuccagaugcugaggugggaggaucauuugagccugggaggucgaggcuacagucagcugagauagcaccacuguacucuacagccugggcaaccgugacacccugccccugccccugucccugauacccccaagaaagacaaagacgugaaauauacugaagauguaacgagaaauagauagaaagcucguucaggauauuaaauagcuaaacaagaggaggucuagaaggagacaauggagaaaccauaguggggaucagaaaagaauuucccagggcugaagggagacacuagccucuaaaauggaggaguccacuaaaugugggacaggaugauuaaaaaaaaccccuacaccauuguaaaauuucagacuacuaaagacaaagaaagaucuuaaaaauuuccagaaagaaaaaaaaguagauuacauacaaagguacaauaaucauauugacaccagauuuccucagugauaaggaaaucacuacauuuuucuguggagaaaugauauucaaccaagaauucuauguccagcuaaaaauaugaggggauuuccagauauuuaaggacuuaagagaauuuaccucccaagucucauuaggaaaauacuuaaagacauguucuagcaaauugaaggcauaaaccaagaaggaagauaauauaagauccaagaauggcgacuguaauuuauaacagggaagagaagacuccaggaaaaaugaacagaugguaucuuggagaugcugaaaggauaugauaaaggcagagaacaacaacaacaaaaauuaaaaauuccaaggaaaacagauaaaugacugggcuuugcagugaacagaugaugaaggaauuacagguaaagaaaaaaauauucaguaucuuuuaaauccucuuucaaaguuaaauuuuaauggauaaagguaauuuaagcaugcaacucucucuuaguuguuguuaaaaauaagugaguacuaagugaauucaagcaccagggcucuuaaaccacugcuauaagcauucuaaaugguuuauacagaaagcucaguacuuacccaacuuuuguuagcucacgaacaauggagaaaauuucuucguuacucaauuuuauuugaaauuuaaaaaacacucuugaaguuccagaugguguuaguuuuauuaauuuuaguuauuuuuuuacuguaaauaaugucaaauuucuccagaaguuuaaaaacaaaaacacgagaauuugcuuacugagaaaagacauaugucauuggaaaauauacuagggacuuguagauacaaagauuuuaggcuucuuuaaaugaaaaaggaaaaauuuugcuauugaaaaaccuaauagguacuuacuucugguaucuuuuuguuuuuugucuguaaugacaauuuuacaugucuaaaucaggaacaagccuaagucauacuuaagucauuguaccuaggaaaguacaaugucagcuucuaaaauaaaucaagauuuuucuaggcuguaacuuuguugacaacaggaaucacaucuguuuuauauaucacuguauuaccauagucacuuauuuggugacugagucauaaaagauucaaagauggcaauuauaacuuuaaagcaaacuuuuaaacuauuuugucauuuuuaaaggcaauuugaaaucagaucuuguaacagugcugcaauugggcccauaauuugggcaauagauguaaaauaaaaguaugaggaaugaugcuuaaucucuguaauuauuuuuaagaaccuacuaagagaugaauuuuagucauuuuagcauaacuggugagaccucuugcuagauaauaauuugcuggccuuuauuuuacauaauuaagauucugcauguaaucuuacagcauuaagauauaaucuaaaacuuuuauuuuagacagaaugaaaacaggccuagaugcaccaaaagagccucaaaacaauauaacuuggaugagucauuaugcgacgugggagugauuauggcuuagaaagguuuauaccuuuuuuuuuuuuuuuuuuuugacacagaguuuuacucuuguugcccaggcuggagugcaauggcgugaucuuggcucaccacaaccuccaccucccagguucaagugauucuccugccucagccuccccaguagcuggaauuacagguaugugccaccacacccagcuaauuuuguauuuuuaguaaagacgggguuucuccauguuggucaggcuggucucgaacucccaaccucaggugaucuacccgccucgggcucccaaagugcugggauuacaggcaugagccaccaugccuggccagauuuacaauuuaaaagaggauauguucaaguuuugaagggaugccaugagaccaguucaauaugguuucaagguaauacuaaagagaaaauaacgguaagauuucuggggcugggugcaguggcucacagcuguaaucccagcacuuugggaggccgaugcggguggauuaugaggucaagagauugagaccauccuggccaacgugaugaaaccccaucucuacuaaaaauacaaaaauuagccaggcgugguggugcaugccuguagucccagcuacuggggaggcugaggcaggggaauugcuugaaccugggaggcagagguugcagugagccgagacugcaccacugcacuccagccugggugacagagcaagacucgaucucaaaaaaaaaaaaaaaaaaagauuucuguuauucuuuuuucaaaaucuuggaauauggaaaggcuuucuaaauaagacacaaaacccagaagccauaagaggaaauucugagaagucugaauauguaaaaguaaaaaauuuauaaggcagaaaaauuuuauugacuaacuaaaagguaguaacaaaguagaaagaauaggcauuuuacagaaauaggcaaguucauaaggugagaaauacaaauggcuggaaaaagaacacaugaaaagauguucaaccucaaucguauuuaaauaugcaaauuaagcucccaagaaaaagaugaaaauuuaaauaaccuaaagcaacaauauauuuuuaccuauuaaacugacuagauaauacuuuuuucaaccaccuacaaaauaugaugaguggggaaaggaaggaggaaagaauauucuuauaaauguuaccaaaaauguuacccauuuguaaguaugggagcauaaacugguaaaaucucuuuagagagagccucaaaauugaaauuggcaacauuuauuggcagucauuaguguccuuccccacauucuucuggcucucugucucccagguaugugguagaacugugccucccuguuccugcugaauuagguguggcugugugcuuuguuuuagcuacagaguaacaugcguugaggcagaggcuuaaggagccacugcucacccacuauguuuccuuggucauggaagcacagagauggagcuucccuuaaccugggucccuuggugagggugauggagaacagaggccaccagcuaaucuauaugggacaggaaaugugagcuagaaauaaaucuuaguuguuuuuaagacaugguuuguuacugcaacauaaccaagccuaaaugauacaucuaucaaaauuaaaaacacauauauccuuggacacagcaguuucacuccuaguaaucucacagucugccaagauacuuggacauggguacaauuauguguacacaaggauuuuuauugcagcacuguucauaaaaacaagauuagcaacuacuuaaggucuaucaagaauggacugguuagauauuaugguacacaauacuaugcagccauuucuuaaaaagcagauccugcugacauggaauucucucaaagagauaaagacaaaaaaaagagacauaauccuagaagaauacaaaaugaacuguuugagaaacuaguuaucucuagugaggggaauuuuucauuauauacccuuuaguucuguuuucaguuuuuuaaaaaagcaaguauguaggaaaauauuuuaaugcaauuccuaucagaauuccaguugacuucuauguagaaauugacaaacugauucuaaaauuuacuuagaauuucaagagacucuaaauagccaagccuaucuugaaaaagaaccaagcaggagaacucacaugucccaauuuaauaauaaaauaauuacaguaauuaagaccauaugguauuggcauaaagaacauauagaacaauggaaaagaauugagaguccagaaaugaacccacgcauuuauggucaacugguuuuuuacaggggugccaaaaucacucaaugaggagaaaaagucuuuucaacaaauggugcugggauacuuggauagccacaugcaaaagaaugaaguuggauucuuacuucaugccaugauauagaaauugcaucagaauggaugaaagaucaaagacuagaauauaagaacuaauauuauauaacucuuaggaggaaaaaauagggguaaaucuuuaugaccucaccucagaguuagaaacuguuucuuaggacaccaaacgcaagagcaauaaaagaaaaaauacauagaguuuggacuucagccaaauaaaaaacuugugcuuaaaggacaccaucaagaaagugaaagacaauacacagaaugggagaaaauugcaaaucauggaagggacuuauuucuagaauauacagagaacucauacaacuuaacaauaaagaugaauaaccuaauuuaaaaguaggcaaaggauaugaauaggcauuucuccaaagaaaauaugcaaauggccaguaagcacaugaaaugaugcuugacaucauuagccaauagggaaaugcaaaucaaaaucacaauuaaauacuuugcagccacuaggauggcaaguaacacaaagucagauaaaagcguuguugaaaauggggagaaaugaaaacccucacacacagcuggugagaauacaaaucacuuuggaaaacaguauggcaacaauuccacugcugaaaagguggaaaaaaacaaaaugucuauuaacugaugaaugaauaaaugaaaugcaguguauuuauauaauggcauauuuggccauaaaaaggaaagaacauguugcugcuauaccauagaugagucaugaaagaucagauuccauuuuauaucacguguccagaauauguaaauuuaucgagaaagaaaguagauuagugguugccuagugcugagugagggugggggguaaugggauagggaggugauagcuuacaggauaugagguuuccuguagaggagaugaaaguguucuacuggcugggugauggcugcacauaucagugaauaaacuaaaaacugauguauacuauaagucaacugcauguauauuaacuauaucucaauaaagcuguuaaaauaaugacuaaacauuaaaaaauuuuaaagaauaauagauuuacguaacuuaauauauuuaagaaaguguacuguucucauuuagugaaugucagacauauuguagaguaugugcauauuauauaaucccguguguucacagacccauguguauaguguguuccugcuuuaagaacaguguguguauacacauauauacacacacguauguguaugugaauauaaagggaaugaauauaaugggaaggggaauauaaugggaaggggauugagugaaucuaaugggaaggggauaaguaacugcuaauagagaauaccucucacaguuaaauaagggaaaagcuggaggaagugacaagucaaagguugaaaagaaacacauuuuuauugcauuuguuuuuuaaaauuucuuuuacugaguguguuauuuucauaauacuuuuuaaagguauuaauuuaauguaagaaauaaccagcuaguagguagagcucuccaaaaccagaauaugcuaccuuaggaggcaguuugugucucauaagaauuuaaaguacagaaaggauuuacacuugauaggcuggauggguacguggacuggauaaccuuuggaguagaauucuucaugcccuuuaaagucucuuccaauucugacauuuaccccaaauuaaaaagguauuuagucuuaagacugggaggaaccuacaaguaguagggcuaauuugaaaaaaauauucuguaagugguccaaugucaacuaaucuuaauugcugaguuuauuauuguuauuuuagagacaaagucuugcuacauugcccuggcuggucuugaacuccugcacucaagcagucuuccugccucagacucccgaguagcucgaacuacaggcaugugcuacugcaguaggcuuuuauuuaauaaagugauuucaaugucaacaaagaauaacaaaaagguauuuccaaugaaaagauacauaaaguuaaacaaaguacaaguuuuagaaucugaacuaaauaaaauuauauuuccuuuugaagaguaucuugcucauugaauuugugccacaauaaacauuuuuuauuaaaucucauuaaaaagaaacguguugugauuuggauagauguacuagugaaaaaugguaaggaaugagaaacacaaaguccaagaagcuaauuuucaacucauaauuuuucuuacuuguauuucuauuuuagguucaaagucaaggcuacugcuuaacacuaugguaggacuuuaaacauaacugaggaaaaaccauauuaaaguaucauuaaaaauauuuaucauuuuauauauguaauuuuuuuucuuuaaauaauaaaaaguuuaccagcuaagucaauaccacagauggaguuguguggaaauuguauuuggcagcaauguuaguuuuuuuuaagaguuucuggcuucuguaacaaaauaagaaaguaggccuuuuucucuccaccaugaaaauuuguuggaaugcuuuguccuccauaccuauaaaaguugccaguguuacaacagguauaccacuaugaagacacuagaaugucucagaauaugcugaaugauaguuuucaacauuuuuuggaagcuagaguugggugguaugacuuaaggggaaaauguagcuauaucugaccacugacuaccaguaagaaaauuucacuucuguauuuguucuuaauggguaaaauaagaauuuucuucauaucuauaaacuuuaaacugaaaauuucucuccaaccuuaauuuguucuuuccacuuuugucucugauuccuguaguaccuuaaggaaucaaguuuaauuuauuuccuuuaggaaggaugguggugcugacagacuuagugcugagaugaguggggucuugauguuucauuaauuuacuucuuuugcuucugaucacucuauaguagaggauguauuaaacaauauaccuuucauaaacaaauuuucacuuuugacaguuuuuaucacaguauuuuagauuucaaaugguagauuaaaagaaaaaagaaaaaaugcauuuugguuaccaaauuuauguauguacguauguucccuucucaauuuggaaaaaguauuuuccuaugauucuagugccuggcuccacuuauuuuucuacucuaaaacaguauuuccaggagcauuagaaaaaucaauuucacugcagaagaccgagauauuucuuuucuuuuucuuacccauaccacucagaguuuagaaaagauccuugcuuaaagaucaggauuacucaggccaccccguuuaguaacugcagagagugucugugaacuauguaggguaaaagcagaaaagaugcauuuuccagcaaaggccuccuuugucuugaauuaagugaaugaaacacuagaucaagauugugucacugagcuaggugcgguggcucacgucuguaaccccagcacuuugggagucugaggcaggcggauugccugaggucaggaguucgagaccagccuggccaacaaggugaaaccacaucucucuuaaaaauacaaaaacuagcugggcgugguggcaugugccuguaaucacagcuacccgggaggcugaggcaggagaacugcuugaauccgggaggugaagguugcagugagcugagaucgugcuacugcacuccagccuggaugacagugagacucuaucucagaaaaaaaagacuguguuacugggugauaggucaaucuggaucaauaccaguuccauaguaaacagaaacaaggagaagaaaaguuggagaacaguaccaaucccaaaacagugugcacacacagauaaugcaaaacuauguagucaaacaaauguuauaaaauucuguauguauguagguauguuuaaagguuguuagagcuuuaaccuccaucaagguuguuagagcuguccgaaggcuguuaagcaauuugaggggcagauucuggagaaaccugcuuucuugguaggcuuuaauuuaagcucucaaaccacagacuucucucaucagaaaguuuuuuuauuuuuacuuucagguguccucugaaagugcucucuacuucuauccaggguguuacuuuauuguuuagaguucuuucuuuccuuuuuuuuucuucuuuauuuuuuugagacggaaucucacucuguugccaggcugaagugcagugguacaaacucggcucacugcaaccacugccucccagguucaagcaauucuccugccucagccuccugaguagcuaggacuacaggugcacgccaccacacccagcuaauuuuuguauuuuuaguagauaccauguuguuucaccauguuggccagcauggucuugaucuuuugaccuugugauccacccgccucggucuuccaaagugcugggauuucaggcaugagccaccaugcccagccuuaaguuauuucuacuuguuguuaucuauuuacuguguuaucuuucccuaugguugccuuuuuuuaauuaaugguuuuuuagcuacaucccucucaaauugaggcacauguggcccccacaguguuguaccaugggcuauaagugaagcuacaagauacacuuaaaauaucuuuccagaggguuuauuaugaaaaucuggaaagaaagacauuauaugauagugguuaacauugugggcuucucuaacuuccuaguuagaauuuuuuuuuuuuuccuuuagacaaagucuugcugucacccaggcuggagugcaauggcaugaucucggcucacugcaaccucugccucccgggcucaagcgauucuccugccucagccucucgagcagcugggauuacaggcgucugccaccacgccccgcuaauuuuugucuuuuuaguagagaugggguuucacccuguuggccaggcuggucuugaacuccugaccuugugauccacccaccucggccucccaaagugcugggacuacaggcgugagccaccgugcccagccucuaguuagaauuuugacucugccacuuguccuuugacaaguuacuuaaucuaucuguucuucaauguuuuagucuaaaaaauaauacuagugcaaauaaaagggcccuaaaguuugccuucuauguuuaaggaagagaguaagaaggccaggagggcuggaacacagugagcaggugguaagcaaaaggaaaagagcuggggggagaagcugcucauccuguagggcuucauagcuuuuauucugagugcaauagauagugaucaugugcagagaagugauaugaucugaugcauauuuuuaacaguaucucccuggaugcugaguugaaagaagacugcaaggaggcaaggacgagaauggguaggucacugcaauaauccauuugaaaggugaugauugcugagaccacaguagugaugaugggggaaguaagaagucacaggccagguguggaggucacgccuguaauccuagcacuuugggagacugagacaggcagaucucuugagcccagggguucaagaccagccugggcaacauagggagacccugucugcaaaaaaauacaaaaaguuagcuggauguggugguguguaccuguaguccagcuacuagggaggcuaaagugggaggaucacuugagcccaggagguugaggcugaagugagcugugaacaugccacugcacuccaauuuggacgaaagagcgagacccugucccaaaaaaaaaaaaaaaaaaaaaagaauaggaggggaauugaagauagcaaguuuaagaaacacuuuauuuucacauucuaguuaaacaugaauaucuuuuuaauaucacuaaauaugaaugccuacuuuacuugaaaauuucccuuaucaaauuaucuucauaaaaaauuugcuacuuaagaaucagcaacuauccaaccauaggaaaccugauguuuugauggaaggacaggaagagaaggugacuuugggagaagaggagaauuaaguuguaaguggaaaaaauaauagcauauaacauuuauaaacugcugaaacuaaacaaaaaugguuguaguuaaucacagauauauggaaaauaaaaguuuuaacacaauuucuagggcaauugaaaucacucauguaccccuaaaaugcacacacacaaauacaugcacacgcauaccuaggauucacuuuacuuaaguuugggcagagcccugcguacuuuauuuuugagauagggaucucgauauguugcccacgcuggagugcaguggugcccugcaaccucaaacuucugggcucaagcaguccucccacuuuagcuucugagaagcugggacuacaggcgggugccacugugcccagcugauuuuuuaaagcuccaugaaugauacuggaauucgaaaggaccacaacccagcuuggacuaagaaucacuaguguagcuguuuaaaacauaaaauaaggcaaagcaauuaggacccccuaagagacucagcaguaaaaucacuguaucagaaauguaaaaaaggaugaggauauuagugacaguaggggcugcaugcugccugagggugauguuauaguauuuuccaaccuacagcugauacaugaaaugauucacugcagauacauauaugacuaagauaugcccuuacucuaaaaggcucaguucaucuacaaacuggcauaaauauucaagaaaaugaauaaccuccaccuucuuaucuaaauguauuuauuuaacaguccuacugaaaauuauguaacuuaagagguuagauaaaacauaugacagaaauuucucuauuugaauuaauauagacauaauguaguaugccaauaucaaauagucuauuucagaaaaggauaaucaauugaaagauuugaaaauaauguccuuauaauuccauguaaaaagaaauauauuaaccaacauuuaagggagaauaaaagggacaaauaucaggaacaagauucaaacuucucuuugagguaaauuauucuaauacuuacgcaguaauagacuuaauauaaaauaagacuaaaauguuguauuagaaaaaugaagaauuuccccccaccccagagaagggucucacucugcugcccaggcuggggcagagugguauggucacaguucacucuaaccuuugaacuccugggcucaagcaauccuccuaccucagucuacugaguaacugggacuacaggugugugccaccaugccugcauaauuucaaaaccuucuguagagacggagucuccauauguugccccagcuggucucaaacuccugggcucaaaugauccucccaucuuggccucccaaagcacuggaauuacaggcgugagccaccaugcccagccaagaauuacuuauucuucaaauaucuggucaaagaaggcaaauuuaccauauuagucaagagagucaacuaguugcuuauuaaaacguuauuucuaggaauuuuuauuuacagaaaauuuaaagagaaagucagcaucaccacagguauaagauuaacugaaaagaaaguguuauaaacauuaacaaaccaacuaaccagauuugguuacucugaagagcugauaacccaauuacucaaacuuccaguuuuauaauaauaaaauaaaauuaaaauuaaaauguauauacauauaauacucucaaauguuacaauaacaucauuuggggcaauauuuaaacaaugaaauaacaaugcuaacauccauuucuguugugaaaucaaaugcacaccaacaagcccagcauggaaaaccaucccaccuuuaguauucauauuaccuuguguguaggcagcaucaucagaucccauacucaguuuccguguuucacuuauucuauccacaugugcuaauguaggguccgugaggugcugaauauucucgguuucuacauaaugaucaggaugauuaagaagauuuguaaguucaaagguaggggacaccaccccuggugaaacugcagggggcuuauugggagagacuguaauuuugaaaguguauuucguauugggcugagugacuaccacucgaggagagguugcagaguuauugccuauugcucgacuuuugggaggauggugaugaauaaaggcaggacccaugcucacuugcccagacauguuccuggaggcagcagaugcuccagaguuuguggauaugaagagugugggcugauuccgcaugaccuguucaucuccuguggcagcauucgcugaaauauagaccuuagguugacuacgggacaucagcucauccguauuuggggggcuggcagcuauguaaacagugggcugauuucuguuuaaggucuggcuauugacugaagaggaagugcuggagguucgagguccagaagaacgcaguuuugaagaauuauuucuuuguggggguucaaguuugauuucaaucugguuuuuucgagguccuguugaaauauucugaauguuauauuggcuaugggcagaagacugugagcuaccagaugaaugaaugguuggugguugugaaguaguaggugaacugauuggcauguagacaugagaggucugguggccuugcugauuuggcuguugagaugagguaugugacagaggauuagaugcaggacaaguaguccagggaccaggcugugaaggcugauaaacuugcugaggguucaugggauuaaacugagauacccagccagaaugcuguugugucugucgaguuguaccaccaggaguuguaauguaaggccuaauauagauagaauuucccuguggacuguuaaguacagguggagguacaccauguaugugcaaagauguaggaguauuacgaccagucuggauauuuggggcuaaaguuaccauaaugggauuaaaucugggaguuuguugagaaaggcuagauguuccuuugcugccuaagugaaauccaagauguggugcugaauuugaagcaccagaggaacuggacauuccaaaaacauuaaagccuugaggaacuugagcuggugcugucuguggcuccugcugaaauaguucacuauuggacuggccaccuugaaguuguccaucacuaaugcugugcguuagaguccuacuuccauucauccuacuuccuucucuuccauggugguaaauguucugugauugcaaguccaaguugagagaagucaugugauugcguagaccagaaauuccagaaucaucugaaaaauucaagucuccuucaccauaaagauaucuuguacucuccugagagagaacagcacagcaggcauccagguuauuauuauucuaugaaaacaaaauaaauugauugauguuaacaaucagaagcgaaugcuuauauuugcaucucuacaaauacaugauuaccaagugacuggcuaauacaauuauaacauauauuuggauauuuaaauuugagaaguuuuuuuaugcaaaugauugaauuaaaaauccucacuacuaauguaauggaaaagcucucucugacuaacaaagugaaucaaaucauuguuccacuuuagcagcuacaauggauacgaggaguaaaauggauucagacagauauaguaaaauuauaaccuaauuaaaaaggcaauuuuaauguugaacaaaauauaaucauucaacuuaaguauauaauacuguauaaucaaacauuuuuuaaaaagcuaaauggaaaaauauucuaucaauguuugauauauagcacaauguaucaagugcuauacacauuuguuuaaacuaauaaauguuuaaaaaguuacauuuguagcauuuaaaguucugaaauucauaccagucaucucaauccuucacacgcuuccucuuaacuuguguaaucccucucucucuggaggcucaagguagccuccagaagaacuagcuccuaucucugccuuuagauaacaucauaaaaaucuacuccagaguggcgggggggaaaaaaaccucagauuguuuuuacgcuuguaaucccagcacuuugggaggccgaggcggguggaucacgaggucaggagaucgagaccacggugaaaucccgucucuacuaaaaauaaaaaaaaauuagccgggcgugguggcgggcgccuguagucccagcuacucggagaggcugaggcaggagaauggcgugaaccugggaggcggagcuugcagugagccgagacugcgccacugcacuccagccugggugacagagcgagacucugucucaaaaaaaaaaaaaaaaauaaguuacauuuguagcauuuaaaguucugaaauucauaccagucaucucaauccuucacacgcuuccucuuaacuuguguaaucccucucucucuggaggcucaagguagccuccagaagaacuagcuccuaucucugccuuuagauaacaucauaaaaaucuacuccagaguggggggggggaaccucagauuguuuuuaaagaauucucaaaagauacuaacuaaccaguagucauaaaucauccacgaaaauguuugccaaacacauacuauaugcauagcacugugagccuguggaagaaucaaagacauauaaaaccaaacuuuuccccuagaaagggagacaaaccacagauuucugaaaagguaacaugaguacaugccaaauauuaagugguaaugaaguucaauagagaauuaauauuguaggcuaccgaagaaaggacugaguuaaugaggaagguauggccugaugguuuucauagaauauguagaacuugaacaacaacaacgacaacaacaacaauucuuggugaagagaauggcacgaguaaagaagaauauaaaggugagaguuaaguaaaagcauguuccaaacaagauggcuggaacagaucuggcuggagcuaaauauuuguauugaaaauguuguugaacaaauuguugcaaaagcagauuggaauuaaauaacaaaggaguuuugaaaaauaagucacgcuagaguuugacuguauuauaagcaaugaggagagcuacugaaaguggaugaacagagaaguaaagacacaaaggguauucagggaagagaagucuauugauacuuaagaugaauaaaaagaugaaaaaccuuuggcaagaugagcaguuagaagacacaaaguaacgagaguuugauaauggaaauaaauuuuaaaauaauauaaauugucaacacaauuuggccacaagagagaaacaauucaaauaagccuggaagauuaagaaccugacagaaaggagaguuuuagacuuaagaaagaugaauaaccaaguuaaaauguccacaggcaguuugauaugagauaaaaaucauauuaagaaagaaguggacuaaaaaggcaucuugaugccuuguuaaggaaaugacaguucacauuguuucaacagguaauauaaaaggauagugagcaagguuugacuucccccuuccuaaaaccaacaacuuaaaccucucaugguagaaaaauccuuuuauccuacuaauaacucuuaauugauacauacuaauuuuucaaauaaaguugaaaaacugaucacaaucuuuaucaacgauuccuauuauaauuagaucuuaucuuuugccaaaccugauuggcccuuuuugcuuuaaguuaaauuuauugccauuccaaguaaauucuucuuccuucuaagccaaagcucagagaguuuaucuuccucucaccuccucucugucaucauucucaauuuaaaauuuacauucccuaccaaauccaauuccacauuuccuuuguaaaagcuugauacucauauuuagccuuccucuuuaauucucuugagcgcucaaaaauuccuuuaauccuuuguaaucucuguaauuauucaauauguucauaucaaaaagcaauauucuagcucaguuaugccauaauuuaugugcacucaaauuauuuacacucuacagacauuacuuucuuaauagcaaaacauaaaagaacuuacagggguuuuauaagguuacauuaggacaaaaggaaauguacuuuuuauuaaaauuuuuauuuuagaaaauuuuaaacauauauaaaagagagaggaaauaugauaaacucccacauacuuaucacccaucuuuguucguuugauguauaugccucagcuacucccccuaccaaacuagaugaagucucagacauuaucucguuuugauuuguaaauacuucaauauguacuguaagagacaggacuuaaaaacauaaccacaaugccaugaucauaccuuaaaauaaucaauucuuagcaucaccuaauauucaaauagcacuaaauuaaagcauaaaaaugucuuuguacaguuaguuuaaaucaggaucuaaauaaggccuacauauuucauuuggcugauaagccuuuuagguuucuucuaauaaccagccccuccccucuuuuaaaauuuuuucuagccauuuguuuguugagaaaacuugguauuuguguaguagaauuuccccuauucuggacugcaccccguggucaaucaauuuccccugcauuucauuguaaacuaguaguuauaucuagggaugugaugaaguccauguuugaauuuuuggugaccaucacagacauccacugucaaaucauacaaggagacacagcaauguuugccugucuuuuugugauuuuaaaaccaacugguagauucagauguugucagcuugauccaacugaugauuuuuagcagcuauugaugaucacugcuuagaaacacuauuucauuaggggugcuaaacaguaauacuggaaugucccaauuauaagauuuuggccaggcgcaguggcucaccccuguaaucccagcguuuugggaggccaaggcgggaugaucgcugggcccaggaguuugacaccagacugggcaacauagugagacccugucucuaaaaaaaaaucuuguuuuuaauuagccagguagaguaggacaccugcagccccagcuacucagaaggcugaaguagcaggagcacuugaacccaggagguugaggcugcaguaagccaugaucaucccacugcugcauuccagccugggugagagcgagacccagucuccaaaaaacauaaaauggauuucaucuucauucuuagcagcaauucuuccuugaaugcuugcucucuucaacuauuugguuacauucugcacagaagaggcaggauaaaaaaauucuuuucacuaguuuucagaguaacaaauuuggucccuagcaaccuccaaaggugacuaugauuuauuuuuaguaucauuauaaacucaugugucuuuaauauuuugauguguuucaaucaguuuuggucauuauguccccucuucaaguuacugggaacagcuucaaguuggcuccucgguauacgacaugaauccaguaguuuuucaaagcuucucugcuuucugauaugacaagauguucuagcuuaucauguacaucuacuccagacuugcaaucagccauuucucaaagcagcccugguuacuuuuagugagaaaggguagaagacucucuugaaguguaucaaaaggggugggauaugaguuuuuagaagguggaaaaucacugcuuuuugguauacagccacaaaucugcauucuccucaaagcuauaaaaaggucugaaucauuaauuccaguuccucuuucauuuuuccccaaacuccugcacagacacagaaauuacagauaguaucaaagcauauauacccuauggcauucauucacuccuuuaaccaacauuuacugagcauucauuagcaaggagaaaggaauaugaucgcugaucgcaagaaucucagucuaguggaggagaauaaugugaacacaaaugaaaugcaguaugguagguguuaucauagaaauauggauaaggacaaugggugaaggucaucugagaagguuccacuaaguacauggcacuuaaauauuaaguguugcauauacugaaugaaaaauacuuaaugcaguacuuugaaaagaaauaccaauuuuaaacuuacagauucaaucgucauguuaagagaauuuaaaaacgguaaaaaauuaaguuaaaaaaccaaagugaaaacuaugcaauauuuucacauucuucuaaguuuucagauuuaauuaccaaauauaaaaaucaacuuuaaagauauaaauuacaccugcugguuauaaguuaucuuacagaauucacagcagaaggaaaagauaugaguaguuccaaaaagagggaacugugcaacagauaaacuuaagagaaaagaggauagacacuuuuguucucucccugacaagcaagauguuuaaaaagaacagguacacagaauugguagcauggcaugauccuuuacuaauuuuaaaaaguucugaaccaguauacugcaggaaggaucugucaaaagaacagaaacccacccaacugagaaaggaagagcagccccaaaagagacgcugucauuuagagguagcuuaauuugcccguuuaaaaauauugcucuaaauuugggaaaacuugcaccccagcugaaaccacagaggaaggagcucuuccuauuccuuucuugucagauuucuuguuauaucagcuaaaaaguacauuaccuggauacccuaaauuauuaucaacucacuuuuaaaaaguguggucuguuucaggcaagcaaaguauuucauuuucauuaacaccagguguugggaagcaugcuaaguagaggaguuugcuuuuguaaagccagauuaacauagggaaggugauauuacuagaugcccaaaggaaacggaaaaccauucauuuuuuauuuuuggguuaaagcuuaauuauuuuauuuuuaaauagauaauuuauuaacacagauuaaaacaauaaaaaaaagauaccuguugagaagucugaguccuaacucugucccaucaggccuguucccucuggccuaccauggauaaacaucuuuuauuaauuuuguuuuuaauucuuccaguauuucuuuaugcaaacagagacaaauacauggauguguaaauauuuauuugucuugcucugucuauauacucugcucugcaucuuguuuuucuuaacacauaccagagauuauacuguaagaguacauuagagugcucuauuuuuuuuuugaaaauauuuuaaaguaauucuacaaaaggcucuauguuuuacucccaguuacgguauuucaaaaucucuauaccuguacuauauguagggaaaugcucuggacaguucuuucaauacgaagucuacagaaauuuaucaaagaacuuacaguaucuuucuguuaguuuuuuaauaaccuacugaacagcauagcuuuauuuuaccacaaaauucucuuuuacuugaaaaguuagggagaaguuacuuggguucuaggggggagacuauuuuuccccacuaucuccgcuccuuucccacacuuucuuuuaacuucugacuccaucuuuauuacauguuuuuauucucucauuuuuuuuucacauuuuauauuaacaaauguaaaccacugauucauuuaccaaauauaccuuaugggcuuucugcuguuguuauuccuuuuaguauuggcugcuaacauuuauugaauacucacuaugaaucaguuacccuacugguuguuuuaucuacauugucaaauuuaacucucuguguaguuuuuuuuauucccacuguacaguggaggaaaugaaagucagaaaaugagggucagagaaguuaauuaaguuacugcuagcaacugucaaaacuugaacucaguuugguuuaucaccaaaagauaugcucuuaaccauuauacuauaagaaaaggcauugcuggugggagaauuccaugcagcucaggaugaccagaacauaggguaugaacaggaaggacuggacaaagaucaggguguagaaacagccaggauuccagaucacagaccuuguaugcccuagucaagcuauaugagcuucauucagaagggcacagggaacaaucaacagguuuuaagugugugaacagcucugcacucuggcagaagaggauagauuggagagaccaaaacuggguuagguaaaggcagguagaccaauuaaaaggugauaauggugauaagggugugaacaaaauguagucauuauuauaaauuacagauuugauaaaaauuucauauaauuucaaacuuuaaaaaucacuucaagaguaaauaugcuugacugagccccggacacuuuuuuuuuuuuuuuuuuuuuuuuugagauagggucucucucuguuucccaggcuggaguguaguggcgcgaucccagcucacugcaaccucugccuccuggguucaagcaauucucaugcuucagucuucugaguagcugggaccacaggugugggcugccacaccuggcuaauuuugguauuuucaguagagacaggguuuugccauguuggccaggcugcucuugaacuccuggccuuaagcaauccacccgccucaaccucccaaagugcugggauuacaggagugagucacagcacauggccccaaauacauuucugauacaaagauuuccaguuuaauaaaauagaaaggcacaacuaucacucaauauuuggaauuguaaauuuccaaaacuguguauacuaagaacaauguacaaauuagagggugauacuaauuggaaaacuuacaaauuaaauuuaaaaauauaaaaacagacuuuuuucccccauuuggaauugggaccuuaggcauugucuagucaaacucuuuuauuuuacagauuaaaaaaaccuaaagcacagagggcauauucuuuaucagauaugcuuggggugcccauuuaggauuauaacccaaguuuccugacucuuuaaucauuuuucucacuuucauacuaagaucugaaauuagcucuccuggcagaacaggugggagaaaaguuaagaaagcucaugucuaguaaguacagauauuaucaaugcuuuacauucagaucucauuuaacucucacaucuacucuacaagucaaguauuauccauacuacagauggguacagaaagcuccaucuugccaaaggccacaugacuaucagacaccaaagcuuaucucuuuucaucauaauacacuaacaccaacaagaagauaaccuaaaagaguuuuucuuccaauguuuaaaaaaauaccagguuuguauuaacaaauucagaaaucauugaacacugaccuguaacaugcaccuggauacaacaacuucagguacuucagggaauuuuugucgcaggucauguaaaaccugaaaaucaauuugguggcuuccuugggccauucguauauugccugaucaggacuauuuguacaguaggcaauucuaggccuuaguggaaauaguacucaucucuucuguccaagcauuuucugugaaagaaagaaaaaaaauuuuaaugagaacugauuauagaaggaauauuguuguggauuuaaaauuucaguacaaaagaauaugugcuuuagcacuuaacauuauaaacuauaaaaauauuuagaccuaaaaugcuuuccauauaguuauacuaucuuuuuaguauaaacucugaugguaaacuuucauacugucuaacucuuauguauuuauaugcucuauaauggcugagccaaaaagcauucaaguaagaaauuacuuucaagguugucuucccagauucuuuuaaaaagggagaagaaauaguaucacugauuuuuuucuuaaugauuaucccaaggugaguaaucuaaauucuuaaaguuuggauacugaaaaaauuugguacuacaaaugacuccguuuugucuaaaacuuaaugauucaaaacccaaugcauucaauauuuugcuuuaucuuucaaauauacuuaauccuuaaaugcacaaucaauucauucuuaggagcuuaguagcauuuuauucccucugcuucuauuaaaucaguauuuuuaaaauacuaauauuucccaagggguuugauuuaauuggcugaggagugagcagccugggcauauggaguuuuaaaagaucccaaggugauucuaauguguggucgaaguugaaaacuacccaccuuauuuuuauuccuauuguuucuaagguaaaccauguuuaauguugaaaaaucuuuuggggauauaaauaggagauaaguacauuaaccuaaauaaaauauuaagacauuuaaaaucaugcuauuugaaaauaccuuucauuaggacaaauuucauaagaagacaaucucuuuaaaacuaauuucuuauuugugguauuucucuuuuuaaccucguuaacauaagccuaaaaauacaggucuauauauucaugaauguagaaauugggucucuuuuauuauuguauaucuagcauuuuauaaacagucuucagcauaagaguagauauuuaaaauaguuuugaguagauuuauagaacuccucagugcucaauaaaauaagcgcucacuuauauaguaauaagccuuuuaguuuuuuaucaucacuugauuaaauuguacuuaauuauuuuaucuauguggcuuuagcuuaguuacaucucauggauaaaaucacugccaacaucaaguuauuugcauuguagauuuuccaaaaguauuucuguguaaacacacacacacacacacacacacacacacacacaaauuuucgcauucaaaaguaguguuucuauaaauggguugcaggagagaaaguacuagaaaugaguaaaggacauuuaaaauaauuuaaguggcgacaaucaugcuauagaacugcucauuuuaaggaagccuuccuugacuccucucuaucagcucauuucucccucuucccccaauuuugggcuaaaacuccuggaaaggguuguuuauacguaagugucuucacuuucucccucccuucuaaucucuuuuaaccuaccccacucaggcuuucauaguuuuucuccacugaaacuacacuuaucaaagccacuauacacuuuuaguuuaugaaacccaauggugaguucucaguccucaacuuacuagaucucucuguagcucaggacccauucaaccacuacucccucauucuuuaaacaauuucuucauguggcuucugagguuuauacucuucuggcuuuccuucuacuuacuggcagauucuucucaguuuacuuugcuggauccuuuuccuuuucuggacaucugaauguugguggcugguagaguucagaucuaugguuuccuuucaacuauaucuacauucaucuucaagguaauuucauucaaauauauugcuuuaaauaauaucuauauacuggugcuuggcaaauuauuaucuccaacuccaaucucuuccuugagacuaacauauccaacuggcuaacugacaucuccuuuuguguaucaacuuauuucaagcucaguauguccaaaaucaaacucuuaauuccucccccauccaaaucaauccuuucccagucuuuuccaugucaguaaaugguaccaccauucauccaguuggucucucaucccacaucuaaucuaccaucaagacuucuuggcuuauauacaaaaaguauucuuaaucuaaccaauuuuucccacuuguuacugcucuuguccaagccaccaucauaauucaucuagacuacuacugcaaaggccucaauaggucuccccaccuuccuucuuuuugccaacauaccacuucuucccguccccaguauuuucuuuacugagcggcgugaucuuugugaaaaguaaaucagagucaucacuuucccuguucaaaaugcaauguaacaaagccccuggcuaucuaccaccccucuaacuucaucuucuacccucuccuuguucccucaauucaaaauggcagucuggugauuucucaaagaagucacucuuguucuucccuuagggcuaucggauuugcugcuccuuuacuacuggaacaguuuucccuuagauccaccugcaacucccuucucuuaugucauuaagaauguugaucaaaugucacuucuucagagacaguuucccugaccaaucccucuaucuaaauaaugccauaacucuuccccaucucccaccauugcacccucauacugcuuuuauuucauaacauguaucaauaccugagauauauuuuauuaucucuccauccccaaaacauuagccccaugggaucaaggacucugaaguucacuguucuaucuccaggaucuggaucauuccuggcucacagaagaugcaacauauuuguugaauaaaaugaauauuuuauuauaagguuucuuuauaguuuccuucuauaaggcuuccaaaacauauuucaaaugaucuagauuugaaaaaaaaaaauuuauacacaauuugagggagaggcaaauagucugauugagacauuuuuauuauuuaaaggaggaugaaccaugaaaacaaauuucaacguauuucauuauuaaaacauacacugaaaucucucaccauacuugccugcuuuucuaauaaagacuaucaccuacacaaaugauaacauucuucaauuguacaauuuuauuuuauggguucuacuuccugugauggcugaguaacgccuaccagaccaaaucuuucaugaauaacaacuauaaacaguagaaaugcauaaaaaacuaccugaaggaggaagaaacaaauugguggagggaagaaaaaggggucagcacuuggaagaaggaaacagcaaggguaacuuuccauuuuuuaauggcuuuuacucagagagcaggucccaguuaguuuggguagcuaacacucagauaaaaaaccugcagucuuacuugcuugaugaaccaaaggacagacaauggcaugaucauaacagcugaaagcuuagugaguaaaucacaggaaggagagaaccacagagaggaggcccuaaauucuguguauaaacucuguauuuaucuuugaucuccaaacuauacauaugugcgacagauuccauucaagcagcaaggcuaagguuaaaauaacugaacugcgauuucagagcuuauacuuuaaguguagucaaguuaucuggcuugaaacagauaacaaaccaaacaucaauacucacuggaggaauacagaauccagagucucuacauggcauucauaauguucuaaauaaaauccaaaauuguuacacauaaacagaaaaaaacugacccauacucaagagaaaaggcaaccaauggacacaaagcccaagaugagccagcugcuagaauuagcacauaaguauuuuaaagcaucuauuuuaacuaugcugaaggauuuaagugcaaauaugccuggaacucucagcaaagaaauggaaauuauacauauauaaagcaaauaaaaauuuaagaacuaaaaaauaaaauaacugaaaaaaauucacuggguagacuuaaccauggaugggaaaugacagucagugaacuugaagacaaagcaauagaaauuauccaaucugaaggaugaauaaaaaagugacugugggcgagggggaggagagaaacagaaccuuagggaccuguggcaagguaucauaacauacuuguaauuggagauucagaaggaaaggggagaaagaaugagguagaaaaaaaauuugaagaaauuauggcuaaaaauuuuguuaguaaaauauauaaauuuacagauuuaaaauaucagcaaaucccgaauagaaaaaaacaaagacuacacauaggcacaagauagucaaacuccugaaaaccaaaaagaaaaucuugaaaacagccaaagaaacagaaugacaauaauuuaaaugaugacuucucaucagaaacaauggaggcaucagaagacagugaaaugacauaauauaagugcugaaagaggaaaaaaccaaacugucaaucaacccacauacuacaaacagcaaaaguaaacuuuaagagugaaagcaauauaacuauuugaaaauguagccuuuguggagcaguaagucauuuguaaggacaacccaaacacauuacugaaacaauugguauuuacuuaauuucaaaacaaaaaccaagaaauaucuuauaaauuuacucuguaaaauuauuucucauaauaaacagagacacauuuccuauguuaagaugcaaaauaaacccucuccugagaaaaagaauaaagaaaucauacuuuaugaaauguuugcagcaauagguauaaaguucuggcaucuaaacuuccaccagcuaaaaugaucuaggaggguuaauuccuucuaaauaguagcagaguauauacagcacuacaaaacauaaguagacauauuggaacgguuuauaaaaugugccauauucuuuccuuucuuaaagauuauguaaacaauuuuugauuucuuaguaacuauuacagugaagaguacuaggcacugguuaauggcucacucagacugcaaguuaugcuucauauucagugcaguuuaucauaguggauguuucuaggacuauaagaguauacaaaagcuaacuguuuaacacgagaccacgucuccagauuaaaaaaacaaacagaaacaaagaaugcaacuggauauauaggucuuaugaaaaucugggcauuuaugaggcaacuagauaagaguauuuaaaacugggacuaucaucaucuauuuaucuaccaaccacacauugaaugagugccuaguaugcaggagauaccaugcuggagauaguacaaguauuagagucaauguccuugcccugcagaucacagaaauugcuagguuaaaggcacauaaauacacguuuauaauuuagauaacuauuuuaacuugcucauuauuuuaucuucugucugcgucuucugcacucggucugcugccugccaucucgcuuguggcuaucacagccacuguuuuucucuuucacaucauuccaaagcagagcaugggagcaugguacauugggaaaaacuguagagagcaaagaucaagcaaaauagguagggcccaaaucaugaagugccuuauaggccauuaacauuuggggauuuuaucuuaagaacaaugggaagccgaugaaggauuuaaagcucagagguaggaaaggugacaugaucaagaaaucauguguguauaaaaaacggcuauuguauggaaaaaggguaaaagaauauaugagaagaccagucagaaaaccacugcuguaguucagccaggaaaugguaauagccuguacuguggauagcaauggagacuagguagagagaaguggaagaccuuaagggauauuuaggaaguaaaaauguauagaaauuuggugaugaauuagaaauuggggcaaaagcgaaggaggugucaaaguugauuucugauuugcucaacuggauaguggucucgucucugaauuaggaaacaaugggaaaaaucaaagagcacaaacaaagagaaggauuacagguuuguuucugaaccuguggaaucuaggguaccuguaaaacauccaaauagagauaucauacagggaguugugauauaugggucuagcgcucaaaggacagaucugaccugcagagaaaaaugugaggugcaucugugguacuggcguuaauuaaaaccugagugugaaugagaaaauccuaccauauaauuuaaauauaucauuaguuauauuauggauaaaacauuauauaguaauuauuaauuuuuucacaauggucaacauucuauccucaaaaaaacugaagagcauguuuaaagauggauuuucaaacaucuuaaugaauuuuuuguucagaaaauauuuuacuguggcauuauccuguaaugaaacuuuaaaaaauguuuaagaaagaaaacauguaaacaguuuaaaaagccagcaagugcuaugaagcucauuagggaaacuuucccugccucaugccucuacaccuuugauuccuacucuguagagguaaccauggucaagacugagcuguuucuccacauuccuaccuauuguuggaggugaggccugguggugaaugaaucauaggggcgaauuucucauaaaugguuuagugccauuuaugagaaaauaaagauuuagcuuuagaacucagugccuaccccauauauauauauacaccauacuucuccacugcuauacuccucugcccaguuacuuuacaauuuuuguguaaucaauauucaauguuuauauuacauuuucccccuauaaauacuguuagccuagauacuuagucaauaaugagggauggacuaaaucuccaaggucccuuccuguagugguauucagggaagaaaaguauaauuuuaauuuaaaaaacuguagaauauuaaucauuugugaccaaagcugguauucaaccaagucugauaaaauaacaaagcucuugcaauucuaacacuagggaaaauggggagaaaugggagggaggggacaagggagaaacauuacuauuguacuuaaguuauagauuuagauuagaugaauuauuuucuagaaaacaagcugccuugauauuaaaaacaaaacaacaccucaaaacaaugacuauaaaaauauggcaaagucugucaaagauugaaguuaacugcucuugacuaguuuccccuccccaguacaccaagccagaugggauaguuuucuaaaacuuuccaaaaaaagguuaauuuuuguguaauuuaaauuguuccaaaguccagacaaauuucaguuuucaauuuacuuuaaaagguuauaauauaguuagggcauuaucuccucuaaaucucauucugaacugugauccccaguguuggagguggggccugauggugaaugaaucauggagacggauuucucauaagugguuuagugccauccccuuagcgcuguccucaggauagugaguucuugugagauauggcuguucaaaaguguguggcaccuccugucucuugcacccgcucuaugugauauccagguucccccuuugccuucugccauagcuguaagcuuccugaggucccgccagaagcgaagcagaugcccagcaccaugcuuccuguacagccugcagaaccaugagccgauuaaaccucuuuucauucugaauuaccuaaucuuggguaugucuuuacagcaaugcaagaauggucuaacauagaaaacugauacugggaauggggcacuacuauaaagauacuugaaaauguggaagcaacuugggaacuggguaacaggcagagguuagaagaguuugcaggacucaggaagacaggaagaugagggaauaucugaaaauucuuagagacugguuaaaugguuauaaucaaaaucuugauagugauauggacagggaaggccaaggugauaaaaacuaagauggaaaucaagaacuuauaggaaccagagcaaagucagccuuguuaugccuuagcaaagagcuuggcuguauuguguucaugcccuggggaucuguggaaguuucaacuuaagagugaugauuuagggcaucugacagaagaaauuucugauguggacuggauguuucuaacaaccuauacucagauguuggagcaaagaaaugacuuaauguuggaaguuauauuuaaaggggaaguagaacuauaaaaguuuggaaaacaugcagucuggccauguggcagagaaagaaaaggcuuuuucgggagaggaauucaagcaaguggacucaccacuugcuagagauuggcccaacuaaaaaggagccaagugcgaacagccaagacaaugggaaaaaggccucgaagacauuucagagaucuuugcagcagccccucccaucacaggcucagaaaccaggaggaaauaaugguucagguggccaggcccagcccugcacagcucaggacacugcucccugaauccaggccgcuccagcuauggcucaaagggccccaagaacaacucgggcugcugcugcuuuggagaauguaugccaccuuaaaccuuggcagugucuaugguguuaagccuacaggugugcacagugcaagagugaaggaggcuuggcagccuccaccuagauuucagaggauguaugagaaagucuggguggccaggcagaagccugcugcaggggcagagcccucacaaaaaaaccucuacuagggcuguagggagggaaaauguggaguuggaggccccacagagucuccaugggggcacugccuaguggggcuggggaaagggacccccguccuccagacccuagaauguuagguccaccagcagcuuacaccuugugcuagaaaaagcugcagacacucaacuccaacccacgagaacaccugccguggcugaacccugcagacacaggcagggcugcucaaaggccuggaugcgggacauggagucaaaggagauuauuuuggagcuuuaagauuuaaugacugcccuacuggguuuuaaaccuguaugaagccuguagccccuuucuuuuggccaauuucucccuuuuggaaugggaauguuuaccccaugccuguacccccauuguaucuugaaagugaauaacuuguuuugauuuuacagacucauagguaaaggggacuuggcuuaacucagaugauacuuuggacuuuugagugacgcugaaaugagcugaaacuuuuggaggacuauuaggaaggaaugauuauauuuugaaaugugagaagaacaugagauuuugagaggcaggggcggaauaauauaguuuggaugcugucuucucuaaaucucauguugaauuaugauccccaguguuggagaugggaccuggugggaggcgacuggaccaugaggguggauuucuuaugaaugguuuagugcccccugccuuggcacuguucucaugauugaguugucaugagaucaggcuguuuaaaacuuccuccucccuugcuuccgcucuugccaugugacacacuggcuuccccugugccuucggccaugauuguaagcuuccugaagccccaccaaaaggugagccgaugcuuggcaacauacuuccuguacagccugcagaacuaggagccaauuaaacccuuauucuuucuaaauuacccagucuuggguacuucuuuauagcaaugcaagaacaaacuaacacaggcuaacauaaaaaaaaauucagaaaaaaaaggcuaucauuuucugauguaaaaaucuaacaugcaaauaaagcaaacaaaauaccuauauaccaagagcauuuacuuuaaaaaaacuggcacaaaaauuuugaauaaaagauuaggaaacggaguauacaaacuauagagcuggauuuauuacugguaucucacuuuaaacuaaacuuauuaauguacuuccauuauauuaauaguuaauggagacuacuuauacuauuaucucaauagauaccaaaagcacauuuaggaaaauuuaagucuuacuuuugggagaaaaaaacuuggcuucaguuccagaaugauaguguacugagcuaguucagaaccucuucuguuaugaaaaaccagaaauaaugaaaaaaugauugacuuuguuuuguaacagcagagcuugcaagaaaaaaauucccuggugccagaaacaaagacagaauuaaaagccacuauaauaaguguuuaaguuaaaauacuguggugauaugugggggagaagaguuuggaaggagagagauauaguuaucagaacuagacauacuggagcugggguuuuaauacuauguggaaagaagacacauuauaggaccacaucagaaagacauuuuauuuaaaugaaauaguugcauaaagcagagauucuggaagguccuuccuuacuagaaaaaagcagcuaaaucucuauccauugccacauagaagccacaagaacugaaauucacuagagccaugagugggaaggaaacaucucccuuacaaaauuaaagacacgagcccgcaccaugcacagguguggaauccaaauuuacacuacagguguagaaaagaaacuuaaaauagaaauuaacaaaaaaauuggucugaggcuggugauaccauaggauuccuggcagaaacaaaaguaaaacugcuauggaaucuuauuucuuuaacccaggaagcaaaggauuucuagaguuaaaaaaugaaaaacaaauaacaucauguugaaaaugagcucauguuaaauaaaauucaaaagcacaaagaaauaauccaccaugaguaaagaucaggaacauuaauuagaugauuaauaucuaagaauguaagagaacagaaccugaaagaagcuauaaaauaaaaauauuuaaaaugacuguggagauaaaaggaaaucauaacaauaagauauaaagugaaaaggcaaaauuugaaaaagaaucaauuaagacuucuagaaaauauaucaucauaaaauguaacaaucaaugaauagguuaaacagcagaagguacuugagacuacagagaaaggugaacuggaagauggauaagagaauagcaaccagaaagcagcagagcuuauaaagcaauggaauauauggaagagaaaaugagaaacagaaugaaaauacuacugcaucuaauagaggacuuguagaaagauaugaaagaauaagggaaaggcaaaauucaaagagauaaugguugagaaacugacaauguuucuuuauaauauacugaaaacacacacacacacacacacacacacacacacagaguucugaagagaaaaauaaaaagaaaucugcaccuagauguauuguagugaaacugcagaguaccaaagacaaauauuuuaucuuuaaaacaaucagagagaaaagagccauaaucuacaaaggaauaacuagauugaugaacuucuaauuagucgcaguagaugccggaagacagaauaauacaaguugagcaucccuaaucugaagauaugaaauacucgaaaacuggaaacuuuuugaguucaacaggaugcgagcaugaguggaaaauuucacauaaguacuuaagacaaacuugcuucaugugcagaauaauguaaaauacuguauaaaauuaccuucaggcuaugcguauuaagguggauaugaaauauaaaucaauaucguguuuagaugugggucucauccugaagauauuauacauauacacaaauauccccaaaucugaaaaaauccaaaauccgaaacauuuuuggucccaagcauuucuaauaagggauacucaacuuauauacacacauuucugagagaacauaacugcagaucuaauuuaauuugcagacccuaugacucagcaauuucacuucuaggaacuuacuugagaaaacagacaaucauguaaagauauacaugaaaaggccgggcgugauggcucacgccuguaauccuggcacuuugggaggccaaggcagguggaucacuugaggucaggaguucgaaaccagccuggccaacauggugaaaucucgucucuacuaaaaauacaaaaaaucagccgggcguagggguggaugccuguaauccuagcuacuugggaggcugagacaggagaaucgcuugaaccugggagauggagguugcagugagccaagaucgcaccauugcacuccagccugggugacagagcgagacucugucucaaaaaaaaagaaaaaaaaagauacauaagaaaagauguuuauuacaguauaauuuauaacaugacaaauucagaaacaaguuaaauguuguaaaguauuaaguucaucuaaauguacugacauggacagauguucauuaacaccguucaagggggcagaagcauagacuaaauuaaacaauguauaauguaauccauuuacauauugauaaagagucuuuacuauuacuuuauauccaucaaggcuaaaauguguguguguguguguguguguguguguguguguguuuuuuuuuucuccuugagacggagucucccucuauugcccaggcuggaguguaguggcacaaucuuggcucacugcaaccuccgccuccuggguucaagugauucuccugccucagccuccugagcaguugggacuacaggugcacaccaccacgcccgauuaguuuuuguauuuuuaguagagaugggacuucaccauauuggccaggcugcucucgaacuccugaccucgugaucugccugccucagccucccaaagugcugggauuacaggagugagccacugcacccggcuaaaauguuucaugcugaaaacacacuacuuuuaaaaaguaaaaauaaauuaaaaguaaauaauaaagacgugguuauuucaguuuucagccacuagacuguuauaaaugucauaaugcuggugaaugaaauaauugaauagucaagguaucuguaaaaaauacgauaugcucuuuugaaaugacaggugcauuuuuauaaauuacuguaaaaaaauucuauggauaggugaaagucuguuuguagcaaauuaaucauauaagagauuuuaaugcuggaauucauuucaaaccaaacaaaaacaaaauccuaaauuccacacuacaagagugaauacucaacaucugaugucaagaucuacagaugaaggcuggaaagauuuuuaugcuuuagauccauccucaccugcuauggugugaauggucagguccccucaaaauucguaugugacauccuaucccccaagaugacaguauugggaggugaucagguuugaguguggaaccuacaugaaugggauuaguggccuuauaaaagaggcccgagggagcugagcugccccuuccaccaugcgaggacauagcuaaaaggugccaccuacgaaccacagagugggaauucaccagacauucagucugcuggugccuugaucuuggacuucauagccuccagaacuacaagaaauaaacuucugcuguuuauaagcuaccuaguuuaugguauuuuguuacagcagccugaauaaacuaagauuaucaucuuauuucuguaaccuuguuuaaugguugcucauuuugacaauccacaucuacguguauaaaaugaaguugagucucacuuucaguuaacccccaauuuuagucacagaaucacugugaaaucuugccuuuaauaaggccauacuaaguuuucuacaaauaccuguugaauggcagucuccuacauuucuaugugcuaaaguagaacuaccauuaccuuuaguuagaaggaaauaagcauuuggaauucucuaggacauuaggaaauacgauuaaauuaggagguaucagaacagauucaauaauucaaauuuuaagaaaucuacuugaaagcccaauauaucacuuugucauuuaucacuucucaaagagccuuucaauagcauuaguuaaguguuacauggaaaaauaaguuuuuuuuuuguggcaauacauuugaaaaaugcuguuacuuaaaguuaaggagguuucuuuauuucuggacuuuaauaugcacuguuaaucuuuggguagcagcagcagaugcaauauuucucaaauuuaguugggcaugauccuauuuauccauaagcaucuugagguaggaagcacacagguaaacagugucauguaaguaagguaaucaaaagacagcaguaccuuucucucuuaggaauuuaugcuaaggaaguaauucaacguaaguuuaacauaguuuuuuuuuuuuuuuuugagauggaguuuugcucuugucacacaggauggagugcaauggugugaccucgacucauugcaaccuccaccuccuggguucaagcgauucuccugucugagccuccugugaagcugggauuacaugucccugccaccacgcccggcuaauuuuugcauuuuuaguagagacggggguuucuccacguuggccaggcuggucucgaacuccugaccucaggugauccacccaccucggccucccaaagugcugggauuacagguauuagccaccacaccugcccuaaguuuaaaauaguuuucuaacaguaaaaaccaaaaaagaaccaaacagcuuaacuuuuggaaagcagcuuuucaaacuguaauuuauuaauacuugacuauuaugcagacauuaaaacuuauuaaaaccucagaaaaugcaaggaaguagucauguaauauuuggcaaaaacagaaagacauuaucauguaaauaauuuucacuggggaaaauuuuaaauuggagaccaaacaaaaaaguauaggggcggcgcaucaugggagauuuaauuuauuaaaaaauaaugaucuuuaauuaacauccaaaugucuguuaacacaucacuuggugaggggaauccucaccucagagugcagucucuauagaugucaauuuggcaaucuguaucaaaauuaaaacugcauuuauuuuuugacuucacaauucuauuuuuaugaaucuguuugcagauacagucacacagaaaacuauauauauuugccaaagcauguuucuaaugauaaacaaccaaaaacuacuuacguaucuguuaauagugauguguaaacuauggucauucacaaaaguauaauguacuauacagccauuaaaaagaaugagaugcuaauauggaauaauccccaagaaacaauacucaguuaaaaaacuaccaccacuaagugcagaacaguguucuguauucucuuacauacaagaacacacacgcuuuuacgugcacagaauaucuuuggaaggauacacaagaacugguaacacuggcugccucuagggaacgcaauuaagggagauuuacucuucauuauacaccuucuugaucuaauaaaaaacacacaaauaaauuuuaaaaaccuauuuuauuuaauauauuguuucuguaauaaaaaauauucaauaaaaagugaaaauaauguguuuuauauuucaucuuacaauuuagacuuagggaaaugaagaugcuucaaaguguuauguaguccaagacuaccugaaguucuaaaauugagauuacauuuuaugacaugauuuugugacacgaucuaccuaacauauuaaguauauuuaaucaaaaguuuugagauuugcacaauccaaaaugaggcucuguagagugcuuguuuaccuacuucucuuucgauuucaggaucaaauaaacugaugugguaacauaagaaggcauacagauguacuaauuaagguaagcagguguuuguguucaaagggcaugauuacacuuuggauagcagaagcugggaccaauuagaugcacauaauugagguuuugaugaauguuauaaagaaaccaauauccaguaaaggacauuguagagaaauuuaguuaaauuuuaucuagacaucugucaacacugagaagcaugcaaauagagaagcaggauuuaacuuuuaugcauaaauauaacuuggacuccaaaguuuuaguggguuaaaaaacauauacguguauguaugucucuuuacauauguauacacacacaaauacacaaauauauauauuuaaucucucacucucuauauauagagaaauaaaauauacaccugaagaaaaguuagaaaauaagcauuguuuuaaaugacugcauaacaguccaucaggucaauauauuacuauuuagccagucuuguaaacaaauaacuaaguuguuucuaauuuuucucuagaaagcuacgcaaaaaguuuuuuguacguggaccauuuccauauuuaaauuauuuccucagaauacgacuuuauauucacaaugucaaggcaacaauaugaagguuagccuuuagauuuuaucuuuauuuuacaaagacuuaaaggggucguuccccgcuugauuuuuuccuaaugccuauguaauauccugcuugcuagcacuaaguuaguguuucuccauucuggaugcacaucuaaaucacuuggggaagaaacugguaacaaugauuaucugaggaagaagagggaaucugggagaauaagggcuggagaggaagacuuaagaaacuuucucuucacuguacaccuuuucgugcuuguugaauucuguauuauauuccugcguuaccuaguaaaagagagaaguaaggggaaggaguaagguggagaaagcagcagcagcagcaaaagcaauccagcagcagcagcagcagcacccagagcuuugaaaugcagaguccaaaguuggggagguaacucaaaccugauaaugaguuuuagaauuucuggauguagggccuacacaugcaucucuguuacucaaaguaaaaacaagauacuccaccaguaacugugaugggaagucaagguagagaaccauggaaucaguaauuccauuuuacaaggcugaugauguucaaaacagguaaaucuuagagcaaacaaaguugaguguguaagcaggagggaaaaaaggugccaaaaccuuaaaagcuccuuaagauuuaagauauuggacaaaaacgcaacuuuccucaucaggaaaaggguguguuuccuaaaucagcauuuuuuaguuuggucuguggaccaccugaaacaaaaucacugggcuucauccuggaccuacugaaucaaagucccuaaguauaaagcccaaguauguucacugauucaucuuugaauccacugugaugagcccucucaagacaacugcuuaucugaauguuucuucaaguaaaguuuacuccaguuccuacaagaccgcuaguugauaacacaguaaaugaaaggcagggaagggacuaaucaaaaaccaagaugacuauggucaaaggaucacauauaagaggugcuuauaguaaaguauugauuuaaggaaggaaaauagagauggaaagggguguggaauuucaugaguuuaaaaaacugggugaaaggcaaugaaauaaaaagauuauuaaaaugaagucaaucaccaacaagccuguaacaggaaugguuagaaacuuguauguaacuugauucaaugggaaagaaauaacuaggggaagaaaaaauuaccucuauuaaguauacacaaacagauucugcagcuacuauauauuuaagaguguaggaaaauguagauguacaauaaacacauauggaucaccauaggucagcuaaaaaugaagcuuauuauaaaauaaaagcuguuuuugggcagguaaauuucugaaaaaucuuuuacuaucaagaaggugccauacaaaguaaaugguggagcaaagcuaaauucccagagaucuaacuuuuaaaaauaaaaggaauaacuaguaauguaucucacauaaacuacucaauuuacauaauuuaaacuugacaaaguauuggccuuuacuauuaaaaucuuaagaaagaaaaggaaccaaugaauaaauaaaauguuacucugagacaggcauaaacuuuccugaagagaagaaaagaguagaacuaaaagaaccaguauucuaccuuagccaugcacgcuucuaaaauuuucuggugaaagaacauguuaauaguuuaaaacagagauaaccuaauguugcuaaauauuucaaccucaguuccauaagugcacacugucuuaucuaacuagaugagacaauuaugauauaagguauauaaaacaguauuugauacacagugauagcuggcuaaguauaaauucuaggauuccauggguucguuuaugaaguuuaauaugcuauuuacuugcaguaacuucuugggcaaaucauuuaauuuuucugugccucaguuuccucaucuauaaaauggugaugauagaguagcuacuucauaggaguguuaggagaauuaaaugaguaauccaaguaagauaauaaaaagagcacauaguaaguacacauguaaauaaaauaucaauacuaucauuucauucuucguaaaauggagaaaacaacucaaagagcuucaaggauuagugacaacauaauuaaagccaauugcauuauaucuguccugccuacagcaaaaaguacaaacugguaguaguaguaauuauuuauuuuaaauaucaugaacuuccacgaagugcaaaggaacaaaaccuuacagggcugcauauuacccugguugcagaauauuguaggaguggauugagccuuuaaggccuucuuuuucaaugcauacgggacaaaaaacuugcaguuggggaaaucugacaaagcuacaugacaaacucaacaguacuagguugugcaaagugcuagaaaaguggcauaaacuguguuauaauagguguuuaaagggaucucucugggcugaggaggaagugggaaaguauugaagcauaggaacuuaaaguauaaaagaaguaaggcagauucuggggaucgugucaccugucuugcaggaggaagaaaggagggacaaagaggaaagaaggggauuaugaagaagguacucaggauggggguaguuacaggagaagcugagaagaugaaugaagguuucaagguauaguggucuuuaucugagaagaccuugagauacgcuaaugcuaauaagguuuuaauauaugucaaacuauauauauacaucauuuuaucuuugcaccguucuuacauaauuaugaguuuugcuggaacaaauuuaauuauguuaacaaaguaagcugggcaugguggcacaugccuguagucccagcuacucaggaggcuaaagaaggaggauccauugagcccaggaguucaaggauguagugagcuaugauugugccacugcacuccagccugggugacugagcucuuaaaaaaaaaaaaaaaaaaaaaaaagacauaaaauaugguucaugccgaauaucaaacaguaguaggaagaaauacauaacguucacuucucaaccgcccuaggauucuuccuuagcuuguguacaagaauguaagagaagauuuuuccauuucaacauacgcuaaaagcaaauuccaguuuccaaaguagccauuagcgguaauaauuuuuucuguaaaucauaaaauccugaauuggacagaauucuaggaaguuaucucauaaaaguauaauuuaagagaucugaaaaaugccuuguugcccagucgucuccuuguuagacuuccucuucucccagucaauccuauuuaccucuuaaaaacaagcccuggucacaaagaaaauucuucacgugagaaauauuaauuccagccgggcgcaguggcuuacgucuguaauccuagcacuuugggaggcugaggugggugggucaccugaggucacggguuugagaccagccuagccaacauggugaaacccugucucuacuaaaaauacaaaaauuagccaggcgugguggcaggcgccuguaaucccagcuacucgggaggcugaggcaaaagaaucgcuugaacccaggaggcagagguugcagugagcugagauugcgccacugcacucuugccucggcgacagagugagacuccaucucugaaugaaugaaugaaugaaugcaugcauguauguuaguucccaagcagagagacuauuuuucacugguguauccuaacuacuuaguguaugucaaguggaugcucaguaaauauuuguugccauaacucucuaaauaaacaucagaauacauacagcuuuuaaagacuacucuaaaaagugguuaucuaucuccccaaacucaagcguuucccuuaaccucagauaugucagugcugcuauaucuguuuugaaaauguaaauauguuccaucacaauugauaugagagaacaauuugaacauuaagucaauuuugcuguaauuucauuuguaagaaacacuaggugaacacagaaagcuguauugagcuaaaacaagcagcauaugaauauacaaaaaguaaacaggaacacaccugaaacacuuaccagcuaucucagcuuaacagaucugcaugucauuaaucacacccagucacauuacugauuucaaaaaacucuuucuugacuaccuuuuuuuuuuuuuuuuuugagacggagugucacucuguugcccaggcuggagugcaguggagugaucucggcucauugcaaccuccgccuccuggguucaagcaauucuccugccucagccucccaaguagcuaggauuacaggcgcgugccaccgugccuggcuaaguuuuuguauuuuuaguagagacgggguuucacuguguuagccaggaucaucucaaucuccuggccuugugaucaacccgccucagucucccaaagcacugggguuacaggcgugagacauggcgcccagccuugacuacuuuacaauaacucacaagcugcaauucuuccugugcucccuuccauaagcaaacuuuaggucucauugaggaaaaaguacaauauucauuguaguauuuacauauuucuuaauuuauuuaacaugaauaaaauuaucuuuaagauuuuuuuuuuaaauuuuuugagauggaguuuugcucuuguugcccaggcuggaguucaacggugcgaucucggcucacugcaaccuccgccucccggauugaagcaauucuccugccuuagccuccugacuaagcugggauuacaggugccugccaccacccccggcuaauuuuuuuguauuuuuaguagagacgggguuucaucauguuggcuaggcuggucucgaacuccugaccucaggugaucuaccugccucguccuuccaaagugcugguauuacaagcaugagccacugcgcccggccuuaucuuuuuuuuuaauguucacaggugauguuuccaaguguuacagccauaauuccuuuuuuuuuucccauaagcccuguguguuuuuuugugugacuuugcauagcauggugauauuuaggaacaugccucuggcucaaccacugacuauuaacauuaaccucuccaggaugccaaauaggacggcagaacguuucgaccuaucuauuuaguugucaauaugaugcuaacaguuuuuuuuuuucuuucuuucuuuccuucuuucuccuacucuuuccuucucucucuuucugagacagggucuuguucugucacccagguuggagugcaauggcacaaucauggcucauugcagccucaaucuccugggcucaaaggaucuucccuccccagcuuccuuaguagcagggacuaccggugcgcaaccccacaacuggcuaauuauuguauuuuuuugguaggcucucccuauauugccaagguuggucuugaacuccuggacucaagugauccucccaccuuggccucccaaagugcugggauaacaggugugagccacugugccuggcccacauucuuauuacuaauuacaauuucucucuucugugaauuggcuggcauuaucacacugccaugaauuacucuuaaacaguaccuuuaccacagaaagaaguguugauaaugcagucagaauagcuggaugaugcuauaauuuuuuaaauuaaagcaaauuuuaaaaccuuuugaccucaaugaacauuucaaaauuaaacauaaaauaagaaucauauuaccuaaguacauacacuauuuaaauaccuuuuacauuauugacauauuauacaaguaucauaucauauaccaguuagcuaauacuuggugcacuucagauuuaauuaacuuuaaaagaauuuauaaauguuaauuuaacauaaaguuuuaaaauuuacuuuuuauaguaaauuauuggaauuauauuucuuggagcaugauguuacaauucuaucaaggcaaagcaaacuuuacuuaaacuccauuuaagauaaaaaugagguaacuauaaucaaucuuuaccauaaacuuuaucacaaaacauuuauaauacuaaaucauuucacacagauaaucaguuaucugcaaaaauaauguaauccaaaugcuacuuauuuuaaguuagcuauuauguucagauuuagagugauuuaaaauuuaaagggagcaaaugauuauguuacuaaaaacuagauuucuuaauuuuauaagccuacaauaauuuacuuucuaaagaauaacaauaaacauuaauaaaguagcauaauaauccacacuacuuccucuuaaagagaaaauuucccauuuugucauuuaaugcacugccucaaggccaugaaugcugacaauuucugaugguuaacaggcuuaccaguuauaaguucuucuaaaaggaaugugcaagucggccacacuuggcaauuuauguacugugguuuugugguagguacuacauuuucuaaggaucaagaaaagugcaauaaaucuaagacggaaugguuauacuucaucaaaacauauuauauaacuaccuuuugugcauuuuauaauucauaccucauuauuauuuugcaauacauuauuguucacugcccucuuucacucuaauuuuuggauaaucuauccugugcauaaauaucaucuauaaaagaaaacaggagcuaaguaugauaauaaguuccuauuuauggguaaaagggaaagaggagaaaagagaauaaaagcacuugaaggaaccaauuuucaucuuacaccaaccauaaacauuuauaacaaaccaauucacugaaugauguguagaaauuuuaauaaguugguuaaauauuaauuuaaaauggcaccuuaauauucagagaaaguuauaagaaguaucaccagcugggcacgguggcuuaugccuguaaucccagcacuuugggaggucgaggugggcgaaucaccugaggucaggaguucaagaccagccugaccaauauggugaagccccaucucuacuaaaaauacaaaaauuagcugggcgugguggcaggcaccuguaaucccagcuauuugggagggugaggcaggagaauugcuugaacucgggaggcggagguugcaguaagccgagaucacaccauugcacuccagccugggcaacaagagcgaaacucugucucaaaaaaaaaaaaaaaaaaaaaaguuucaccaacugaucugauccccaugcaguuucaaugccuuacuuggucccaugauucuuccuguucaucucauauaacucugcucauuuucuuucuaaugucauagcccucagcugacuuuuucccauaguggacuccuggccagcugcuaagggagaggggugugugugugugcaugcgugcaugcgugggcgugugcacaauagcacuaggaguaugauaaguucacaaguuagacaaaguguacauggauauuugcuacuacuaauaaaguaucagaguucuagcuuucuauccaucuauccauccacccauccaccccuuccucccucucuucaucuauccagcuauaugaauuaaagcaucuaaucuagaaaaaacacacguguuuaaagugguguaaacaagaauggucaucccagugugugcuucuaaaaacaaccucaauggccaucuaggaggaauaaauaaauacauuauugcauagccacacuaaggaacaccaugcagcuuuuuguuguuguuguuuaguggaauaugauguccaaauaauuauauggacaaauauauccaaauaauuauauggaccuauaagaccuuauugacugaaaaaaaaucaagaugcagauuccauguauaacaccuuuuguguaaaaauaaagacacacaaaagaugcauuauauuaaaaagcuuuuaaaaaauguuuuguccuuuccuaugaugcugaaaauagauguauuuuaaacagauauuuuuauaugauuguauaggaaagauucugaaaguauacacacacuaauuauucuggagagggggcugaguagaaggacacauggauggaagguauuccaaggagguuuagucaucugucccaauuuuuauaauaacacauauucaugcauuacuauaaaguuauuccuuauauauuucucuauaauauuacuuguauucugauauguagauagaguaagaauagaacagaaugaguuauuugaagguaccuguauuagccaaccacagguaccuucaaauaacucaaagccuguguugucuaugcugaaacuguuauggaugugcaguuuacagcugcagcacugaccaauuaucaggaugcuugauagaugagauuuacaguuacuuucuaacuuaaauguuacuuaugaauuuauauauguagguccauccaugauuaaccaugucuaagcuuagugucauaauuuguaauccuugguuaaaacaaagaagccaggugacuuuuuuuuuuaccuaaaggcuaacucaaggugaacuauuuauuaugcaagcacucaaacugacuaaguauuacacaucuaccaaugagaugguuuaauuaauuaaaggaaagagguaaggggugguagaaaaagaaguaggcuuauuguuacuauuaaauauaagagucucccaauaaacacaauaccuuuauggaaaguuauuguacuaucauauacaaagguggacaagacacgcuguuuucucugagccuagaguauaaucacuuugguucuacacuuacuaugagccaaguccugugcuaaaugccuuaaacauguauuauuucaguuacuuuuuacaauauuccaguagugaggauuaagugagaaacugcagguaaaacucuuugcacaaugccugacagaguaaaugucccuuauuaggcauuacuacugccuaaccucuaacuucaucaauucaacccucacucuacgguagucagcuuuucaaaagauucacugacuuaacacauaccaguucugagaaaucuucaacggauucccauugccuauuaaaguccaaacuccuucaucugacauucaaaaaaacaugacauagcuccaucucccaucacaccccucccuauccaacuauucucuaugcacacuggacugcucacaauuucuauaauauauuaaauacuuucaucuccauaacuuagaaauacucuugcugcuuucucuaaagaauucuauuuauccuucaugguucagcagaaacauuaccuucuccacaaagcugauucucuccaguacucuuaaguauguuguaugcaucucuauuacgauacuuucauauuacuugucuguaagcucacuaaaacaagguuuauugauuucuacaucccagcugugucuauuuacauugaauaauggagaaaaauuucaccauuaauagcaccacugaaaauaacuaagacuugauauucauauguaauuccuucuucaauuucuacuucaauucaccuaacagugguaaugacccuaacuaguagcucccuuuccagcucuaauucaacacucagugacacauaauucuuuaaacaccaaacaaauaauguggcacauaaucagugaccuaaugcugacuaaauugccagacauuaaauucauuaugcauuaauacugcaggaagggauguaaggaaggaguuaagcacaugcuagaauauuaggauugccuuuuaaauucacaauugggauacaaaauuccucuucaguuuucgguaaucucuaaccuagauaaacugaacuaaaaucaaaagacauguaugauuaucuacccauuuaguaaauaaacucaucuuucagggauuaauucuguuucuacaucuauauauauugguaaaaggaauaaauauccuuaaaagcuaauugaucuuggcccucuaaccauucaugaguagcuuucucuugguuaaaaucuaaggcauuaggaaaccucaguuuuugguuuuguuguuacacuccaggaugacucugacuauuuguaacuuccuuggcugguuucuuuuggguaaucaaguaaaauauuagcaaauauuaguuauacacuuaguuuaaaaauauaacuaaauucuucagguaaaguacuauauaauacauugcucgguucuauccagaaauaauaugucuaauuuccaauuacugaagaauauauuaaccuuuuuuuuuuuuuuugagacggagucucacucuguugcucaggcuggagugcaguggugcaaucucaguucacugcaaccuccgacucccucaguucaagugauucucgugcuucaggcucccaagcagcugggacuacaggugcacgccaccaagccugccuaauuuuuuugcauuuuuaguggaggcgggguuucgccauguaugaauauaucaacuuuuuagguaaaggcauuaguaggguagaauaguugaggaucucaggaagagggaaguaguuucauuaacugaauucccuauacugcuuguacucaauguaaaccuuuuaaagaaaggcaguuuuguuguuguugauguuuguuuuucaauuuuuuuugguauguuuauacggcuucacucaauagcauuucacauuuauuuuucuuauguuuuugcauuaguuugcuacuacuagcaaacaaguuaaauuagaaauauucaggcaaaagguauguuaaacucaauacuagcugcauguuaccuagauguuaguguuacuauacuuuaaagcaagaugacuauaaguuuugaaagucaaguuuuaguuacuauagauuuaauaauaaggcaguuacacaggcuaagcuugacuggugccauggacuuuagcauaccuggaaauagaaaaauucaaauuguagcuguucuugguuggcccauugccauuuuugcagcuuacaaauuguuaauuaaguaacugcagugagcucaucucuacgggauacuucuuuuccagggcagguccaggaacugggucuggagccuugaaagcagaagagaaacuagaguaaacuagagguaggcagaacaagaaaugugaccagauaacauuaugagauguaauagcaguaagguaguccccaaagucucucacauaaaauauucugaagggaaaaugggucucuuaaauugcaaguaaccaaaggaugcuguuuacuuugguuaagccauucuuuuaaccuacccaacacuauucuggaaucucaguuccagcaacucaaaacaguaguuuuuaugaaaucucuaauggcuuuuagcaacagacuguccaacaggagaccacagaguaacucuaacagaaagagaaaaacaacaacaaaauccaaaauuggaaauguaaaguccucauuuucaggucauuuuucucuucccuuucacuaucguauuuccaaucaucuucuaaacgcuccccuaauuuccuaugauccauucccagggguuucuuaagaaaugcuuuagauauauccaagcaaugaauugaauguuaaguuccaauuuuuaaaaauacuugguaauucuuaaagagggaggcaaagaacagcucauaagaugugguucuuaaccacacuggaaaaucuuuuuuuccauuaccaaaauagauucaaugauuuuuuuuuuuuuaauuuuuguuagggccauauaaaacaaaaaccaaaaacaaacuugcaacuacgaagguuacagaaauaauaggauauuaugaauaguagaauguuguacuauuuugauuauuaaaaccuggaaaugauguccuuaugcuugguaggcugguacccuuaggcauuucccuaagaaacuaaucccacaggagucaaaauaaauagaauuuucugcugcucucaaauuaucauagauguugugaaaacuguaauaggacaaaaaaaaguagugaagacgaagauccaaaaacugaauucccugcauuuccaguaacuagcaauauaaacagcaaaacagaguaaaaguaguuuuugugaaaaauguaaauuuuccaucuauugugauggcacauugcaggacaaggaauucugugagagagaagucuaaguucagaucugauuucaguauggcuuugaaauuaaacugcagaaaucucuuuuauuaaauggaauaucacuacccacccugcuguacuguccaugagauuuagcuaaaguguauguaaagcacuuaacaguguggcacauauaggcauucaauauauuuuucugcauuauuaaagaauguaacacauuuucuuguucuaaacauguggguauacuuaaguuuucauuuucacaaaugcuaaagcaacaacuagguagcaggcuuucgguuuaaauaauucaacuauaaucacauucuaagacauguaacugauuaucuuccagaauagccacaaauugaguauaugagagaggucaauuuugagagcugaugauaaauaaaaauauaacaauuuauauuuaggauauaaaaagaauuaguaguaaacaagaagacauguaauucucuuuccaaguaaaguauaaaauacuucugucaacacaucucuuguuaaaaaguuauauauagauccgguauaauccuuuuuaaaaaaacauaaaagcaaucaaugcaugauauaauuugguccuuaaguuaggaaauguuuuaagggcaaagaaaagccuuauauaugggcaauaauuuuccucuuacugauagaacaguggguuccacacaaaauuauuauuuaccaaauauggcucaaagaucagauuacacccucucuaaaauuaccaaguaauagagcaaguaucacaagccacaaggaauuuuaaaaaaugauuuccuuauaguuguuuuaaguguauucucugccacaacuucauuuuaaaaguuuuaaaaaguuaacauggaagugucuuauucaaaauauacuaaaacuuagaugauaagacugaauuacugcauuccucagaaagaaggggaaaggguauuuaaguuugaggauuuccauucaguaacucauaugaauaggcuuucaguuuaaagaccaucaaauaaaaaaaccacuucagauaaaccacuuuuuuaaauuuuuuaacuagucaucauacugaaaucucauuacuuauaguaauauuucaguugauucucuuggcuuuuccagguauacaacguuauuuacaaauuauaaugaacuugcuuuuacucuuuuaaaaaaacauauuaaguaauauuuacucaucgaaacuccaauaagcagcagaguuaaaaccagaaauguaucuguagcugucuaaccucauguccaagguuccuucuuuauuguacuagcuugacguuacuaauaauuuucuuucugaaaacuucuuuuccggucaacacucugcauucuaguuucuuagaauucuuauuucuaugccucuuauuaauguuagccaaaaggauguagguguaaaguuauaacauucauucucucacuuguuccucuggcaucuuauuuacacucacagcauaaucuaaggagaaucuccuuuaaauuguaguuuaagcuuuuuauucuacuugaugaaacuuaaaagauuccgaaucauagauuugauguugaaaggagccuuauagauuaucuaguccaacacccuuauuuaauagaagaaaaacauaaaguucaaauaauaugucaguagaaucugaauaaaaguuuaacacaaaaaauuagcauuauuacuuaugaaucguaaaguaaaugccuacauuuauauacaguaaauaugaacagagcaauuaaacaaauuucaagaguaauuauugaggccgggcaugguggcucagcacuuugggaggcugaggcggguggaucaccugagugaggucaggaguuugagaccagcuuggccaacaugguaaaaccccgucucuacuaaaaguacaaaaauuagcugggugugguggugcacaccuguagucccagcuacuagggaggcugagguaggagaaucgcuugaaccugggagguggagguugcagugggcugcaaucgcaccacugcacucuggccugggcaacagagacuccgucucaaaaaaaaaaaaaaauaaauaaauaaauaaauaaaaaagauuaauuauugggccgugcuucuuuccuguuaaaaaacacuuaucccuauuucuaagagaguuuacuuauaugacagugucaauguaugaguccauuuauuaaaguggauuuaaaaauuacagaauggcagacaaaaaaguuaaaaccuacuuaauccuacauauuuaugcauuaauuauaucuuagauuuuuuuucuuuuuuucauuuuuuuugaaacggagucucacucugucacucagcuggagugcaguggugugaucuuggcucacugcaaccuccgcuucugcaaccccacuucaagcgauucuccugccucagccucccaaguagcugggacuacaggcgcgugccaccacacccagcuaaguuuuguauuuuuaguagagccaaguuucaccauguuggccaggauggucuugaucuccuuaucucaugauccgcccgucucggccucccaaagggcugggauuacaggcgugagccacugugcccggucauauccuagauuuucuaacaaaauuacgcuaucugugcuucccacgugaguugauguccugacccaguccaaaagacagaaacagcacggacugcuugcuacagcacuuagaacagugccuggcacauggcagcucccauugcugcugaacaauuacuacucuaaauauauucacguuauaauaaauauagccauaggaaugauucaaccauacagaaaagaauccugcuacaaggugaauuaucucacucuaccccuuuuauucuguuuuccagguuugguuccaugaguaggaucacaaccuucacuuauuuaggcacaccuuuccaaucgauaauuucuguuaucaauucagaaacacuaagaucucaaucaacaucagucuguuaggcuccuuguagguugcuguuaagcuccuucuagguuucauuuuaaaaggaaauuuuacacuccaacaacuuccaagcuuucaugugaagcaaaaauauguuguuucaucuuaauuguacuuauguuuaaacuuaaacucuuccaauacuaguuucccuccucaacuuuccauuuuugucagaaauagcaauuucuuuucagccugcaaagugaaguuaccuuaacucuucucucuucucuuucuuuaccuuuacccaacuccuugaaaucgcauccauuuuguaauuaacauuccuuaaaauacaacuucuaagacucuccucaaugguuauuacagucaauacaguccacaauuacuuccauaguucugaaauaaaaugucaggacaagauuuuuccacgaagcuucauauggaaacucauuuggugguggcaaaaaucugaguugaaccgauguaagguuauuuacaggcuugauuuagcccacuuacugugaauauuuucaccuucacugcagagauacuagugucuaguuacaggaugauaccucagaccuugcugggagaguuauguaauauacaauauacacguuaccuuucccaaauccaaaaauguuugaaucccaaaacacagcuggccucaggguuucagauaaagcauuguggaccuguauaauauuauucuaggaauccuaauuuaggcacccuauacuuaacuuucuuccugauacucucucuuaccugacuccaugcaucucagcucccauaccaccaaguucuauuauuuuuucuuuccaauaucuccugcaauuuuacucuaucucuaacugcuuaccacccuaucccuaucaucaaacauauaaaugaccagacccacugcuuagcucccugccagucuucccacccucuguguaaguauaguauaagagauuaagaaaguuuccuauauaaccacuuuaaauauuucacucaauugcagaggaauuuaauaaacugaaacagauaaauaauaaaagaggaaggauagugacugugguguuacaagaugaguuucuguuauuuuuuuaaacaguuuaucuacaauugugagcuaagaagaguuugacccuuuuuucuaaacugguugaaacuuugaaauuuucuauguuaacacaucuauucuguaacugaaacaaaacaaacaaaugaacaaaauuggcaaggcuccuuuccugcuuaucacuucagcuaaaaccccucagugugguuuuucaaugccuucuccaguuugguuccacuagaucgggggucaugaaucccucuggcagucuggagaaagcuacagagucccccucagagugguuuuaaaugcauaaaauacaauaucuaggauuauaaagaaagccaguuuuacuaaaauauaguuguuuuugaaaauaugguuuuaaaugcauaaaauauacauuacuaagaaaaccaauuauaccgaaacaguuaucaaguguuuuuaaaaaccuuguaugugauauauucauacauaugcuucuuuaguaauaauacaauaaaaucuagugggagucuaauaaaaaccauaauucugaaguaguaauaugcauaaauuauagagauaucaacagcuguaaucugaaaauaucugugcuuuuucuauuaguaauaaaagauauacguacugcuaauauuacuguagucugccgcuuaaaaucuuauuaaaaguaaaugcuaaauuucaguucaaaguucauaaaaauauaaagaugucacuuuuuuuuuuuuaucuaaaugcaugcagcccucuaaauuguaucccuggaucccuucagggucuugcagauuaaaacuacucuauuaaauucaccugcuucuauuucccagcaguccccacacccuuaggaaucugggcaggccugucugaacauguucaacccacacuuuccuuucuuugcuuacuacacuacugcccuugcuuagaauguuaugucuucaccuugaggcuuaucaaaaucuuaacuaccucuucaaaaccaauuccaauuucaccuucuacuugaauucuuuuuauccugcuucagcccacauggaucuuuuccuacaacuacuaauguagcuguaggucaaugcuuuaugaaucaacauuuaauuauucucuuacagucuacuucugugucucuucaucuaaguuauaagauccccggagacaugugcuaugugcuuacacauagaacacugcauauacauaauauaggcacauauaaaguacucagcaagugcccccaauaaaucaagcacagaagaucaucuguuuggcaacuucgaguaccagaaaauacaucaagauaagccaaaaguuccacuaaggaguuaaaacagacauaaauuaggcuuauaguucaccucuaucagaaccuagauacuccuauuuaauuaagaacccagaagcuuauuuacuaggcagcaaugaauuccaaguaauaaaucaaggaaggagcacuaaagucagcacaagacaaugauucauuccaaacauauugguuaagcacuacuacgugccaggcacuguucuagaaucuaugauucaguucucauauagcaacuuagugccaggcccuggacuagaacccgggguuccugacucauucugaagcucugaaacaaaauguuuauuucuaucuuccagaaaagguuuaguaugcaggguaaaagugggggaggggaggagguguuacuauuucagaaagcagcaaaguaugugaaacauuauaaagaaauagauuuggagguaugaauaucuauauuuaucuacacacaauauacauaauauauuguaaaaucucuauaaaaucucuaaaauagauucaggaguaaguuucaaucauuuuauguacuuacuaccuaagaauacuagaugaaugagguguuacucugcuuauuaauauuuuaaucacaaacacuucauaaaauuguauuuuucuucaaagagcccugccaaguugcuucauuuauuugauguaaaaauaaaaaacuaggucagguauaguggcucauaccuguaaucgcagcacuuugggagaccaaagcaagaggaucacuugagccaaggaguuugagacuagccugugcaauacagcaaaacccugccucuacaaaaaguuagaaaaaaaguauuagccaggcaugguggcuggugucuguagucccagguacuugggaggcuaaggugggagguuaaggcugagcccaggaaguuaaggcugcagugagcuaugauuguaccacugcccuccagccugggugacagaguaauacccugucucaaauauauguauguaaauauuauauauauguuauauauacacacauauauuuuuuauauauauaauacauacauacauacauaucuauauauaaacuuuucuaccaauuuccuggaggugaggugggguggggugguaguaaugaugguaguagauauuauucuaaauaaucuucaccuuuuucccuggggaaacggaccaaaagaggauaaugagaauguggguaggaaauggggaauuggucuccacaaauuucaagcucuacugcugacugugacuaaaaaaaauuacuuuuccuaaagggaaguucuuagacuaauagcaauggaauucagugagcgagugagggaaggagggaggcggaagggaggggugggacuggaacaaguaaacuaauagccugacaauaccaugcuggcaaccuaaagucaccuuguccaaaacucaacucacugccuccuacucacuaauguauuucucuguuaauuauaaaugacaugcuucugaagcuagaaaccucagaguucucaauucuuuuccucuccacauauaaucaauggcaaaguuucacugauuacuuucacaaaaauuucucuuuuccaccacaauguccuuguucaaguauguguuaucugggcaaucaccuaacaccaugaccucuuguuugacugcuuguucuacucuuaagguuuucuuuuuuuuuuuuuuaagagacaaggucuugcucuauuuuccaggcuggagugcugucauguaaucauagauaugcagccucgaacuccugggcucaagugauccucucaacucagccucuugaguaggcaggacuacaggugcacuuuaccugccgaguuaguuuuuuauuuuuauuagagauggggucuugcuauguugcccaggcuggucucaaacuccuggcuucagcaauccucuugccucaaccucucaagacucuaguauuacaggccuuaugccuggcuaagccuuucuaaacuguauuucacagugguaacaaacuuggcuagcuuccuaaaaacuggcugaaucgugucacuuuccucccuaagaaaggcaagagauuuuguagagauacgcuguagugaguuucagcagaaggugcugacacugacacagggaauaaugaaaaaaagguaagagagaggagaccugaggaugaagaauuuagaauaagucagaaaaaucaggcagagaaaauguugggaagaaugguaucaagaaagccaagugaagaguuauaacaaaaaugauuauaaaguuuaaaguuuauuauuuuuauaauuuuauagcaauaaauuuucuauuaauagcuuacauuuacuaagugcuaggcacuaggucaaaugacuuauaaugcauaaacucaucuaaugcucccaauaaucaugugaggcaggcaccucuauacgagacucaguuaacuacacaguuuguccuacuagacaaagaauuauuuuauacagcucccuuuccuuauucccugagaugcuuaaugcaaagcacuuaaacauucuuacuauguuggugucaacaauaccagagaaagacauucuuuuuacaaacuuuacuaauuugccauggacuaacacaauauauguaucuguacacacagacacauagacacacacacacacacacacacacacacacacacacacuauggaucuggaaauaaaagaauauaugguuuuaaaaauacccaaucuccuaauauuuaaaucugcauuggaauaguaagggcuaaggguauuuuugucuuguaaagcucaaaaguggaaagguauauaaaaauacugaagagaaacuuggccuauacaucuaccaucuaccugaaaaugggcagaaggacugcguagaagacagacagauuaacauuccuuucuuuuaaaaugugcacaagaaauuuccuaggagacaugcuauuauggacucaacucuaaaccuagccuacuauuugcaauguguacuccauucaacacaagaaaucugggccaaaguuuagacgaauuugcagaaauccauuaccacuagggaaaagagaaaaaagaggcaaaauguacgccucacuaaucuuggguuggugacgcugcuauguaugggugcaaucucuagggcuagaaugcuuguuuggaagcaucagaaagacauucaaccacaaccuguacuccagaaucccaaaagcucauuuacuuucgaaaacaaucaaguuuacuagcucuaaacucuaguagucuguguccauucauucacaaauauuuacugagcgcucaagcgccaagguauuguacucaugcuauaaaaacugacauuuagugggagaaacugaaaaguaaacagauaauuauaauacacauggcaaucuugcaauggggguaaauaaaacgaagugcuagaaagauauaaauuaucaauaaggaaauauuauuggagcuaauaaucaguuacaacagaaaaaacuuguggcauuuaaaaaauuuuccaaauuacaugaauuuaaaguacacaugaucacagugggacucaggagacaugucuuucuacaaauucucugugacuaagacugaccugcucccuuuacugauguauuucuggcucuaagccucuccuugccagcuauuuuacauuccuguuuuucaucuuuauuuuucauuuaucucucuggcuguuuuuaucuguaagauaaauguugccacagaaagucauucgggcacuuaauaagugucaaacccuuuccacaacauguaguuacuucauuuuauaaagauuuagggcaaagcucuaaaaauuaguaagacacuauuagaugaccacuguuaacagccauuuaccuaucaaauaaguaugacuaaguacauauuaaauauccauccccaaaucaccucccaauuacaaaauuucuguugcauuucaugucacauacacagcagaacuaauccaaauuuucacaaagcucuuucacauguuagaagagucuggcuuuuugcuaauaaaucugaaauuacaguaacuagaaagcagucacagguauaguuuuaaacaaauaccacuauaacuucuuucacaucaacuccacugauacucccaaauucauauuucuagucugaaucucuugcuugaauuccauuauaccgaaugaauugcccaguugauaucacugguuauaugucuaaaaggcauuucaaaguuaacacauccaaaaaaaaggcuccugauugcucagucuaaacuugcuacuuuaccaugcucccaaacugagucaauggcaacuccauacuuccaauugcuugcgccaaaaaucucuugucauccuugaauucucuuuuaugccucagauccaauucaucagcaauuccuucccacacagaguuugaaacauauccaaaaucugaucuguucucacccuuuccuauuacuguccuggucccagccaccaucaucuaaguaugacaauaauuucuaauauauuuucccuguuuaaaucuuugcucuaucuccaaagucuacuccacacacagcagagugaauauuuaaaaagguaaguaaccacuagcuaccagcuuaaagaauaaaagccauaugaccauaucaauugauguagaaaaaagcauuugacaaaauugaagaccuacucaugauaaaaacacuuaacaaacuacaaauaaaaagggaacuuccucaacuugauaaacagcaucuacaaaaaaccuacagcuaacauauacuuacuggugaaagacugaaugcuuuuccacuaagaucagaaacaagcuugucagcucccaccacuauuaugaaacagcauugcaaguagcagaggaagaaaaggaaauaaaaagcauacagauugggaagaaaaaaauguaaauaacugucucuaugcacaggcacaucagaaaacccaaugaaucuacaaaauaaaccuccuaaaacugauaauuuagcaaagucucaaaauauaagauccacucacagaaaucaaccaaccauacugccacauauuagacaugaacaauuggaaaucagaauuaaaaacacaguaucacuuacaauuguucuaaaaaauauauaucuagguauaaaucuaacaaaacaugcacgggauuuuuaugcuagaaacuaaaaaaugcugacaaaagaaauaaaagaauuaaauaaaagacauaccauauaccagguucauggauugaagacucaacaaaauaaaaaugucaauuuccccgaaacugacauuuuacagauucuaaauuuuacauggaaaggaacuagaauagcuaaagcaauucugaaaaaggagaaugaaguuggaggaauuucacuaucuaauuuuaagacuuacuauauagcaauaguaaucaaacagugugguagugguggagggacaggcacaaagaucaauggaacagaacagagaauccagaaauagauccucacaauuacggcuaucugauuuuugacaaagguacaaaagcaauucaauaaaggaaggauagucuuuuuuguuugggaccuaagguuagccaguguucucagacuugacaagaaaggcacaauccauaaaagaaaaaaaugcacaaaaugaacuucaucaaagcuaauuuuuugcucugcaaaagacccuguuaagagacuauaaagacaugccacauacuaggagaaaguauuuguaaaucacguauucaacaaaggacuuggauauagaauuuguaaagaacucucuaaacucaacaagaaaacaaaacaauucaauuagaauaugagcaaaagacuugaacacauuucaccacaaaggauauguagacagcaaagaaguacaugaaaauauguucaacaucauuagccauuaaggauaugcaaauuaauggucacuacauacuauuagacugggugaaauaagaaauacugacaauacuaaugcuggagaggaugcagagaaacuguagguuucucacauauugcugcugggaauguaaaauuguacagcuacucuggaaaagucuggcaguuucuuauuuaaacauacauuuaucacgcaacccaacaacugcacucuugggaauuuauccuacagagaugaaaacguauuuucacauaaaauccuguaaaaccuguucacagcaguuuuauuuuuacaacccaaaguuggaaauuccaaagucaaauugugguauauccauacaaugguaaacucuuuagcauuaaaaaggaauaaauauugauaaaugcaacaauuuggaaggaccucaaggggauuauacugggugaaaaaaaaaagagcccaucuccaaagguaacaucacguacgauuuauguaacauucuugaagugacaauuauagugauagagaacagaagcagguaagugguugccaggaaggaaaggugaaacuuaagggguaaaacaagggagucucuuuaugaugaugaaacaguuuuuauaaccuaauugugaaggucacaugaauuuauacauauacauaauaauguuacagaaccacacacauacaaaugucaauaaauaaacaauguucuaagaagugagggggaaaauacaaauuagauuuuaucuuaaagcccuuuggugacuuccuaccccauccugaguaaaaucuaaaguccuuaucacagucuaaacacccuacaugaacagcauacacaguuggauaccaucuacccuacuuccaccccccaaccccgccccccccagcuccaauuauauuggccuuccugcucuuagaagauggcaaggacaucccacuuaaaggccacugcauuugcuacugccucuauuuucauucauguaccugcucaaauguuaucuaaucaagacaagcauucucuaucuccuccauaucaagugaagucuuccucuuucucccuccauagaaccuuaaaaucaacaaacagaacucaaaugucuuccucaccuguugcaacccuggucuguucuguaauggugaacaucaccaucacaacuaugcacccagggcaugugugaucuucacugcuuuaugucacauucaauuauuuccuucucaaacacauuaccuauucuucuuaauuaccccauuaucagugccuuaauuuggguccuaaucaacucucaaauagauacuuauaugccugccucuuccucccaagucuggcucuuuucuaagguauuuugugcacuacaacaagagaaucuuucuagaauguuaauuuaagaacuugucuuccauccauuugaaggaugaaguuaaaucuccuuuauggaguauacagguaucucgaugcucugucuuuuuucuaauuuuccaccucacuuccagcuaacccaccacugguaccuaaugcacuguagaacuacacacaguuacuguguacauguggacuuuccuaccuccaucuuucaugcaugguguuucucucuaucuaaaaagaccuaucugcagccuguaacucucuuccuugccuaucugauauacacucagauuaagugucaccuuuccuaggaagauuucccugucauauccuuucaucccuuacugaauaggagauacugccuaauccuuauccauaggagacacuaccuccuauggauuccuaaaguauuuuauguuuaaccccgucacagcauuugucacaguauaucacauguguuuguauauaugucucuuaaggacaagaacuguaucuuacauaucuguccaccccuuugaccuagcaaaguacaggcacacagcaggaacucaaaacuauuggauaaguaagguaguuugaauaauaaagaauguagaggccgggugcgguggcucgugccuguaaucccagcacuuugguaggucaaggcgggccaaucacaaggucaggagauugagaccauccuggcuaacacggugaaacccugucucuacuaaacacacaaaaaauuagccaggcgugguggcacgcaccaacagucccagcuacuugggaggcugaggcaggagaauugcuugaaccugggagguggagguugcacugagcugagacugcaccacugcacuccagccugagggacagagcagacucccucucaaacaaaacaaacagaauguagagaugagacacaauagaagaaugaguaaggcaagauuucuuggguuagccagcuauucugcacaagcaugucauagaagacauaugaaauacgcucuauggaguuucuguucuuucgaucaugugauauucuauaaaaguugauauacugauagauagcuugguuugguuaagaugaccacuucaaucuucuaccuaauuacuucaacuagguaaugaacuaacuucaauuagguaaugaacuaauuaccuucaacaagagcacuuacuucuuguuccacuugcaaaauuacagcaauggcucugucauccuuuaaauguauggcaauguucaugaggggaaaaaucucaugaagagaaugaguaugucucaugcaggccaaacaauuaccuuagcuagacaaucucaaagggcauucaacacgugucaaugcacuuuuauaugcaaaaaagcagaaucgccauauguggaagugggaauuuucuucugaaauccccauuuccaugugcuuauuuuuccauuuccuauaaaaucauccuaagaguuggcaagcaguacuuuagucaaguacaauucagguacaugcuaaucaugggguaaacaguaagucacucucaaugcaaauuauaaaauaucuguauuucuagcaacuuuuauuugacacggaucccuuggaugguuccuugagcacauuuucucacaauucuaguaacuacuuaacugugacaccuacauacaucugcaacauacagcugcuuaacuucugaacagcagacgcucauguuuaucaggucacuaauugccuuuuaaaaauuaaccaaguugccaggcucaguggcaugccauacguaguccuagcuacuugggaagcugaggcaagaggauggcuugggccuagaaaucgagaccagccuaggcaacauaacgaaacccccauuucuaaacaaauaaauaauaaaucaauaaaauuaaccaggcaacuaugacauaauuugugcucaguaauuaaauggaacauuuaaucugucuuaaauuuuuaaaaaacgaccaucuugccuauauuuuauaaugaugacaacccuaauagaaaccuacaaucaggaaaugcuaguauaaaagaaaaguguaaaagacaaaauaguccauaggauaucaagaauguggaagcaaauaucuguauaauaggcuuuguaccacagaucugaauauuaauauuuaaaggccaguuucucccacuuaaauuuuuaugcaauuauuagcuuugcugaacauaagauaaacucuugcaaacuacaaaaaagcaaaauuaauuugcugaccuaauuauuacugauauuaagugaccuauccaaaaggaugugaaaauguuagguuuucuaaauaauggcauuugaucaaaacaaaaaucaaauuucugugcauaauacuucacucuacauguugacuuuuccaacagcaaaagcuaaaaaccgcuuaaaaaagcaaggcugaggauggguggaucaccugaggucaggaguucgagaccagccuggccaacauggugaaacccugucuuuacuaaaaauacaaaaauuagccaggcaggguggugggcgccuguaaucccagcuacucaggacgcugaggcaggagaauugcuugaacccaggaggcaaagguugcagugagcugagauugcaacauugcacucuagccuggacaaaagagcaagaccccgucucaaaaaaaaaaaaauaauaacaaaaacacaaggcugaaaagaccaacauguaccuuauaauucuuucugccaugauaacaugucauuuauccaaugauuaaugguucaaucuccuauuugugcuucugguuuuauuuuacagauugcauaaaaacugcacacguguaagauuaaagcauauuuauuaccucuaggcuaagagauuucauguauauacacuacagaaugugcuaagccuaugaacuuaauaaaaugcaaugacuuuuuuaaacugucuuuuuuuuuuuuuuuuuuugagauggggucuugcuuugucacccaggcuaaaaauuuuugucuuaaucuacugaguaaaccaguguaacuguuguagacuauuuugcuguaauaauuaguauugaaugcuauuuguauaaccaauauuuuaacauaauaauacaauuuguuuacucuucuugguacuauagcaauacagauaacuuauuaacaaaauauaaaaccauugcuauagcugcuguuaaaacaggcugggugugguagcucacaccuauaaucccaacacuuaggugggaggccaaggcaagaugauuccuugaaccuagcugcucaagaccagccuaagcaaaauaggaagaacccuucucuacaaaaaauaaaaaguaagcugagcguugugguacgcaucuguaaucccagcuacuuggaaggcugaggugggaggaucacuugagccugggaggucaagacuucagugagcugugguugugccacugcauuccagccugggcaacauagcgagacacugucuuaaaacauaaacauaacagaaaaguauaaagaucauuuuacacagauaaaguggcacaaguuuuguaguauuauauuaaaccucauauuugagguguuuucaaaaucuuauccaugccaauuuucuaaugcuuuuccuaaagaagaacuauauuauagauuuguggacuaauuucaaauugaaaaugcagcuuuucccacaggaacaggcaagaaaaauacaaagaauuaacaauccguauguuuauuuuguaguuaaaaaaauaaugaugauguuuuguuuguuucaucuuggucuaaggaguuacaguaaauuaaaaaguacagaaauucuuuuuucauucuauuuguugaggaaaaaugaaguggacagauaccuugaagaaaaaaccuaacgaagcaaaauuccaaauguaaaauuacuuccaauuacuuaagcuacauauccuaauguaacuagaacaagaauucaccuguucuauguaagguagguauuacuauauccauuuuucugaagaaaacuccuuggcucagagugugugaaugaugucuaaaaucacauagcuauagucagcaacagaacucagguuugaacuugggcucaucugguuuuaaagcccagaacuuuuauuauacuucauugacucccaacacgguaaaauuaagauauuuaguuaaagaggugggggcugagaagcugaaaaauuaacaaagagaucaacuaaaaaccaaaagcaguauuuuccuagccugggcaacaaagggagauccugucucuauaaaaaauuuuuagaaaucagcuggauguaguugcgcacacuuguagucccagcuauucaggaggcugaggugggagaaaggcuugugcccaggaguuugagauugcagcgagcuaugauugugucacugcacuccaaaaaaaaaaaaaaaaaaguaauauuuuccacaguuuaaaaccagguaaagucucuucuaccccuauggccccaguucauaucagaauuacugcuuuuguugauuucucugacuaaacaaaaguugcuuggccugaggacaauguucugcaaggucaaguugcugaguucaaguuuucaucugcauuagcaaguauuuuucucucauugaugaggaauggaaagucacuccccugaacugcccugccacuggcucuauacugaugagccaagcaauaucucuggccugcuucacuggcaaacugacaggaagcaaacuugugaugugcucaauuuugcuaacauuaaaaaagguaaacauuaagauauuaaaggucaaaaauaauuuuccuuaauaucaaugugagaguaaaacuuuaagcuaaaauucaaaauaauauuaauaauauuauuuaaugauucagaugaugguuaauaaacuggugaauaaaaauuuauagaucaaaaauuacucuuuccuacacauuuuaauggauuauuuuaaacaagucuauuauuaacaaucggcauucacacauuucuaccaaaaucucugcuaaaauccccauuccuauacucuugcugcuucucucucucucucucugcaggaccuuuccaaccucuacuuuauuaucuggcuucugugacuuguacuaggagcacugguacuaggccgguuuuuguuuuucuucuuaagugaaacaagaauuccauuuucuuuuaacaaggcaauuaaaauacuacaaauucuuauacugcucuugucucuuguacuuguuuguagguaaaucagacuuccuuucugaagccacucaaacugacaccuuguaggaauuauuucuguccuguaguagacaguuauuguucaaaaaaagcaaagaaaaaaaauuacaagaguauaaaauauucaguuguauguauuccuaucucauuucuaaaguaguacuguggcacaucaaauacuaaaaugaaauacuuuucauccuauuuguucauauuugaauauaaagcacacgauacaugcuuuguggagaacuuuuuaaaaauccaagaaauauuuuggguaaaugacugaaagccucauaaccugacagaagucuuaaguuuggggaaagcuaaaauuauuauucuuuagguagaggauaacuuacagcagaacaggaaagaguugacugguacuaagauuuaggcaucugaagaaugcuuaaaauacugugaagaugggaggugggaugcuggugggacguuuucacuuuucagugaaaacaccaguauuuccuguaucacagaaauguaaguaaacgaccaagcuauuuaauccauaaaaccaggacaaaucuacacuuucauugaaauuaucuuaaaaagauaagguaaacuuguucuuuaacaguuaagagcaaauaauuauucauaaauuuucuucuacucuuuuaaaaacugcuauauuacuuuuucacuuugaugccaauaacaucauagaaauagguuaaugaagacuaaucuagcuacaaauaauugauuucuuccucucaauuucuagaauauuuuuugaacuuuuggcuagauucacaaaauagcauuuaagagacuuugcauaaugauaucuuauucagugcuuaaaauuaaaaguagagauuccagugcagucaccuuucagacucaggaguuuacuacaaaaagagcuguaauuuacagaaaaaugaucauuaagaacuauucaacauuuaacacacaguauuucuugagcucuuaacuacaggccaaccacugaaaauaaugugaaguaaagacugaaaggaagacauguucugcacuugaggugcuguuucgugaucuuccagucuaaaaaugaaaauaaguauugcaacuugcaugguuauuccacucuucccucaaaaaucccauucacaauuugaguuauuuuaucuuugcaaaaacuuuccuuaauaauuuguauaaaagauucuuugaauuaacaagcaaaaugaugacaaaaagcaaacauuuacucuauaguuacuaugugccagguacuguacuaaauauuuuaaaaguauuuacaugaauuggaauuuuauacacuguuauuuccuuguuaaaaugcugagauccagcucaucaaccuauucaacaacauacgacacaauguuccuucaccagaaaaagaaagauaucguauccauuuuacacagaagaaaacaagcucagagaagcuaacgaauuuuaacugaucccaaaucuaguggcaaagcuacuaaguggcaaaaccaggauuaaaaacuccgauuuucuauccagccauaaaacagcuuucugaaauacuaacaauaggaaaucgcuguugaaacucuguaacuuugaaguauaaauacaauuguguucugaaauuugaaguguauucuuaaaggaaaaauuuuauguaugggauagguuuugcuuuuugaaaucaaggauaauacccauuacacaguuuuuaaaaaagcucaauaagcaauguucauucccuaacucccuuuuccguuuuauuuuucugcacaguacuguuuugucccaggcauauuacacuguacucauuuauuaagucuuuuaccacuaaauguaaacuauaugaaaacagcuauuuuugucuguucuucaauacggcaccuccagcaucuggaagagucccuagcacauaauaagugcucaauaaauauuucugaaaugaagaaaagcuuggcacacaguaggcauucaauaaauauuaguuccuuucucuuuauuaugcaggauaucacucccuggguaccauauucugaacuggaauacaugauuagaaaugaaauaaaauuucuuauuaaaguuuuacauuacacaugaguaaggcaaaucaaaaagucacauucagcaaagccucauuuaugaagcauaaagguaaggggguguauguaaauuaaauuuugaacaaauguacuuuuaagugccaaaacuuuaaucaauuuucauagacaucuuuuauucauauaacauacacaauuuuacuuugugauaauucugacuuggauguccugaaacaucacuugucagcugacacuucucacucugcucacuccuuuucuaaggaauaggaaauaaaguaaacauauucuguaaaaugagucaauaaaaauccaagugaaaauccaagugaaacgcauaaccucaacguaggagcugugggaucauuauucuggcaucuuuuucuuuuccuaggaggcugaaugaauguagguuaaguaccacuuacuaguaaauaggcuguuuugagagauggaauacuuagaaaaagauaguacccucuuagcaaucucuaauuccuuaguuuuaucaagaucagucaaguuuagugauuaacuaaagaaaacauaaaaaguauaacuccuaagaguacuuacucagguuuuuuagcuuucugaguaagcagcguccuugauuuuuuaggaccagaaucauaagaaacaaaauguuaaaauacuguuaaguauucuggaaauaugagccagaggcaaaaacauaugaacaugcauacauuuaaauucuauauaauuucaaugucuccaaauccuuaucauuuuaauacagaggguuuuaaauaagaugacauauauagagugucagaaccuaugaaaagguucagagacaaucuccuuuguacaguucagcaugaucauuuuccugugcuuggcagccaccacuacccacaucuccacauuccuagcugccuaaaacuuuucaucuaauucucugcuagcaucuuauccucugucucuccuccuccuuauuacuguuuugcccaaucuucacaugugccucuguuauuaccucauaauccuuccauucuagagagacccaauguuagaucaaauaaagaugacauaagugaaacaaaggaaaagugcuacuaguguucucugggucaugggaaccuggccagagagagauauaauggaauuauaauuuggauuuuucaauuacaguuuaauuuaugaacuuuauauauuauaaagauuaucaggaacuuucccccaaaauaucuauaacaaggcaaaaauucugaaguaugauaaaaaauaaacuuuuagucuugaucuguuuauauaacucaaaaaaaaaugcuguuuuagaaaauacacauuccucaaggacuuuuuuugcaaguaacucauagaguaaaacagccuacauuauacuuauuuuucaaaaugcaguagguucacagauacacauauguacauuucacucuaaacaguauuuugggaaaagaaauuuuccuuacugggaaaauuacggauguagaauaaacuucuauuucugccaagacacaaauguaauaagacauuuaaccaaguguaaguuguuaauacuaaagaagcaauucucaauacugaccuaaguggggaucugccuacauaacugcggaguuuaaaaaccucauuucauuaggcauuugggaggcugaggcggguggaucaccuaaggucaggaguucgagaccagccaggccaucauggugaaacuccaucucuacuaaaaguacaaaaauuagccgggcgugguggcaagcgccuguaaucccagcuacugggaaggcugaggcgggagaaucccuugaacccgggaggcagagguugcaaugagucaagaucgcacuacugcacuccagccugggugacagagcgagacugucucaaaacaaaaaacaaagaaaacaaaaacaaaauuaaaaaaaaauuguuucccagucuuagcaauacccuuagcugaaggcaagcgcuuuuuuccacuagaggaccaagcauaggugugauuucaaucaaacgggauuaaguuaaaauuuauuuuucaaaaaacauguauuugaugagguucugaccauuuuauccacuucuuaaugagucacuaaagcacacguucuacuaugaaauaguuaacuaaaggggguucaauaguagcauuucaucaguguccuuaagagaauacuuuuaaacucaggaaaaguaacucgaugcacacaaaagaaaaaagaaauaauggaguauauucaggggauaacuuauucaucuauaauugacguauucaacuuucaguuugauucuugaaagauuuaaaacuuaagcacccucuauuagaaacugauuagaccuaugggggaaaaacccaaacagaaguucugaaucacuggaauuuuuguucuauuuccuguuaacacauugauaguacaucauauucguuccauacauguuuuuuuaaagcagcagaauccuuaaacuaacuguacccuaauuuagccuauagcucauguaucuaacaauucuucccauuguuucuaauuaaaaugcucagccaaagccuacaacaaaagaaaagcaagucuuccuuuauuacaaacugccaugguuucaaaauuuacaguuucaaaccgucaaaaguuuaaaaucgugauuucauuguuacaaagaauguaaagauauuuuuuaaaaggugucaauacucugcuacuguaugaacaguguaguaagcagaagugaaaaaacugaaagcaaauauucuauuccaugcccacuaaaauucccggccaaaucuggaauugcauaaugaucaucauaaccuuuagaguaugcuaaagcggaaacgaaauuccuuuucuaaaaugugaaucaaucugaccccaaaauuagacacuuuacaaacuuaccuaaaacagacaaaauggaugcaaaauuauauugccguacaguugcucugaauacgaucuuagcguucaagaacuuuccaaugaauaaggguacucaacagccugcacugggggccuaaauuucgugaacuacggagaaaccccugugaggcugcaaauucccuccgcucuccuggaaaacccucuuaucagaaacauuugaagaauuuauccacaacaauuaagcugacuugaagaauggaaaccuaacaucucaaauauacuauauauggaaugaaacauggccaaacacauaaauacaaacucacacggucucugacacuuugguguacgacugugccugaacaucucacagcaucagcaacagaaagauccaccugucaccuguucagcaccgccaagagacccuugcagccucccugacucaaccacaaucguaggguuugagguugaugggaccgaaaaccagaaacauccagugaaauuuaaggggccacauauucauaguagggcuugccccccacuucaaagacggcugcagaaaaccaagauccgcaaaggaacgauguucucccucccgcccgacccccacauaacugccccgugucuguccccaaaacccccgccccugagucaucuuuaacuagaccucggcuccccaaaaggagauuuuuccucccccgcccccaccucacacaugccugggggcgggucaggggcgccgacgcagggaggggcccucccgagccccuugcgcccucccccacccggggcucuccuaggcgcucgauuccaaugaagcucccccuccccccccgcacggacgccccggagcccaggcccggcccgaugcuccccacccccaccggacugggggacucggggggccucccucuccgccacgccacugggggaaggaaagaggcggagggaggaagagugcaaguuagaagcgaacgccccgcacgggccucgcgaggcggcagagccccuuccagacggaggggggugcggggcgaugaggggagagccagguuggggaucccgccgaggcccggcagcgcuguccgcuuacccuuugccgccgccgcuucccccuccuccuccucggccgccgccgccgccgccucucccacuagggcagccgucuccaccgucgccuccgccaccacggccgccgccagcgccgccgccgccuccgguuccacccggcaggggggacaccucagcccucccucccuccccgcucagcccccuccgcucgcccgccgccgccaacucccuccggccgccgccgccgccaccgcuccuggcugagggggaggggagggggucgggcugggucgccccgccggcggcugcagcagaucaaaaacgacggcugggcggcgucgccgcuccccaauccucagcuccggcucgcucggccuccccaccucccucugcccccaccccccucgcgcucgccugcccuccccccacccccccagcucucgcucgcucucgccgcggcuccgccagccca

SEQ ID NO: 16197 - RNA, 94049 nt, Homo sapiens
ugggcuggcggagccgcggcgagagcgagcgagagcuggggggguggggggagggcaggcgagcgcgaggggggugggggcagagggagguggggaggccgagcgagccggagcugaggauuggggagcggcgacgccgcccagccgucguuuuugaucugcugcagccgccggcggggcgacccagcccgacccccuccccucccccucagccaggagcgguggcggcggcggcggccggagggaguuggcggcggcgggcgagcggagggggcugagcggggagggagggagggcugagguguccccccugccggguggaaccggaggcggcggcggcgcuggcggcggccgugguggcggaggcgacgguggagacggcugcccuagugggagaggcggcggcggcggcggccgaggaggaggagggggaagcggcggcggcaaaggguaagcggacagcgcugccgggccucggcgggauccccaaccuggcucuccccucaucgccccgcaccccccuccgucuggaaggggcucugccgccucgcgaggcccgugcggggcguucgcuucuaacuugcacucuuccucccuccgccucuuuccuucccccaguggcguggcggagagggaggccccccgagucccccaguccgguggggguggggagcaucgggccgggccugggcuccggggcguccgugcggggggggagggggagcuucauuggaaucgagcgccuaggagagccccgggugggggagggcgcaaggggcucgggagggccccucccugcgucggcgccccugacccgcccccaggcaugugugaggugggggcgggggaggaaaaaucuccuuuuggggagccgaggucuaguuaaagaugacucaggggcggggguuuuggggacagacacggggcaguuaugugggggucgggcgggagggagaacaucguuccuuugcggaucuugguuuucugcagccgucuuugaaguggggggcaagcccuacuaugaauauguggccccuuaaauuucacuggauguuucugguuuucggucccaucaaccucaaacccuacgauugugguugagucagggaggcugcaagggucucuuggcggugcugaacaggugacagguggaucuuucuguugcugaugcugugagauguucaggcacagucguacaccaaagugucagagaccgugugaguuuguauuuauguguuuggccauguuucauuccauauauaguauauuugagauguuagguuuccauucuucaagucagcuuaauuguuguggauaaauucuucaaauguuucugauaagaggguuuuccaggagagcggagggaauuugcagccucacagggguuucuccguaguucacgaaauuuaggcccccagugcaggcuguugaguacccuuauucauuggaaaguucuugaacgcuaagaucguauucagagcaacuguacggcaauauaauuuugcauccauuuugucuguuuuagguaaguuuguaaagugucuaauuuuggggucagauugauucacauuuuagaaaaggaauuucguuuccgcuuuagcauacucuaaagguuaugaugaucauuaugcaauuccagauuuggccgggaauuuuagugggcauggaauagaauauuugcuuucaguuuuuucacuucugcuuacuacacuguucauacaguagcagaguauugacaccuuuuaaaaaauaucuuuacauucuuuguaacaaugaaaucacgauuuuaaacuuuugacgguuugaaacuguaaauuuugaaaccauggcaguuuguaauaaaggaagacuugcuuuucuuuuguuguaggcuuuggcugagcauuuuaauuagaaacaaugggaagaauuguuagauacaugagcuauaggcuaaauuaggguacaguuaguuuaaggauucugcugcuuuaaaaaaacauguauggaacgaauaugauguacuaucaauguguuaacaggaaauagaacaaaaauuccagugauucagaacuucuguuuggguuuuucccccauaggucuaaucaguuucuaauagagggugcuuaaguuuuaaaucuuucaagaaucaaacugaaaguugaauacgucaauuauagaugaauaaguuauccccugaauauacuccauuauuucuuuuuucuuuugugugcaucgaguuacuuuuccugaguuuaaaaguauucucuuaaggacacugaugaaaugcuacuauugaacccccuuuaguuaacuauuucauaguagaacgugugcuuuagugacucauuaagaaguggauaaaauggucagaaccucaucaaauacauguuuuuugaaaaauaaauuuuaacuuaaucccguuugauugaaaucacaccuaugcuugguccucuaguggaaaaaagcgcuugccuucagcuaaggguauugcuaagacugggaaacaauuuuuuuuuaauuuuguuuuuguuuucuuuguuuuuuguuuugagacagucucgcucugucacccaggcuggagugcaguagugcgaucuugacucauugcaaccucugccucccggguucaagggauucucccgccucagccuucccaguagcugggauuacaggcgcuugccaccacgcccggcuaauuuuuguacuuuuaguagagauggaguuucaccaugauggccuggcuggucucgaacuccugaccuuaggugauccacccgccucagccucccaaaugccuaaugaaaugagguuuuuaaacuccgcaguuauguaggcagauccccacuuaggucaguauugagaauugcuucuuuaguauuaacaacuuacacuugguuaaaugucuuauuacauuugugucuuggcagaaauagaaguuuauucuacauccguaauuuucccaguaaggaaaauuucuuuucccaaaauacuguuuagagugaaauguacauauguguaucugugaaccuacugcauuuugaaaaauaaguauaauguaggcuguuuuacucuaugaguuacuugcaaaaaaaguccuugaggaauguguauuuucuaaaacagcauuuuuuuuugaguuauauaaacagaucaagacuaaaaguuuauuuuuuaucauacuucagaauuuuugccuuguuauagauauuuugggggaaaguuccugauaaucuuuauaauauauaaaguucauaaauuaaacuguaauugaaaaauccaaauuauaauuccauuauaucucucucuggccagguucccaugacccagagaacacuaguagcacuuuuccuuuguuucacuuaugucaucuuuauuugaucuaacauugggucucucuagaauggaaggauuaugagguaauaacagaggcacaugugaagauugggcaaaacaguaauaaggaggaggagagacagaggauaagaugcuagcagagaauuagaugaaaaguuuuaggcagcuaggaauguggagauguggguagugguggcugccaagcacaggaaaaugaucaugcugaacuguacaaaggagauugucucugaaccuuuucauagguucugacacucuauauaugucaucuuauuuaaaacccucuguauuaaaaugauaaggauuuggagacauugaaauuauauagaauuuaaauguaugcauguucauauguuuuugccucuggcucauauuuccagaauacuuaacaguauuuuaacauuuuguuucuuaugauucugguccuaaaaaaucaaggacgcugcuuacucagaaagcuaaaaaaccugaguaaguacucuuaggaguuauacuuuuuauguuuucuuuaguuaaucacuaaacuugacugaucuugauaaaacuaaggaauuagagauugcuaagaggguacuaucuuuuucuaaguauuccaucucucaaaacagccuauuuacuaguaagugguacuuaaccuacauucauucagccuccuaggaaaagaaaaagaugccagaauaaugaucccacagcuccuacguugagguuaugcguuucacuuggauuuucacuuggauuuuuauugacucauuuuacagaauauguuuacuuuauuuccuauuccuuagaaaaggagugagcagagugagaagugucagcugacaagugauguuucaggacauccaagucagaauuaucacaaaguaaaauuguguauguuauaugaauaaaagaugucuaugaaaauugauuaaaguuuuggcacuuaaaaguacauuuguucaaaauuuaauuuacauacacccccuuaccuuuaugcuucauaaaugaggcuuugcugaaugugacuuuuugauuugccuuacucauguguaauguaaaacuuuaauaagaaauuuuauuucauuucuaaucauguauuccaguucagaauaugguacccagggagugauauccugcauaauaaagagaaaggaacuaauauuuauugaaugccuacugugugccaagcuuuucuucauuucagaaauauuuauugagcacuuauuaugugcuagggacucuuccagaugcuggaggugccguauugaagaacagacaaaaauagcuguuuucauauaguuuacauuuagugguaaaagacuuaauaaaugaguacaguguaauaugccugggacaaaacaguacugugcagaaaaauaaaacggaaaagggaguuagggaaugaacauugcuuauugagcuuuuuuaaaaacuguguaauggguauuauccuugauuucaaaaagcaaaaccuaucccauacauaaaauuuuuccuuuaagaauacacuucaaauuucagaacacaauuguauuuauacuucaaaguuacagaguuucaacagcgauuuccuauuguuaguauuucagaaagcuguuuuauggcuggauagaaaaucggaguuuuuaauccugguuuugccacuuaguagcuuugccacuagauuugggaucaguuaaaauucguuagcuucucugagcuuguuuucuucuguguaaaauggauacgauaucuuucuuuuucuggugaaggaacauugugucguauguuguugaauagguugaugagcuggaucucagcauuuuaacaaggaaauaacaguguauaaaauuccaauucauguaaauacuuuuaaaauauuuaguacaguaccuggcacauaguaacuauagaguaaauguuugcuuuuugucaucauuuugcuuguuaauucaaagaaucuuuuauacaaauuauuaaggaaaguuuuugcaaagauaaaauaacucaaauugugaaugggauuuuugagggaagaguggaauaaccaugcaaguugcaauacuuauuuucauuuuuagacuggaagaucacgaaacagcaccucaagugcagaacaugucuuccuuucagucuuuacuucacauuauuuucagugguuggccuguaguuaagagcucaagaaauacuguguguuaaauguugaauaguucuuaaugaucauuuuucuguaaauuacagcucuuuuuguaguaaacuccugagucugaaaggugacugcacuggaaucucuacuuuuaauuuuaagcacugaauaagauaucauuaugcaaagucucuuaaaugcuauuuugugaaucuagccaaaaguucaaaaaauauucuagaaauugagaggaagaaaucaauuauuuguagcuagauuagucuucauuaaccuauuucuaugauguuauuggcaucaaagugaaaaaguaauauagcaguuuuuaaaagaguagaagaaaauuuaugaauaauuauuugcucuuaacuguuaaagaacaaguuuaccuuaucuuuuuaagauaauuucaaugaaaguguagauuuguccugguuuuauggauuaaauagcuuggucguuuacuuacauuucugugauacaggaaauacugguguuuucacugaaaagugaaaacgucccaccagcaucccaccucccaucuucacaguauuuuaagcauucuucagaugccuaaaucuuaguaccagucaacucuuuccuguucugcuguaaguuauccucuaccuaaagaauaauaauuuuagcuuuccccaaacuuaagacuucugucagguuaugaggcuuucagucauuuacccaaaauauuucuuggauuuuuaaaaaguucuccacaaagcauguaucgugugcuuuauauucaaauaugaacaaauaggaugaaaaguauuucauuuuaguauuugaugugccacaguacuacuuuagaaaugagauaggaauacauacaacugaauauuuuauacucuuguaauuuuuuuucuuugcuuuuuuugaacaauaacugucuacuacaggacagaaauaauuccuacaaggugucaguuugaguggcuucagaaaggaagucugauuuaccuacaaacaaguacaagagacaagagcaguauaagaauuuguaguauuuuaauugccuuguuaaaagaaaauggaauucuuguuucacuuaagaagaaaaacaaaaaccggccuaguaccagugcuccuaguacaagucacagaagccagauaauaaaguagagguuggaaagguccugcagagagagagagagagaagcagcaagaguauaggaauggggauuuuagcagagauuuugguagaaaugugugaaugccgauuguuaauaauagacuuguuuaaaauaauccauuaaaauguguaggaaagaguaauuuuugaucuauaaauuuuuauucaccaguuuauuaaccaucaucugaaucauuaaauaauauuauuaauauuauuuugaauuuuagcuuaaaguuuuacucucacauugauauuaaggaaaauuauuuuugaccuuuaauaucuuaauguuuaccuuuuuuaauguuagcaaaauugagcacaucacaaguuugcuuccugucaguuugccagugaagcaggccagagauauugcuuggcucaucaguauagagccaguggcagggcaguucaggggagugacuuuccauuccucaucaaugagagaaaaauacuugcuaaugcagaugaaaacuugaacucagcaacuugaccuugcagaacauuguccucaggccaagcaacuuuuguuuagucagagaaaucaacaaaagcaguaauucugauaugaacuggggccauagggguagaagagacuuuaccugguuuuaaacuguggaaaauauuacuuuuuuuuuuuuuuuuuuggagugcagugacacaaucauagcucgcugcaaucucaaacuccugggcacaagccuuucucccaccucagccuccugaauagcugggacuacaagugugcgcaacuacauccagcugauuucuaaaaauuuuuuauagagacaggaucucccuuuguugcccaggcuaggaaaauacugcuuuugguuuuuaguugaucucuuuguuaauuuuucagcuucucagcccccaccucuuuaacuaaauaucuuaauuuuaccguguugggagucaaugaaguauaauaaaaguucugggcuuuaaaaccagaugagcccaaguucaaaccugaguucuguugcugacuauagcuaugugauuuuagacaucauucacacacucugagccaaggaguuuucuucagaaaaauggauauaguaauaccuaccuuacauagaacaggugaauucuuguucuaguuacauuaggauauguagcuuaaguaauuggaaguaauuuuacauuuggaauuuugcuucguuagguuuuuucuucaagguaucuguccacuucauuuuuccucaacaaauagaaugaaaaaagaauuucuguacuuuuuaauuuacuguaacuccuuagaccaagaugaaacaaacaaaacaucaucauuauuuuuuuaacuacaaaauaaacauacggauuguuaauucuuuguauuuuucuugccuguuccugugggaaaagcugcauuuucaauuugaaauuaguccacaaaucuauaauauaguucuucuuuaggaaaagcauuagaaaauuggcauggauaagauuuugaaaacaccucaaauaugagguuuaauauaauacuacaaaacuugugccacuuuaucuguguaaaaugaucuuuauacuuuucuguuauguuuauguuuuaagacagugucucgcuauguugcccaggcuggaaugcaguggcacaaccacagcucacugaagucuugaccucccaggcucaagugauccucccaccucagccuuccaaguagcugggauuacagaugcguaccacaacgcucagcuuacuuuuuauuuuuuguagagaaggguucuuccuauuuugcuuaggcuggucuugagcagcuagguucaaggaaucaucuugccuuggccucccaccuaaguguugggauuauaggugugagcuaccacacccagccuguuuuaacagcagcuauagcaaugguuuuauauuuuguuaauaaguuaucuguauugcuauaguaccaagaagaguaaacaaauuguauuauuauguuaaaauauugguuauacaaauagcauucaauacuaauuauuacagcaaaauagucuacaacaguuacacugguuuacucaguagauuaagacaaaaauuuuuagccugggugacaaagcaagaccccaucucaaaaaaaaaaaaaaaaaaagacaguuuaaaaaagucauugcauuuuauuaaguucauaggcuuagcacauucuguaguguauauacaugaaaucucuuagccuagagguaauaaauaugcuuuaaucuuacacgugugcaguuuuuaugcaaucuguaaaauaaaaccagaagcacaaauaggagauugaaccauuaaucauuggauaaaugacauguuaucauggcagaaagaauuauaagguacauguuggucuuuucagccuuguguuuuuguuauuauuuuuuuuuuuuugagacggggucuugcucuuuuguccaggcuagagugcaauguugcaaucucagcucacugcaaccuuugccuccuggguucaagcaauucuccugccucagcguccugaguagcugggauuacaggcgcccaccacccugccuggcuaauuuuuguauuuuuaguaaagacaggguuucaccauguuggccaggcuggucucgaacuccugaccucaggugauccacccauccucagccuugcuuuuuuaagcgguuuuuagcuuuugcuguuggaaaagucaacauguagagugaaguauuaugcacagaaauuugauuuuuguuuugaucaaaugccauuauuuagaaaaccuaacauuuucacauccuuuuggauaggucacuuaauaucaguaauaauuaggucagcaaauuaauuuugcuuuuuuguaguuugcaagaguuuaucuuauguucagcaaagcuaauaauugcauaaaaauuuaagugggagaaacuggccuuuaaauauuaauauucagaucugugguacaaagccuauuauacagauauuugcuuccacauucuugauauccuauggacuauuuugucuuuuacacuuuucuuuuauacuagcauuuccugauuguagguuucuauuaggguugucaucauuauaaaauauaggcaagauggucguuuuuuaaaaauuuaagacagauuaaauguuccauuuaauuacugagcacaaauuaugucauaguugccugguuaauuuuauugauuuauuauuuauuuguuuagaaauggggguuucguuauguugccuaggcuggucucgauuucuaggcccaagccauccucuugccucagcuucccaaguagcuaggacuacguauggcaugccacugagccuggcaacuugguuaauuuuuaaaaggcaauuagugaccugauaaacaugagcgucugcuguucagaaguuaagcagcuguauguugcagauguauguaggugucacaguuaaguaguuacuagaauugugagaaaaugugcucaaggaaccauccaagggauccgugucaaauaaaaguugcuagaaauacagauauuuuauaauuugcauugagagugacuuacuguuuaccccaugauuagcauguaccugaauuguacuugacuaaaguacugcuugccaacucuuaggaugauuuuauaggaaauggaaaaauaagcacauggaaauggggauuucagaagaaaauucccacuuccacauauggcgauucugcuuuuuugcauauaaaagugcauugacacguguugaaugcccuuugagauugucuagcuaagguaauuguuuggccugcaugagacauacucauucucuucaugagauuuuuccccucaugaacauugccauacauuuaaaggaugacagagccauugcuguaauuuugcaaguggaacaagaaguaagugcucuuguugaagguaauuaguucauuaccuaauugaaguuaguucauuaccuaguugaaguaauuagguagaagauugaaguggucaucuuaaccaaaccaagcuaucuaucaguauaucaacuuuuauagaauaucacaugaucgaaagaacagaaacuccauagagcguauuucauaugucuucuaugacaugcuugugcagaauagcuggcuaacccaagaaaucuugccuuacucauucuucuauugugucucaucucuacauucuguuuguuuuguuugagagggagucugcucugucccucaggcuggagugcaguggugcagucucagcucagugcaaccuccaccucccagguucaagcaauucuccugccucagccucccaaguagcugggacuguuggugcgugccaccacgccuggcuaauuuuuuguguguuuaguagagacaggguuucaccguguuagccaggauggucucaaucuccugaccuugugauuggcccgccuugaccuaccaaagugcugggauuacaggcacgagccaccgcacccggccucuacauucuuuauuauucaaacuaccuuacuuauccaauaguuuugaguuccugcugugugccuguacuuugcuaggucaaagggguggacagauauguaagauacaguucuuguccuuaagagacauauauacaaacacaugugauauacugugacaaaugcugugacgggguuaaacauaaaauacuuuaggaauccauaggagguagugucuccuauggauaaggauuaggcaguaucuccuauucaguaagggaugaaaggauaugacagggaaaucuuccuaggaaaggugacacuuaaucugaguguauaucagauaggcaaggaagagaguuacaggcugcagauaggucuuuuuagauagagagaaacaccaugcaugaaagauggagguaggaaaguccacauguacacaguaacuguguguaguucuacagugcauuagguaccagugguggguuagcuggaagugagguggaaaauuagaaaaaagacagagcaucgagauaccuguauacuccauaaaggagauuuaacuucauccuucaaauggauggaagacaaguucuuaaauuaacauucuagaaagauucucuuguuguagugcacaaaauaccuuagaaaagagccagacuugggaggaagaggcaggcauauaaguaucuauuugagaguugauuaggacccaaauuaaggcacugauaaugggguaauuaagaagaauagguaauguguuugagaaggaaauaauugaaugugacauaaagcagugaagaucacacaugcccugggugcauaguugugauggugauguucaccauuacagaacagaccaggguugcaacaggugaggaagacauuugaguucuguuuguugauuuuaagguucuauggagggagaaagaggaagacuucacuugauauggaggagauagagaaugcuugucuugauuagauaacauuugagcagguacaugaaugaaaauagaggcaguagcaaaugcaguggccuuuaagugggauguccuugccaucuucuaagagcaggaaggccaauauaauuggagcuggggggggcgggguugggggguggaaguaggguagaugguauccaacuguguaugcuguucauguaggguguuuagacugugauaaggacuuuagauuuuacucaggaugggguaggaagucaccaaagggcuuuaagauaaaaucuaauuuguauuuucccccucacuucuuagaacauuguuuauuuauugacauuuguaugugugugguucuguaacauuauuauguauauguauaaauucaugugaccuucacaauuagguuauaaaaacuguuucaucaucauaaagagacucccuuguuuuaccccuuaaguuucaccuuuccuuccuggcaaccacuuaccugcuucuguucucuaucacuauaauugucacuucaagaauguuacauaaaucguacgugauguuaccuuuggagaugggcucuuuuuuuuuucacccaguauaauccccuugagguccuuccaaauuguugcauuuaucaauauuuauuccuuuuuaaugcuaaagaguuuaccauuguauggauauaccacaauuugacuuuggaauuuccaacuuuggguuguaaaaauaaaacugcugugaacagguuuuacaggauuuuaugugaaaauacguuuucaucucuguaggauaaauucccaagagugcaguuguuggguugcgugauaaauguauguuuaaauaagaaacugccagacuuuuccagaguagcuguacaauuuuacauucccagcagcaauaugugagaaaccuacaguuucucugcauccucuccagcauuaguauugucaguauuucuuauuucacccagucuaauaguauguagugaccauuaauuugcauauccuuaauggcuaaugauguugaacauauuuucauguacuucuuugcugucuacauauccuuuguggugaaauguguucaagucuuuugcucauauucuaauugaauuguuuuguuuucuuguugaguuuagagaguucuuuacaaauucuauauccaaguccuuuguugaauacgugauuuacaaauacuuucuccuaguauguggcaugucuuuauagucucuuaacagggucuuuugcagagcaaaaaauuagcuuugaugaaguucauuuugugcauuuuuuucuuuuauggauugugccuuucuugucaagucugagaacacuggcuaaccuuaggucccaaacaaaaaagacuauccuuccuuuauugaauugcuuuuguaccuuugucaaaaaucagauagccguaauugugaggaucuauuucuggauucucuguucuguuccauugaucuuugugccugucccuccaccacuaccacacuguuugauuacuauugcuauauaguaagucuuaaaauuagauagugaaauuccuccaacuucauucuccuuuuucagaauugcuuuagcuauucuaguuccuuuccauguaaaauuuagaaucuguaaaaugucaguuucggggaaauugacauuuuuauuuuguugagucuucaauccaugaaccugguauaugguaugucuuuuauuuaauucuuuuauuucuuuugucagcauuuuuuaguuucuagcauaaaaaucccgugcauguuuuguuagauuuauaccuagauauauauuuuuuagaacaauuguaagugauacuguguuuuuaauucugauuuccaauuguucaugucuaauauguggcaguaugguugguugauuucugugaguggaucuuauauuuugagacuuugcuaaauuaucaguuuuaggagguuuauuuuguagauucauuggguuuucugaugugccugugcauagagacaguuauuuacauuuuuuucuucccaaucuguaugcuuuuuauuuccuuuucuuccucugcuacuugcaaugcuguuucauaauaguggugggagcugacaagcuuguuucugaucuuaguggaaaagcauucagucuuucaccaguaaguauauguuagcuguagguuuuuuguagaugcuguuuaucaaguugaggaaguucccuuuuuauuuguaguuuguuaaguguuuuuaucaugaguaggucuucaauuuugucaaaugcuuuuuucuacaucaauugauauggucauauggcuuuuauucuuuaagcugguagcuagugguuacuuaccuuuuuaaauauucacucugcuguguguggaguagacuuuggagauagagcaaagauuuaaacagggaaaauauauuagaaauuauugucauacuuagaugaugguggcugggaccaggacaguaauaggaaagggugagaacagaucagauuuuggauauguuucaaacucugugugggaaggaauugcugaugaauuggaucugaggcauaaaagagaauucaaggaugacaagagauuuuuggcgcaagcaauuggaaguauggaguugccauugacucaguuugggagcaugguaaaguagcaaguuuagacugagcaaucaggagccuuuuuuuuggauguguuaacuuugaaaugccuuuuagacauauaaccagugauaucaacugggcaauucauucgguauaauggaauucaagcaagagauucagacuagaaauaugaauuugggaguaucaguggaguugaugugaaagaaguuauagugguauuuguuuaaaacuauaccugugacugcuuucuaguuacuguaauuucagauuuauuagcaaaaagccagacucuucuaacaugugaaagagcuuugugaaaauuuggauuaguucugcuguguaugugacaugaaaugcaacagaaauuuuguaauugggaggugauuuggggauggauauuuaauauguacuuagucauacuuauuugauagguaaauggcuguuaacaguggucaucuaauagugucuuacuaauuuuuagagcuuugcccuaaaucuuuauaaaaugaaguaacuacauguuguggaaaggguuugacacuuauuaagugcccgaaugacuuucuguggcaacauuuaucuuacagauaaaaacagccagagagauaaaugaaaaauaaagaugaaaaacaggaauguaaaauagcuggcaaggagaggcuuagagccagaaauacaucaguaaagggagcaggucagucuuagucacagagaauuuguagaaagacaugucuccugagucccacugugaucauguguacuuuaaauucauguaauuuggaaaauuuuuuaaaugccacaaguuuuuucuguuguaacugauuauuagcuccaauaauauuuccuuauugauaauuuauaucuuucuagcacuucguuuuauuuacccccauugcaagauugccauguguauuauaauuaucuguuuacuuuucaguuucucccacuaaaugucaguuuuuauagcaugaguacaauaccuuggcgcuugagcgcucaguaaauauuugugaaugaauggacacagacuacuagaguuuagagcuaguaaacuugauuguuuucgaaaguaaaugagcuuuugggauucuggaguacagguugugguugaaugucuuucugaugcuuccaaacaagcauucuagcccuagagauugcacccauacauagcagcgucaccaacccaagauuagugaggcguacauuuugccucuuuuuucucuuuucccuagugguaauggauuucugcaaauucgucuaaacuuuggcccagauuucuuguguugaauggaguacacauugcaaauaguaggcuagguuuagaguugaguccauaauagcaugucuccuaggaaauuucuugugcacauuuuaaaagaaaggaauguuaaucugucugucuucuacgcaguccuucugcccauuuucagguagaugguagauguauaggccaaguuucucuucaguauuuuuauauaccuuuccacuuuugagcuuuacaagacaaaaauacccuuagcccuuacuauuccaaugcagauuuaaauauuaggagauuggguauuuuuaaaaccauauauucuuuuauuuccagauccauagugugugugugugugugugugugugugugugugugugucuaugugucuguguguacagauacauauauuguguuaguccauggcaaauuaguaaaguuuguaaaaagaaugucuuucucugguauuguugacaccaacauaguaagaauguuuaagugcuuugcauuaagcaucucagggaauaaggaaagggagcuguauaaaauaauucuuugucuaguaggacaaacuguguaguuaacugagucucguauagaggugccugccucacaugauuauugggagcauuagaugaguuuaugcauuauaagucauuugaccuagugccuagcacuuaguaaauguaagcuauuaauagaaaauuuauugcuauaaaauuauaaaaauaauaaacuuuaaacuuuauaaucauuuuuguuauaacucuucacuuggcuuucuugauaccauucuucccaacauuuucucugccugauuuuucugacuuauucuaaauucuucauccucaggucuccucucucuuaccuuuuuuucauuauucccugugucagugucagcaccuucugcugaaacucacuacagcguaucucuacaaaaucucuugccuuucuuagggaggaaagugacacgauucagccaguuuuuaggaagcuagccaaguuuguuaccacugugaaauacaguuuagaaaggcuuagccaggcauaaggccuguaauacuagagucuugagagguugaggcaagaggauugcugaagccaggaguuugagaccagccugggcaacauagcaagaccccaucucuaauaaaaauaaaaaacuaacucggcagguaaagugcaccuguaguccugccuacucaagaggcugaguugagaggaucacuugagcccaggaguucgaggcugcauaucuaugauuacaugacagcacuccagccuggaaaauagagcaagaccuugucucuuaaaaaaaaaaaaaagaaaaccuuaagaguagaacaagcagucaaacaagaggucaugguguuaggugauugcccagauaacacauacuugaacaaggacauugugguggaaaagagaaauuuuugugaaaguaaucagugaaacuuugccauugauuauauguggagaggaaaagaauugagaacucugagguuucuagcuucagaagcaugucauuuauaauuaacagagaaauacauuagugaguaggaggcagugaguugaguuuuggacaaggugacuuuagguugccagcaugguauugucaggcuauuaguuuacuuguuccagucccaccccucccuuccgccucccuccuucccucacucgcucacugaauuccauugcuauuagucuaagaacuucccuuuaggaaaaguaauuuuuuuuagucacagucagcaguagagcuugaaauuuguggagaccaauuccccauuuccuacccacauucucauuauccucuuuugguccguuuccccagggaaaaaggugaagauuauuuagaauaauaucuacuaccaucauuacuaccaccccaccccaccucaccuccaggaaauugguagaaaaguuuauauauagauauguauguauguauguauuauauauauaaaaaauauauguguguauauauaacauauauauaauauuuacauacauauauuugagacaggguauuacucugucacccaggcuggagggcagugguacaaucauagcucacugcagccuuaacuuccugggcucagccuuaaccucccaccuuagccucccaaguaccugggacuacagacaccagccaccaugccuggcuaauacuuuuuuucuaacuuuuuguagaggcaggguuuugcuguauugcacaggcuagucucaaacuccuuggcucaagugauccucuugcuuuggucucccaaagugcugcgauuacagguaugagccacuauaccugaccuaguuuuuuauuuuuacaucaaauaaaugaagcaacuuggcagggcucuuugaagaaaaauacaauuuuaugaaguguuugugauuaaaauauuaauaagcagaguaacaccucauucaucuaguauucuuagguaguaaguacauaaaaugauugaaacuuacuccugaaucuauuuuagagauuuuauagagauuuuacaauauauuauguauauuguguguagauaaauauagauauucauaccuccaaaucuauuucuuuauaauguuucacauacuuugcugcuuucugaaauaguaacaccuccuccccucccccacuuuuacccugcauacuaaaccuuuucuggaagauagaaauaaacauuuuguuucagagcuucagaaugagucaggaaccccggguucuaguccagggccuggcacuaaguugcuauaugagaacugaaucauagauucuagaacagugccuggcacguaguagugcuuaaccaauauguuuggaaugaaucauugucuugugcugacuuuagugcuccuuccuugauuuauuacuuggaauucauugcugccuaguaaauaagcuucuggguucuuaauuaaauaggaguaucuagguucugauagaggugaacuauaagccuaauuuaugucuguuuuaacuccuuaguggaacuuuuggcuuaucuugauguauuuucugguacucgaaguugccaaacagaugaucuucugugcuugauuuauugggggcacuugcugaguacuuuauaugugccuauauuauguauaugcaguguucuauguguaagcacauagcacaugucuccggggaucuuauaacuuagaugaagagacacagaaguagacuguaagagaauaauuaaauguugauucauaaagcauugaccuacagcuacauuaguaguuguaggaaaagauccaugugggcugaagcaggauaaaaagaauucaaguagaaggugaaauuggaauugguuuugaagagguaguuaagauuuugauaagccucaaggugaagacauaacauucuaagcaagggcaguaguguaguaagcaaagaaaggaaaguguggguugaacauguucagacaggccugcccagauuccuaaggguguggggacugcugggaaauagaagcaggugaauuuaauagaguaguuuuaaucugcaagacccugaagggauccagggauacaauuuagagggcugcaugcauuuagauaaaaaaaaaaaagugacaucuuuauauuuuuaugaacuuugaacugaaauuuagcauuuacuuuuaauaagauuuuaagcggcagacuacaguaauauuagcaguacguauaucuuuuauuacuaauagaaaaagcacagauauuuucagauuacagcuguugauaucucuauaauuuaugcauauuacuacuucagaauuaugguuuuuauuagacucccacuagauuuuauuguauuauuacuaaagaagcauauguaugaauauaucacauacaagguuuuuaaaaacacuugauaacuguuucgguauaauugguuuucuuaguaauguauauuuuaugcauuuaaaaccauauuuucaaaaacaacuauauuuuaguaaaacuggcuuucuuuauaauccuagauauuguauuuuaugcauuuaaaaccacucugagggggacucuguagcuuucuccagacugccagagggauucaugacccccgaucuaguggaaccaaacuggagaaggcauugaaaaaccacacugagggguuuuagcugaagugauaagcaggaaaggagccuugccaauuuuguucauuuguuuguuuuguuucaguuacagaauagauguguuaacauagaaaauuucaaaguuucaaccaguuuagaaaaaagggucaaacucuucuuagcucacaauuguagauaaacuguuuaaaaaaauaacagaaacucaucuuguaacaccacagucacuauccuuccucuuuuauuauuuaucuguuucaguuuauuaaauuccucugcaauugagugaaauauuuaaagugguuauauaggaaacuuucuuaaucucuuauacuauacuuacacagagggugggaagacuggcagggagcuaagcagugggucuggucauuuauauguuugaugauagggauagggugguaagcaguuagagauagaguaaaauugcaggagauauuggaaagaaaaaauaauagaacuuggugguaugggagcugagaugcauggagucagguaagagagaguaucaggaagaaaguuaaguauagggugccuaaauuaggauuccuagaauaauauuauacagguccacaaugcuuuaucugaaacccugaggccagcuguguuuugggauucaaacauuuuuggauuugggaaagguaacguguauauuguauauuacauaacucucccagcaaggucugagguaucauccuguaacuagacacuaguaucucugcagugaaggugaaaauauucacaguaagugggcuaaaucaagccuguaaauaaccuuacaucgguucaacucagauuuuugccaccaccaaaugaguuuccauaugaagcuucguggaaaaaucuuguccugacauuuuauuucagaacuauggaaguaauuguggacuguauugacuguaauaaccauugaggagagucuuagaaguuguauuuuaaggaauguuaauuacaaaauggaugcgauuucaaggaguuggguaaagguaaagaaagagaagagagaagaguuaagguaacuucacuuugcaggcugaaaagaaauugcuauuucugacaaaaauggaaaguugaggagggaaacuaguauuggaagaguuuaaguuuaaacauaaguacaauuaagaugaaacaacauauuuuugcuucacaugaaagcuuggaaguuguuggaguguaaaauuuccuuuuaaaaugaaaccuagaaggagcuuaacagcaaccuacaaggagccuaacagacugauguugauugagaucuuaguguuucugaauugauaacagaaauuaucgauuggaaaggugugccuaaauaagugaagguugugauccuacucauggaaccaaaccuggaaaacagaauaaaagggguagagugagauaauucaccuuguagcaggauucuuuucuguaugguugaaucauuccuauggcuauauuuauuauaacgugaauauauuuagaguaguaauuguucagcagcaaugggagcugccaugugccaggcacuguucuaagugcuguagcaagcaguccgugcuguuucugucuuuuggacugggucaggacaucaacucacgugggaagcacagauagcguaauuuuguuagaaaaucuaggauaugaccgggcacaguggcucacgccuguaaucccagcccuuugggaggccgagacgggcggaucaugagauaaggagaucaagaccauccuggccaacauggugaaacuuggcucuacuaaaaauacaaaacuuagcugggugugguggcacgcgccuguagucccagcuacuugggaggcugaggcaggagaaucgcuugaagugggguugcagaagcggagguugcagugagccaagaucacaccacugcacuccagcugagugacagagugagacuccguuucaaaaaaaaugaaaaaaagaaaaaaaaucuaagauauaauuaaugcauaaauauguaggauuaaguagguuuuaacuuuuuugucugccauucuguaauuuuuaaauccacuuuaauaaauggacucauacauugacacugucauauaaguaaacucucuuagaaauagggauaaguguuuuuuaacaggaaagaagcacggcccaauaauuaaucuuuuuuauuuauuuauuuauuuauuuuuuuuuuuuuuugagacggagucucuguugcccaggccagagugcaguggugcgauugcagcccacugcaaccuccaccucccagguucaagcgauucuccuaccucagccucccuaguagcugggacuacaggugugcaccaccacacccagcuaauuuuuguacuuuuaguagagacgggguuuuaccauguuggccaagcuggucucaaacuccugaccucacucaggugauccacccgccucagccucccaaagugcugagccaccaugcccggccucaauaauuacucuugaaauuuguuuaauugcucuguucauauuuacuguauauaaauguaggcauuuacuuuacgauucauaaguaauaaugcuaauuuuuuguguuaaacuuuuauucagauucuacugacauauuauuugaacuuuauguuuuucuucuauuaaauaaggguguuggacuagauaaucuauaaggcuccuuucaacaucaaaucuaugauucggaaucuuuuaaguuucaucaaguagaauaaaaagcuuaaacuacaauuuaaaggagauucuccuuagauuaugcugugaguguaaauaagaugccagaggaacaagugagagaaugaauguuauaacuuuacaccuacauccuuuuggcuaacauuaauaagaggcauagaaauaagaauucuaagaaacuagaaugcagaguguugaccggaaaagaaguuuucagaaagaaaauuauuaguaacgucaagcuaguacaauaaagaaggaaccuuggacaugagguuagacagcuacagauacauuucugguuuuaacucugcugcuuauuggaguuucgaugaguaaauauuacuuaauauguuuuuuuaaaagaguaaaagcaaguucauuauaauuuguaaauaacguuguauaccuggaaaagccaagagaaucaacugaaauauuacuauaaguaaugagauuucaguaugaugacuaguuaaaaaauuuaaaaaagugguuuaucugaagugguuuuuuuauuugauggucuuuaaacugaaagccuauucauaugaguuacugaauggaaauccucaaacuuaaauacccuuuccccuucuuucugaggaaugcaguaauucagucuuaucaucuaaguuuuaguauauuuugaauaagacacuuccauguuaacuuuuuaaaacuuuuaaaaugaaguuguggcagagaauacacuuaaaacaacuauaaggaaaucauuuuuuaaaauuccuuguggcuugugauacuugcucuauuacuugguaauuuuagagaggguguaaucugaucuuugagccauauuugguaaauaauaauuuuguguggaacccacuguucuaucaguaagaggaaaauuauugcccauauauaaggcuuuucuuugcccuuaaaacauuuccuaacuuaaggaccaaauuauaucaugcauugauugcuuuuauguuuuuuuaaaaaggauuauaccggaucuauauauaacuuuuuaacaagagauguguugacagaaguauuuuauacuuuacuuggaaagagaauuacaugucuucuuguuuacuacuaauucuuuuuauauccuaaauauaaauuguuauauuuuuauuuaucaucagcucucaaaauugaccucucucauauacucaauuuguggcuauucuggaagauaaucaguuacaugucuuagaaugugauuauaguugaauuauuuaaaccgaaagccugcuaccuaguuguugcuuuagcauuugugaaaaugaaaacuuaaguauacccacauguuuagaacaagaaaauguguuacauucuuuaauaaugcagaaaaauauauugaaugccuauaugugccacacuguuaagugcuuuacauacacuuuagcuaaaucucauggacaguacagcaggguggguagugauauuccauuuaauaaaagagauuucugcaguuuaauuucaaagccauacugaaaucagaucugaacuuagacuucucucucacagaauuccuuguccugcaaugugccaucacaauagauggaaaauuuacauuuuucacaaaaacuacuuuuacucuguuuugcuguuuauauugcuaguuacuggaaaugcagggaauucaguuuuuggaucuucgucuucacuacuuuuuuuuguccuauuacaguuuucacaacaucuaugauaauuugagagcagcagaaaauucuauuuauuuugacuccugugggauuaguuucuuagggaaaugccuaaggguaccagccuaccaagcauaaggacaucauuuccagguuuuaauaaucaaaauaguacaacauucuacuauucauaauauccuauuauuucuguaaccuucguaguugcaaguuuguuuuugguuuuuguuuuauauggcccuaacaaaaauuaaaaaaaaaaaaaucauugaaucuauuuugguaauggaaaaaaagauuuuccagugugguuaagaaccacaucuuaugagcuguucuuugccucccucuuuaagaauuaccaaguauuuuuaaaaauuggaacuuaacauucaauucauugcuuggauauaucuaaagcauuucuuaagaaaccccugggaauggaucauaggaaauuaggggagcguuuagaagaugauuggaaauacgauagugaaagggaagagaaaaaugaccugaaaaugaggacuuuacauuuccaauuuuggauuuuguuguuguuuuucucuuucuguuagaguuacucuguggucuccuguuggacagucuguugcuaaaagccauuagagauuucauaaaaacuacuguuuugaguugcuggaacugagauuccagaauaguguuggguagguuaaaagaauggcuuaaccaaaguaaacagcauccuuugguuacuugcaauuuaagagacccauuuucccuucagaauauuuuaugugagagacuuuggggacuaccuuacugcuauuacaucucauaauguuaucuggucacauuucuuguucugccuaccucuaguuuacucuaguuucucuucugcuuucaaggcuccagacccaguuccuggaccugcccuggaaaagaaguaucccguagagaugagcucacugcaguuacuuaauuaacaauuuguaagcugcaaaaauggcaaugggccaaccaagaacagcuacaauuugaauuuuucuauuuccagguaugcuaaaguccauggcaccagucaagcuuagccuguguaacugccuuauuauuaaaucuauaguaacuaaaacuugacuuucaaaacuuauagucaucuugcuuuaaaguauaguaacacuaacaucuagguaacaugcagcuaguauugaguuuaacauaccuuuugccugaauauuucuaauuuaacuuguuugcuaguaguagcaaacuaaugcaaaaacauaagaaaaauaaaugugaaaugcuauugagugaagccguauaaacauaccaaaaaaaauugaaaaacaaacaucaacaacaacaaaacugccuuucuuuaaaagguuuacauugaguacaagcaguauagggaauucaguuaaugaaacuacuucccucuuccugagauccucaacuauucuacccuacuaaugccuuuaccuaaaaaguugauauauucauacauggcgaaaccccgccuccacuaaaaaugcaaaaaaauuaggcaggcuugguggcgugcaccuguagucccagcugcuugggagccugaagcacgagaaucacuugaacugagggagucggagguugcagugaacugagauugcaccacugcacuccagccugagcaacagagugagacuccgucucaaaaaaaaaaaaaaagguuaauauauucuucaguaauuggaaauuagacauauuauuucuggauagaaccgagcaauguauuauauaguacuuuaccugaagaauuuaguuauauuuuuaaacuaaguguauaacuaauauuugcuaauauuuuacuugauuacccaaaagaaaccagccaaggaaguuacaaauagucagagucauccuggaguguaacaacaaaaccaaaaacugagguuuccuaaugccuuagauuuuaaccaagagaaagcuacucaugaaugguuagagggccaagaucaauuagcuuuuaaggauauuuauuccuuuuaccaauauauauagauguagaaacagaauuaaucccugaaagaugaguuuauuuacuaaauggguagauaaucauacaugucuuuugauuuuaguucaguuuaucuagguuagagauuaccgaaaacugaagaggaauuuuguaucccaauugugaauuuaaaaggcaauccuaauauucuagcaugugcuuaacuccuuccuuacaucccuuccugcaguauuaaugcauaaugaauuuaaugucuggcaauuuagucagcauuaggucacugauuaugugccacauuauuuguuugguguuuaaagaauuaugugucacugaguguugaauuagagcuggaaagggagcuacuaguuagggucauuaccacuguuaggugaauugaaguagaaauugaagaaggaauuacauaugaauaucaagucuuaguuauuuucaguggugcuauuaauggugaaauuuuucuccauuauucaauguaaauagacacagcugggauguagaaaucaauaaaccuuguuuuagugagcuuacagacaaguaauaugaaaguaucguaauagagaugcauacaacauacuuaagaguacuggagagaaucagcuuuguggagaagguaauguuucugcugaaccaugaaggauaaauagaauucuuuagagaaagcagcaagaguauuucuaaguuauggagaugaaaguauuuaauauauuauagaaauugugagcaguccagugugcauagagaauaguuggauagggaggggugugaugggagauggagcuaugucauguuuuuuugaaugucagaugaaggaguuuggacuuuaauaggcaaugggaauccguugaagauuucucagaacugguauguguuaagucagugaaucuuuugaaaagcugacuaccguagagugaggguugaauugaugaaguuagagguuaggcaguaguaaugccuaauaagggacauuuacucugucaggcauugugcaaagaguuuuaccugcaguuucucacuuaauccucacuacuggaauauuguaaaaaguaacugaaauaauacauguuuaaggcauuuagcacaggacuuggcucauaguaaguguagaaccaaagugauuauacucuaggcucagagaaaacagcgugucuuguccaccuuuguauaugauaguacaauaacuuuccauaaagguauuguguuuauugggagacucuuauauuuaauaguaacaauaagccuacuucuuuuucuaccaccccuuaccucuuuccuuuaauuaauuaaaccaucucauugguagauguguaauacuuagucaguuugagugcuugcauaauaaauaguucaccuugaguuagccuuuagguaaaaaaaaaagucaccuggcuucuuuguuuuaaccaaggauuacaaauuaugacacuaagcuuagacaugguuaaucauggauggaccuacauauauaaauucauaaguaacauuuaaguuagaaaguaacuguaaaucucaucuaucaagcauccugauaauuggucagugcugcagcuguaaacugcacauccauaacaguuucagcauagacaacacaggcuuugaguuauuugaagguaccugugguuggcuaauacagguaccuucaaauaacucauucuguucuauucuuacucuaucuacauaucagaauacaaguaauauuauagagaaauauauaaggaauaacuuuauaguaaugcaugaauauguguuauuauaaaaauugggacagaugacuaaaccuccuuggaauaccuuccauccauguguccuucuacucagcccccucuccagaauaauuaguguguguauacuuucagaaucuuuccuauacaaucauauaaaaauaucuguuuaaaauacaucuauuuucagcaucauaggaaaggacaaaacauuuuuuaaaagcuuuuuaauauaaugcaucuuuugugugucuuuauuuuuacacaaaagguguuauacauggaaucugcaucuugauuuuuuuucagucaauaaggucuuauagguccauauaauuauuuggauauauuuguccauauaauuauuuggacaucauauuccacuaaacaacaacaacaaaaagcugcaugguguuccuuaguguggcuaugcaauaauguauuuauuuauuccuccuagauggccauugagguuguuuuuagaagcacacacugggaugaccauucuuguuuacaccacuuuaaacacguguguuuuuucuagauuagaugcuuuaauucauauagcuggauagaugaagagagggaggaagggguggauggguggauggauagauggauagaaagcuagaacucugauacuuuauuaguaguagcaaauauccauguacacuuugucuaacuugugaacuuaucauacuccuagugcuauugugcacacgcccacgcaugcacgcaugcacacacacacaccccucucccuuagcagcuggccaggaguccacuaugggaaaaagucagcugagggcuaugacauuagaaagaaaaugagcagaguuauaugagaugaacaggaagaaucaugggaccaaguaaggcauugaaacugcauggggaucagaucaguuggugaaacuuuuuuuuuuuuuuuuuuuuuugagacagaguuucgcucuuguugcccaggcuggagugcaauggugugaucucggcuuacugcaaccuccgccucccgaguucaagcaauucuccugccucacccucccaaauagcugggauuacaggugccugccaccacgcccagcuaauuuuuguauuuuuaguagagauggggcuucaccauauuggucaggcuggucuugaacuccugaccucaggugauucgcccaccucgaccucccaaagugcugggauuacaggcauaagccaccgugcccagcuggugauacuucuuauaacuuucucugaauauuaaggugccauuuuaaauuaauauuuaaccaacuuauuaaaauuucuacacaucauucagugaauugguuuguuauaaauguuuaugguugguguaagaugaaaauugguuccuucaagugcuuuuauucucuuuucuccucuuucccuuuuacccauaaauaggaacuuauuaucauacuuagcuccuguuuucuuuuauagaugauauuuaugcacaggauagauuauccaaaaauuagagugaaagagggcagugaacaauaauguauugcaaaauaauaaugagguaugaauuauaaaaugcacaaaagguaguuauauaauauguuuugaugaaguauaaccauuccgucuuagauuuauugcacuuuucuugauccuuagaaaauguaguaccuaccacaaaaccacaguacauaaauugccaaguguggccgacuugcacauuccuuuuagaagaacuuauaacugguaagccuguuaaccaucagaaauugucagcauucauggccuugaggcagugcauuaaaugacaaaaugggaaauuuucucuuuaagaggaaguaguguggauuauuaugcuacuuuauuaauguuuauuguuauucuuuagaaaguaaauuauuguaggcuuauaaaauuaagaaaucuaguuuuuaguaacauaaucauuugcucccuuuaaauuuuaaaucacucuaaaucugaacauaauagcuaacuuaaaauaaguagcauuuggauuacauuauuuuugcagauaacugauuaucugugugaaaugauuuaguauuauaaauguuuugugauaaaguuuaugguaaagauugauuauaguuaccucauuuuuaucuuaaauggaguuuaaguaaaguuugcuuugccuugauagaauuguaacaucaugcuccaagaaauauaauuccaauaauuuacuauaaaaaguaaauuuuaaaacuuuauguuaaauuaacauuuauaaauucuuuuaaaguuaauuaaaucugaagugcaccaaguauuagcuaacugguauaugauaugauacuuguauaauaugucaauaauguaaaagguauuuaaauaguguauguacuuagguaauaugauucuuauuuuauguuuaauuuugaaauguucauugaggucaaaagguuuuaaaauuugcuuuaauuuaaaaaauuauagcaucauccagcuauucugacugcauuaucaacacuucuuucugugguaaagguacuguuuaagaguaauucauggcagugugauaaugccagccaauucacagaagagagaaauuguaauuaguaauaagaaugugggccaggcacaguggcucacaccuguuaucccagcacuuugggaggccaaggugggaggaucacuugaguccaggaguucaagaccaaccuuggcaauauagggagagccuaccaaaaaaauacaauaauuagccaguugugggguugcgcaccgguagucccugcuacuaaggaagcuggggagggaagauccuuugagcccaggagauugaggcugcaaugagccaugauugugccauugcacuccaaccugggugacagaacaagacccugucucagaaagagagagaaggaaagaguaggagaaagaaggaaagaaagaaagaaaaaaaaaaacuguuagcaucauauugacaacuaaauagauaggucgaaacguucugccguccuauuuggcauccuggagagguuaauguuaauagucagugguugagccagaggcauguuccuaaauaucaccaugcuaugcaaagucacacaaaaaaacacacagggcuuaugggaaaaaaaaaaggaauuauggcuguaacacuuggaaacaucaccugugaacauuaaaaaaaaagauaaggccgggcgcaguggcucaugcuuguaauaccagcacuuuggaaggacgaggcagguagaucaccugaggucaggaguucgagaccagccuagccaacaugaugaaaccccgucucuacuaaaaauacaaaaaaauuagccgggggugguggcaggcaccuguaaucccagcuuagucaggaggcuaaggcaggagaauugcuucaauccgggaggcggagguugcagugagccgagaucgcaccguugaacuccagccugggcaacaagagcaaaacuccaucucaaaaaauuuaaaaaaaaaaucuuaaagauaauuuuauucauguuaaauaaauuaagaaauauguaaauacuacaaugaauauuguacuuuuuccucaaugagaccuaaaguuugcuuauggaagggagcacaggaagaauugcagcuugugaguuauuguaaaguagucaaggcugggcgccaugucucacgccuguaaccccagugcuuugggagacugaggcggguugaucacaaggccaggagauugagaugauccuggcuaacacagugaaaccccgucucuacuaaaaauacaaaaacuuagccaggcacgguggcacgcgccuguaauccuagcuacuugggaggcugaggcaggagaauugcuugaacccaggaggcggagguugcaaugagccgagaucacuccacugcacuccagccugggcaacagagugacacuccgucucaaaaaaaaaaaaaaaaaagguagucaagaaagaguuuuuugaaaucaguaaugugacugggugugauuaaugacaugcagaucuguuaagcugagauagcugguaaguguuucagguguguuccuguuuacuuuuuguauauucauaugcugcuuguuuuagcucaauacagcuuucuguguucaccuaguguuucuuacaaaugaaauuacagcaaaauugacuuaauguucaaauuguucucucauaucaauugugauggaacauauuuacauuuucaaaacagauauagcagcacugacauaucugagguuaagggaaacgcuugaguuuggggagauagauaaccacuuuuuagaguagucuuuaaaagcuguauguauucugauguuuauuuagagaguuauggcaacaaauauuuacugagcauccacuugacauacacuaaguaguuaggauacaccagugaaaaauagucucucugcuugggaacuaacauacaugcaugcauucauucauucauucauucagagauggagucucacucugucgccgaggcaagagugcaguggcgcaaucucagcucacugcaaccucugccuccuggguucaagcgauucuuuugccucagccucccgaguagcugggauuacaggcgccugccaccacgccuggcuaauuuuuguauuuuuaguagagacaggguuucaccauguuggcuaggcuggucucaaacccgugaccucaggugacccacccaccucagccucccaaagugcuaggauuacagacguaagccacugcgcccggcuggaauuaauauuucucacgugaagaauuuucuuugugaccagggcuuguuuuuaagagguaaauaggauugacugggagaagaggaagucuaacaaggagacgacugggcaacaaggcauuuuucagaucucuuaaauuauacuuuuaugagauaacuuccuagaauucuguccaauucaggauuuuaugauuuacagaaaaaauuauuaccgcuaauggcuacuuuggaaacuggaauuugcuuuuagcguauguugaaauggaaaaaucuucucuuacauucuuguacacaagcuaaggaagaauccuagggcgguugagaagugaacguuauguauuucuuccuacuacuguuugauauucggcaugaaccauauuuuaugucuuuuuuuuuuuuuuuuuuuuuuuuaagagcucagucacccaggcuggagugcaguggcacaaucauagcucacuacauccuugaacuccugggcucaauggauccuccuucuuuagccuccugaguagcugggacuacaggcaugugccaccaugcccagcuuacuuuguuaacauaauuaaauuuguuccagcaaaacucauaauuauguaagaacggugcaaagauaaaaugauguauauauauaguuugacauauauuaaaaccuuauuagcauuagcguaucucaaggucuucucagauaaagaccacuauaccuugaaaccuucauucaucuucucagcuucuccuguaacuacccccauccugaguaccuucuucauaauccccuucuuuccucuuugucccuccuuucuuccuccugcaagacaggugacacgauccccagaaucugccuuacuucuuuuauacuuuaaguuccuaugcuucaauacuuucccacuuccuccucagcccagagagaucccuuuaaacaccuauuauaacacaguuuaugccacuuuucuagcacuuugcacaaccuaguacuguugaguuugucauguagcuuugucagauuuccccaacugcaaguuuuuugucccguaugcauugaaaaagaaggccuuaaaggcucaauccacuccuacaauauucugcaaccaggguaauaugcagcccuguaagguuuuguuccuuugcacuucguggaaguucaugauauuuaaaauaaauaauuacuacuacuaccaguuuguacuuuuugcuguaggcaggacagauauaaugcaauuggcuuuaauuauguugucacuaauccuugaagcucuuugaguuguuuucuccauuuuacgaagaaugaaaugauaguauugauauuuuauuuacauguguacuuacuaugugcucuuuuuauuaucuuacuuggauuacucauuuaauucuccuaacacuccuaugaaguagcuacucuaucaucaccauuuuauagaugaggaaacugaggcacagaaaaauuaaaugauuugcccaagaaguuacugcaaguaaauagcauauuaaacuucauaaacgaacccauggaauccuagaauuuauacuuagccagcuaucacuguguaucaaauacuguuuuauauaccuuauaucauaauugucucaucuaguuagauaagacagugugcacuuauggaacugagguugaaauauuuagcaacauuagguuaucucuguuuuaaacuauuaacauguucuuucaccagaaaauuuuagaagcgugcauggcuaagguagaauacugguucuuuuaguucuacucuuuucuucucuucaggaaaguuuaugccugucucagaguaacauuuuauuuauucauugguuccuuuucuuucuuaagauuuuaauaguaaaggccaauacuuugucaaguuuaaauuauguaaauugaguaguuuaugugagauacauuacuaguuauuccuuuuauuuuuaaaaguuagaucucugggaauuuagcuuugcuccaccauuuacuuuguauggcaccuucuugauaguaaaagauuuuucagaaauuuaccugcccaaaaacagcuuuuauuuuauaauaagcuucauuuuuagcugaccuauggugauccauauguguuuauuguacaucuacauuuuccuacacucuuaaauauauaguagcugcagaaucuguuuguguauacuuaauagagguaauuuuuucuuccccuaguuauuucuuucccauugaaucaaguuacauacaaguuucuaaccauuccuguuacaggcuuguuggugauugacuucauuuuaauaaucuuuuuauuucauugccuuucacccaguuuuuuaaacucaugaaauuccacaccccuuuccaucucuauuuuccuuccuuaaaucaauacuuuacuauaagcaccucuuauaugugauccuuugaccauagucaucuugguuuuugauuagucccuucccugccuuucauuuacuguguuaucaacuagcggucuuguaggaacuggaguaaacuuuacuugaagaaacauucagauaagcaguugucuugagagggcucaucacaguggauucaaagaugaaucagugaacauacuugggcuuuauacuuagggacuuugauucaguagguccaggaugaagcccagugauuuuguuucaggugguccacagaccaaacuaaaaaaugcugauuuaggaaacacacccuuuuccugaugaggaaaguugcguuuuuguccaauaucuuaaaucuuaaggagcuuuuaagguuuuggcaccuuuuuucccuccugcuuacacacucaacuuuguuugcucuaagauuuaccuguuuugaacaucaucagccuuguaaaauggaauuacugauuccaugguucucuaccuugacuucccaucacaguuacugguggaguaucuuguuuuuacuuugaguaacagagaugcauguguaggcccuacauccagaaauucuaaaacucauuaucagguuugaguuaccuccccaacuuuggacucugcauuucaaagcucugggugcugcugcugcugcugcuggauugcuuuugcugcugcugcugcuuucuccaccuuacuccuuccccuuacuucucucuuuuacuagguaacgcaggaauauaauacagaauucaacaagcacgaaaagguguacagugaagagaaaguuucuuaagucuuccucuccagcccuuauucucccagauucccucuucuuccucagauaaucauuguuaccaguuucuuccccaagugauuuagaugugcauccagaauggagaaacacuaacuuagugcuagcaagcaggauauuacauaggcauuaggaaaaaaucaagcggggaacgaccccuuuaagucuuuguaaaauaaagauaaaaucuaaaggcuaaccuucauauuguugccuugacauugugaauauaaagucguauucugaggaaauaauuuaaauauggaaaugguccacguacaaaaaacuuuuugcguagcuuucuagagaaaaauuagaaacaacuuaguuauuuguuuacaagacuggcuaaauaguaauauauugaccugauggacuguuaugcagucauuuaaaacaaugcuuauuuucuaacuuuucuucagguguauauuuuauuucucuauauauagagagugagagauuaaauauauauauuuguguauuuguguguguauacauauguaaagagacauacauacacguauauguuuuuuaacccacuaaaacuuuggaguccaaguuauauuuaugcauaaaaguuaaauccugcuucucuauuugcaugcuucucaguguugacagaugucuagauaaaauuuaacuaaauuucucuacaauguccuuuacuggauauugguuucuuuauaacauucaucaaaaccucaauuaugugcaucuaauuggucccagcuucugcuauccaaaguguaaucaugcccuuugaacacaaacaccugcuuaccuuaauuaguacaucuguaugccuucuuauguuaccacaucaguuuauuugauccugaaaucgaaagagaaguagguaaacaagcacucuacagagccucauuuuggauugugcaaaucucaaaacuuuugauuaaauauacuuaauauguuagguagaucgugucacaaaaucaugucauaaaauguaaucucaauuuuagaacuucagguagucuuggacuacauaacacuuugaagcaucuucauuucccuaagucuaaauuguaagaugaaauauaaaacacauuauuuucacuuuuuauugaauauuuuuuauuacagaaacaauauauuaaauaaaauagguuuuuaaaauuuauuuguguguuuuuuauuagaucaagaagguguauaaugaagaguaaaucucccuuaauugcguucccuagaggcagccaguguuaccaguucuuguguauccuuccaaagauauucugugcacguaaaagcguguguguucuuguauguaagagaauacagaacacuguucugcacuuaguggugguaguuuuuuaacugaguauuguuucuuggggauuauuccauauuagcaucucauucuuuuuaauggcuguauaguacauuauacuuuugugaaugaccauaguuuacacaucacuauuaacagauacguaaguaguuuuugguuguuuaucauuagaaacaugcuuuggcaaauauauauaguuuucugugugacuguaucugcaaacagauucauaaaaauagaauugugaagucaaaaaauaaaugcaguuuuaauuuugauacagauugccaaauugacaucuauagagacugcacucugaggugaggauuccccucaccaagugauguguuaacagacauuuggauguuaauuaaagaucauuauuuuuuaauaaauuaaaucucccaugaugcgccgccccuauacuuuuuuguuuggucuccaauuuaaaauuuuccccagugaaaauuauuuacaugauaaugucuuucuguuuuugccaaauauuacaugacuacuuccuugcauuuucugagguuuuaauaaguuuuaaugucugcauaauagucaaguauuaauaaauuacaguuugaaaagcugcuuuccaaaaguuaagcuguuugguucuuuuuugguuuuuacuguuagaaaacuauuuuaaacuuagggcaggugugguggcuaauaccuguaaucccagcacuuugggaggccgagguggguggaucaccugaggucaggaguucgagaccagccuggccaacguggagaaacccccgucucuacuaaaaaugcaaaaauuagccgggcgugguggcagggacauguaaucccagcuucacaggaggcucagacaggagaaucgcuugaacccaggagguggagguugcaaugagucgaggucacaccauugcacuccauccugugugacaagagcaaaacuccaucucaaaaaaaaaaaaaaaaacuauguuaaacuuacguugaauuacuuccuuagcauaaauuccuaagagagaaagguacugcugucuuuugauuaccuuacuuacaugacacuguuuaccugugugcuuccuaccucaagaugcuuauggauaaauaggaucaugcccaacuaaauuugagaaauauugcaucugcugcugcuacccaaagauuaacagugcauauuaaaguccagaaauaaagaaaccuccuuaacuuuaaguaacagcauuuuucaaauguauugccacaaaaaaaaaacuuauuuuuccauguaacacuuaacuaaugcuauugaaaggcucuuugagaagugauaaaugacaaagugauauauugggcuuucaaguagauuucuuaaaauuugaauuauugaaucuguucugauaccuccuaauuuaaucguauuuccuaauguccuagagaauuccaaaugcuuauuuccuucuaacuaaagguaaugguaguucuacuuuagcacauagaaauguaggagacugccauucaacagguauuuguagaaaacuuaguauggccuuauuaaaggcaagauuucacagugauucugugacuaaaauuggggguuaacugaaagugagacucaacuucauuuuauacacguagauguggauugucaaaaugagcaaccauuaaacaagguuacagaaauaagaugauaaucuuaguuuauucaggcugcuguaacaaaauaccauaaacuagguagcuuauaaacagcagaaguuuauuucuuguaguucuggaggcuaugaaguccaagaucaaggcaccagcagacugaaugucuggugaauucccacucugugguucguagguggcaccuuuuagcuauguccucgcaugguggaaggggcagcucagcucccucgggccucuuuuauaaggccacuaaucccauucauguagguuccacacucaaaccugaucaccucccaauacugucaucuugggggauaggaugucacauacgaauuuugaggggaccugaccauucacaccauagcaggugaggauggaucuaaagcauaaaaaucuuuccagccuucaucuguagaucuugacaucagauguugaguauucacucuuguaguguggaauuuaggauuuuguuuuuguuugguuugaaaugaauuccagcauuaaaaucucuuauaugauuaauuugcuacaaacagacuuucaccuauccauagaauuuuuuuacaguaauuuauaaaaaugcaccugucauuucaaaagagcauaucguauuuuuuacagauaccuugacuauucaauuauuucauucaccagcauuaugacauuuauaacagucuaguggcugaaaacugaaauaaccacgucuuuauuauuuacuuuuaauuuauuuuuacuuuuuaaaaguaguguguuuucagcaugaaacauuuuagccgggugcaguggcucacuccuguaaucccagcacuuugggaggcugaggcaggcagaucacgaggucaggaguucgagagcagccuggccaauauggugaagucccaucucuacuaaaaauacaaaaacuaaucgggcgugguggugugcaccuguagucccaacugcucaggaggcugaggcaggagaaucacuugaacccaggaggcggagguugcagugagccaagauugugccacuacacuccagccugggcaauagagggagacuccgucucaaggagaaaaaaaaaacacacacacacacacacacacacacacacacacacauuuuagccuugauggauauaaaguaauaguaaagacucuuuaucaauauguaaauggauuacauuauacauuguuuaauuuagucuaugcuucugcccccuugaacgguguuaaugaacaucuguccaugucaguacauuuagaugaacuuaauacuuuacaacauuuaacuuguuucugaauuugucauguuauaaauuauacuguaauaaacaucuuuucuuauguaucuuuuuuuuucuuuuuuuuugagacagagucucgcucugucacccaggcuggagugcaauggugcgaucuuggcucacugcaaccuccaucucccagguucaagcgauucuccugucucagccucccaaguagcuaggauuacaggcauccaccccuacgcccggcugauuuuuuguauuuuuaguagagacgagauuucaccauguuggccaggcugguuucgaacuccugaccucaagugauccaccugccuuggccucccaaagugccaggauuacaggcgugagccaucacgcccggccuuuucauguauaucuuuacaugauugucuguuuucucaaguaaguuccuagaagugaaauugcugagucauagggucugcaaauuaaauuagaucugcaguuauguucucucagaaauguguguauauaaguugaguaucccuuauuagaaaugcuugggaccaaaaauguuucggauuuuggauuuuuucagauuuggggauauuuguguauauguauaauaucuucaggaugagacccacaucuaaacacgauauugauuuauauuucauauccaccuuaauacgcauagccugaagguaauuuuauacaguauuuuacauuauucugcacaugaagcaaguuugucuuaaguacuuaugugaaauuuuccacucaugcucgcauccuguugaacucaaaaaguuuccaguuuucgaguauuucauaucuucagauuagggaugcucaacuuguauuauucugucuuccggcaucuacugcgacuaauuagaaguucaucaaucuaguuauuccuuuguagauuauggcucuuuucucucugauuguuuuaaagauaaaauauuugucuuugguacucugcaguuucacuacaauacaucuaggugcagauuucuuuuuauuuuucucuucagaacucuguguguguguguguguguguguguguguguguuuucaguauauuauaaagaaacauugucaguuucucaaccauuaucucuuugaauuuugccuuucccuuauucuuucauaucuuucuacaaguccucuauuagaugcaguaguauuuucauucuguuucucauuuucucuuccauauauuccauugcuuuauaagcucugcugcuuucugguugcuauucucuuauccaucuuccaguucaccuuucucuguagucucaaguaccuucugcuguuuaaccuauucauugauuguuacauuuuaugaugauauauuuucuagaagucuuaauugauucuuuuucaaauuuugccuuuucacuuuauaucuuauuguuaugauuuccuuuuaucuccacagucauuuuaaauauuuuuauuuuauagcuucuuucagguucuguucucuuacauucuuagauauuaaucaucuaauuaauguuccugaucuuuacucaugguggauuauuucuuugugcuuuugaauuuuauuuaacaugagcucauuuucaacaugauguuauuuguuuuucauuuuuuaacucuagaaauccuuugcuuccuggguuaaagaaauaagauuccauagcaguuuuacuuuuguuucugccaggaauccuaugguaucaccagccucagaccaauuuuuuuguuaauuucuauuuuaaguuucuuuucuacaccuguaguguaaauuuggauuccacaccugugcauggugcgggcucgugucuuuaauuuuguaagggagauguuuccuucccacucauggcucuagugaauuucaguucuuguggcuucuauguggcaauggauagagauuuagcugcuuuuuucuaguaaggaaggaccuuccagaaucucugcuuuaugcaacuauuucauuuaaauaaaaugucuuucugaugugguccuauaaugugucuucuuuccacauaguauuaaaaccccagcuccaguaugucuaguucugauaacuauaucucucuccuuccaaacucuucucccccacauaucaccacaguauuuuaacuuaaacacuuauuauaguggcuuuuaauucugucuuuguuucuggcaccagggaauuuuuuucuugcaagcucugcuguuacaaaacaaagucaaucauuuuuucauuauuucugguuuuucauaacagaagagguucugaacuagcucaguacacuaucauucuggaacugaagccaaguuuuuuucucccaaaaguaagacuuaaauuuuccuaaaugugcuuuugguaucuauugagauaauaguauaaguagucuccauuaacuauuaauauaauggaaguacauuaauaaguuuaguuuaaagugagauaccaguaauaaauccagcucuauaguuuguauacuccguuuccuaaucuuuuauucaaaauuuuugugccaguuuuuuuaaaguaaaugcucuugguauauagguauuuuguuugcuuuauuugcauguuagauuuuuacaucagaaaaugauagccuuuuuuuucugaauuuuuuuuuauguuagccuguguuaguuuguucuugcauugcuauaaagaaguacccaagacuggguaauuuagaaagaauaaggguuuaauuggcuccuaguucugcaggcuguacaggaaguauguugccaagcaucggcucaccuuuugguggggcuucaggaagcuuacaaucauggccgaaggcacaggggaagccagugugucacauggcaagagcggaagcaagggaggaggaaguuuuaaacagccugaucucaugacaacucaaucaugagaacagugccaaggcagggggcacuaaaccauucauaagaaauccacccucaugguccagucgccucccaccaggucccaucuccaacacuggggaucauaauucaacaugagauuuagagaagacagcauccaaacuauauuauuccgccccugccucucaaaaucucauguucuucucacauuucaaaauauaaucauuccuuccuaauaguccuccaaaaguuucagcucauuucagcgucacucaaaaguccaaaguaucaucugaguuaagccaaguccccuuuaccuaugagucuguaaaaucaaaacaaguuauucacuuucaagauacaauggggguacaggcaugggguaaacauucccauuccaaaagggagaaauuggccaaaagaaaggggcuacaggcuucauacagguuuaaaacccaguagggcagucauuaaaucuuaaagcuccaaaauaaucuccuuugacuccaugucccgcauccaggccuuugagcagcccugccugugucugcaggguucagccacggcagguguucucguggguuggaguugagugucugcagcuuuuucuagcacaagguguaagcugcugguggaccuaacauucuagggucuggaggacgggggucccuuuccccagccccacuaggcagugcccccauggagacucuguggggccuccaacuccacauuuucccucccuacagcccuaguagagguuuuuuugugagggcucugccccugcagcaggcuucugccuggccacccagacuuucucauacauccucugaaaucuagguggaggcugccaagccuccuucacucuugcacugugcacaccuguaggcuuaacaccauagacacugccaagguuuaagguggcauacauucuccaaagcagcagcagcccgaguuguucuuggggcccuuugagccauagcuggagcggccuggauucagggagcaguguccugagcugugcagggcugggccuggccaccugaaccauuauuuccuccugguuucugagccugugaugggaggggcugcugcaaagaucucugaaaugucuucgaggccuuuuucccauugucuuggcuguucgcacuuggcuccuuuuuaguugggccaaucucuagcaaguggugaguccacuugcuugaauuccucucccgaaaaagccuuuucuuucucugccacauggccagacugcauguuuuccaaacuuuuauaguucuacuuccccuuuaaauauaacuuccaacauuaagucauuucuuugcuccaacaucugaguauagguuguuagaaacauccaguccacaucagaaauuucuucugucagaugcccuaaaucaucacucuuaaguugaaacuuccacagauccccagggcaugaacacaauacagccaagcucuuugcuaaggcauaacaaggcugacuuugcucugguuccuauaaguucuugauuuccaucuuaguuuuuaucaccuuggccuucccuguccauaucacuaucaagauuuugauuauaaccauuuaaccagucucuaagaauuuucagauauucccucaucuuccugucuuccugaguccugcaaacucuucuaaccucugccuguuacccaguucccaaguugcuuccacauuuucaaguaucuuuauaguagugccccauucccaguaucaguuuucuauguuagaccauucuugcauugcuguaaagacauacccaagauuagguaauucagaaugaaaagagguuuaaucggcucaugguucugcaggcuguacaggaagcauggugcugggcaucugcuucgcuucuggcgggaccucaggaagcuuacagcuauggcagaaggcaaagggggaaccuggauaucacauagagcgggugcaagagacaggaggugccacacacuuuugaacagccauaucucacaagaacucacuauccugaggacagcgcuaaggggauggcacuaaaccacuuaugagaaauccgucuccaugauucauucaccaucaggccccaccuccaacacuggggaucacaguucagaaugagauuuagaggagauaaugcccuaacuauauuauaaccuuuuaaaguaaauugaaaacugaaauuugucuggacuuuggaacaauuuaaauuacacaaaaauuaaccuuuuuuuggaaaguuuuagaaaacuaucccaucuggcuugguguacuggggaggggaaacuagucaagagcaguuaacuucaaucuuugacagacuuugccauauuuuuauagucauuguuuugagguguuguuuuguuuuuaauaucaaggcagcuuguuuucuagaaaauaauucaucuaaucuaaaucuauaacuuaaguacaauaguaauguuucucccuuguccccucccucccauuucuccccauuuucccuaguguuagaauugcaagagcuuuguuauuuuaucagacuugguugaauaccagcuuuggucacaaaugauuaauauucuacaguuuuuuaaauuaaaauuauacuuuucuucccugaauaccacuacaggaagggaccuuggagauuuaguccaucccucauuauugacuaaguaucuaggcuaacaguauuuauagggggaaaauguaauauaaacauugaauauugauuacacaaaaauuguaaaguaacugggcagaggaguauagcaguggagaaguaugguguauauauauauaugggguaggcacugaguucuaaagcuaaaucuuuauuuucucauaaauggcacuaaaccauuuaugagaaauucgccccuaugauucauucaccaccaggccucaccuccaacaauagguaggaauguggagaaacagcucagucuugaccaugguuaccucuacagaguaggaaucaaagguguagaggcaugaggcagggaaaguuucccuaaugagcuucauagcacuugcuggcuuuuuaaacuguuuacauguuuucuuucuuaaacauuuuuuaaaguuucauuacaggauaaugccacaguaaaauauuuucugaacaaaaaauucauuaagauguuugaaaauccaucuuuaaacaugcucuucaguuuuuuugaggauagaauguugaccauugugaaaaaauuaauaauuacuauauaauguuuuauccauaauauaacuaaugauauauuuaaauuauaugguaggauuuucucauucacacucagguuuuaauuaacgccaguaccacagaugcaccucacauuuuucucugcaggucagaucuguccuuugagcgcuagacccauauaucacaacucccuguaugauaucucuauuuggauguuuuacagguacccuagauuccacagguucagaaacaaaccuguaauccuucucuuuguuugugcucuuugauuuuucccauuguuuccuaauucagagacgagaccacuauccaguugagcaaaucagaaaucaacuuugacaccuccuucgcuuuugccccaauuucuaauucaucaccaaauuucuauacauuuuuacuuccuaaauaucccuuaaggucuuccacuucucucuaccuagucuccauugcuauccacaguacaggcuauuaccauuuccuggcugaacuacagcagugguuuucugacuggucuucucauauauucuuuuacccuuuuuccauacaauagccguuuuuuauacacacaugauuucuugaucaugucaccuuuccuaccucugagcuuuaaauccuucaucggcuucccauuguucuuaagauaaaauccccaaauguuaauggccuauaaggcacuucaugauuugggcccuaccuauuuugcuugaucuuugcucucuacaguuuuucccaauguaccaugcucccaugcucugcuuuggaaugaugugaaagagaaaaacaguggcugugauagccacaagcgagauggcaggcagcagaccgagugcagaagacgcagacagaagauaaaauaaugagcaaguuaaaauaguuaucuaaauuauaaacguguauuuaugugccuuuaaccuagcaauuucugugaucugcagggcaaggacauugacucuaauacuuguacuaucuccagcaugguaucuccugcauacuaggcacucauucaaugugugguugguagauaaauagaugaugauagucccaguuuuaaauacucuuaucuaguugccucauaaaugcccagauuuucauaagaccuauauauccaguugcauucuuuguuucuguuuguuuuuuuaaucuggagacguggucucguguuaaacaguuagcuuuuguauacucuuauaguccuagaaacauccacuaugauaaacugcacugaauaugaagcauaacuugcagucugagugagccauuaaccagugccuaguacucuucacuguaauaguuacuaagaaaucaaaaauuguuuacauaaucuuuaagaaaggaaagaauauggcacauuuuauaaaccguuccaauaugucuacuuauguuuuguagugcuguauauacucugcuacuauuuagaaggaauuaacccuccuagaucauuuuagcugguggaaguuuagaugccagaacuuuauaccuauugcugcaaacauuucauaaaguaugauuucuuuauucuuuuucucaggagaggguuuauuuugcaucuuaacauaggaaaugugucucuguuuauuaugagaaauaauuuuacagaguaaauuuauaagauauuucuugguuuuuguuuugaaauuaaguaaauaccaauuguuucaguaauguguuuggguuguccuuacaaaugacuuacugcuccacaaaggcuacauuuucaaauaguuauauugcuuucacucuuaaaguuuacuuuugcuguuuguaguauguggguugauugacaguuugguuuuuuccucuuucagcacuuauauuaugucauuucacugucuucugaugccuccauuguuucugaugagaagucaucauuuaaauuauugucauucuguuucuuuggcuguuuucaagauuuucuuuuugguuuucaggaguuugacuaucuugugccuauguguagucuuuguuuuuuucuauucgggauuugcugauauuuuaaaucuguaaauuuauauauuuuacuaacaaaauuuuuagccauaauuucuucaaauuuuuuuucuaccucauucuuucuccccuuuccuucugaaucuccaauuacaaguauguuaugauaccuugccacaggucccuaagguucuguuucucuccucccccucgcccacagucacuuuuuuauucauccuucagauuggauaauuucuauugcuuugucuucaaguucacugacugucauuucccauccaugguuaagucuacccagugaauuuuuuucaguuauuuuauuuuuuaguucuuaaauuuuuauuugcuuuauauauguauaauuuccauuucuuugcugagaguuccaggcauauuugcacuuaaauccuucagcauaguuaaaauagaugcuuuaaaauacuuaugugcuaauucuagcagcuggcucaucuugggcuuuguguccauugguugccuuuucucuugaguaugggucaguuuuuuucuguuuauguguaacaauuuuggauuuuauuuagaacauuaugaaugccauguagagacucuggauucuguauuccuccagugaguauugauguuugguuuguuaucuguuucaagccagauaacuugacuacacuuaaaguauaagcucugaaaucgcaguucaguuauuuuaaccuuagccuugcugcuugaauggaaucugucgcacauauguauaguuuggagaucaaagauaaauacagaguuuauacacagaauuuagggccuccucucugugguucucuccuuccugugauuuacucacuaagcuuucagcuguuaugaucaugccauugucuguccuuugguucaucaagcaaguaagacugcagguuuuuuaucugaguguuagcuacccaaacuaacugggaccugcucucugaguaaaagccauuaaaaaauggaaaguuacccuugcuguuuccuucuuccaagugcugaccccuuuuucuucccuccaccaauuuguuucuuccuccuucagguaguuuuuuaugcauuucuacuguuuauaguuguuauucaugaaagauuuggucugguaggcguuacucagccaucacaggaaguagaacccauaaaauaaaauuguacaauugaagaauguuaucauuuguguaggugauagucuuuauuagaaaagcaggcaaguauggugagagauuucaguguauguuuuaauaaugaaauacguugaaauuuguuuucaugguucauccuccuuuaaauaauaaaaaugucucaaucagacuauuugccucucccucaaauuguguauaaauuuuuuuuuuucaaaucuagaucauuugaaauauguuuuggaagccuuauagaaggaaacuauaaagaaaccuuauaauaaaauauucauuuuauucaacaaauauguugcaucuucugugagccaggaaugauccagauccuggagauagaacagugaacuucagaguccuugaucccauggggcuaauguuuuggggauggagagauaauaaaauauaucucagguauugauacauguuaugaaauaaaagcaguaugagggugcaauggugggagauggggaagaguuauggcauuauuuagauagagggauuggucagggaaacugucucugaagaagugacauuugaucaacauucuuaaugacauaagagaagggaguugcagguggaucuaagggaaaacuguuccaguaguaaaggagcagcaaauccgauagcccuaagggaagaacaagagugacuucuuugagaaaucaccagacugccauuuugaauugagggaacaaggagaggguagaagaugaaguuagaggggugguagauagccaggggcuuuguuacauugcauuuugaacagggaaagugaugacucugauuuacuuuucacaaagaucacgccgcucaguaaagaaaauacuggggacgggaagaagugguauguuggcaaaaagaaggaagguggggagaccuauugaggccuuugcaguaguagucuagaugaauuaugaugguggcuuggacaagagcaguaacaagugggaaaaauugguuagauuaagaauacuuuuuguauauaagccaagaagucuugaugguagauuagaugugggaugagagaccaacuggaugaauggugguaccauuuacugacauggaaaagacugggaaaggauugauuuggaugggggaggaauuaagaguuugauuuuggacauacugagcuugaaauaaguugauacacaaaaggagaugucaguuagccaguuggauauguuagucucaaggaagagauuggaguuggagauaauaauuugccaagcaccaguauauagauauuauuuaaagcaauauauuugaaugaaauuaccuugaagaugaauguagauauaguugaaaggaaaccauagaucugaacucuaccagccaccaacauucagauguccagaaaaggaaaaggauccagcaaaguaaacugagaagaaucugccaguaaguagaaggaaagccagaagaguauaaaccucagaagccacaugaagaaauuguuuaaagaaugagggaguagugguugaauggguccugagcuacagagagaucuaguaaguugaggacugagaacucaccauuggguuucauaaacuaaaaguguauaguggcuuugauaaguguaguuucaguggagaaaaacuaugaaagccugagugggguagguuaaaagagauuagaagggagggagaaagugaagacacuuacguauaaacaacccuuuccaggaguuuuagcccaaaauugggggaagagggagaaaugagcugauagagaggagucaaggaaggcuuccuuaaaaugagcaguucuauagcaugauugucgccacuuaaauuauuuuaaauguccuuuacucauuucuaguacuuucucuccugcaacccauuuauagaaacacuacuuuugaaugcgaaaauuuguguguguguguguguguguguguguguguguguuuacacagaaauacuuuuggaaaaucuacaaugcaaauaacuugauguuggcagugauuuuauccaugagauguaacuaagcuaaagccacauagauaaaauaauuaaguacaauuuaaucaagugaugauaaaaaacuaaaaggcuuauuacuauauaagugagcgcuuauuuuauugagcacugaggaguucuauaaaucuacucaaaacuauuuuaaauaucuacucuuaugcugaagacuguuuauaaaaugcuagauauacaauaauaaaagagacccaauuucuacauucaugaauauauagaccuguauuuuuaggcuuauguuaacgagguuaaaaagagaaauaccacaaauaagaaauuaguuuuaaagagauugucuucuuaugaaauuuguccuaaugaaagguauuuucaaauagcaugauuuuaaaugucuuaauauuuuauuuagguuaauguacuuaucuccuauuuauauccccaaaagauuuuucaacauuaaacaugguuuaccuuagaaacaauaggaauaaaaauaagguggguaguuuucaacuucgaccacacauuagaaucaccuugggaucuuuuaaaacuccauaugcccaggcugcucacuccucagccaauuaaaucaaaccccuugggaaauauuaguauuuuaaaaauacugauuuaauagaagcagagggaauaaaaugcuacuaagcuccuaagaaugaauugauugugcauuuaaggauuaaguauauuugaaagauaaagcaaaauauugaaugcauuggguuuugaaucauuaaguuuuagacaaaacggagucauuuguaguaccaaauuuuuucaguauccaaacuuuaagaauuuagauuacucaccuugggauaaucauuaagaaaaaaaucagugauacuauuucuucucccuuuuuaaaagaaucugggaagacaaccuugaaaguaauuucuuacuugaaugcuuuuuggcucagccauuauagagcauauaaauacauaagaguuagacaguaugaaaguuuaccaucagaguuuauacuaaaaagauaguauaacuauauggaaagcauuuuaggucuaaauauuuuuauaguuuauaauguuaagugcuaaagcacauauucuuuuguacugaaauuuuaaauccacaacaauauuccuucuauaaucaguucucauuaaaauuuuuuuucuuucuuucacagaaaaugcuuggacagaagagaugaguacuauuuccacuaaggccuagaauugccuacuguacaaauaguccugaucaggcaauauacgaauggcccaaggaagccaccaaauugauuuucagguuuuacaugaccugcgacaaaaauucccugaaguaccugaaguuguuguauccaggugcauguuacaggucaguguucaaugauuucugaauuuguuaauacaaaccugguauuuuuuuaaacauuggaagaaaaacucuuuuagguuaucuucuuguugguguuaguguauuaugaugaaaagagauaagcuuuggugucugauagucauguggccuuuggcaagauggagcuuucuguacccaucuguaguauggauaauacuugacuuguagaguagaugugagaguuaaaugagaucugaauguaaagcauugauaauaucuguacuuacuagacaugagcuuucuuaacuuuucucccaccuguucugccaggagagcuaauuucagaucuuaguaugaaagugagaaaaaugauuaaagagucaggaaacuuggguuauaauccuaaaugggcaccccaagcauaucugauaaagaauaugcccucugugcuuuagguuuuuuuaaucuguaaaauaaaagaguuugacuagacaaugccuaaggucccaauuccaaaugggggaaaaaagucuguuuuuauauuuuuaaauuuaauuuguaaguuuuccaauuaguaucacccucuaauuuguacauuguucuuaguauacacaguuuuggaaauuuacaauuccaaauauugagugauaguugugccuuucuauuuuauuaaacuggaaaucuuuguaucagaaauguauuuggggccaugugcugugacucacuccuguaaucccagcacuuugggagguugaggcggguggauugcuuaaggccaggaguucaagagcagccuggccaacauggcaaaacccugucucuacugaaaauaccaaaauuagccagguguggcagcccacaccuguggucccagcuacucagaagacugaagcaugagaauugcuugaacccaggaggcagagguugcagugagcugggaucgcgccacuacacuccagccugggaaacagagagagacccuaucucaaaaaaaaaaaaaaaaaaaaaaaaaguguccggggcucagucaagcauauuuacucuugaagugauuuuuaaaguuugaaauuauaugaaauuuuuaucaaaucuguaauuuauaauaaugacuacauuuuguucacacccuuaucaccauuaucaccuuuuaauuggucuaccugccuuuaccuaacccaguuuuggucucuccaaucuauccucuucugccagagugcagagcuguucacacacuuaaaaccuguugauuguucccugugcccuucugaaugaagcucauauagcuugacuagggcauacaaggucugugaucuggaauccuggcuguuucuacacccugaucuuuguccaguccuuccuguucauacccuauguucuggucauccugagcugcauggaauucucccaccagcaaugccuuuucuuauaguauaaugguuaagagcauaucuuuuggugauaaaccaaacugaguucaaguuuugacaguugcuagcaguaacuuaauuaacuucucugacccucauuuucugacuuucauuuccuccacuguacagugggaauaaaaaaaacuacacagagaguuaaauuugacaauguagauaaaacaaccaguaggguaacugauucauagugaguauucaauaaauguuagcagccaauacuaaaaggaauaacaacagcagaaagcccauaagguauauuugguaaaugaaucagugguuuacauuuguuaauauaaaaugugaaaaaaaaaugagagaauaaaaacauguaauaaagauggagucagaaguuaaaagaaagugugggaaaggagcggagauaguggggaaaaauagucuccccccuagaacccaaguaacuucucccuaacuuuucaaguaaaagagaauuuugugguaaaauaaagcuaugcuguucaguagguuauuaaaaaacuaacagaaagauacuguaaguucuuugauaaauuucuguagacuucguauugaaagaacuguccagagcauuucccuacauauaguacagguauagagauuuugaaauaccguaacugggaguaaaacauagagccuuuuguagaauuacuuuaaaauauuuucaaaaaaaaaauagagcacucuaauguacucuuacaguauaaucucugguauguguuaagaaaaacaagaugcagagcagaguauauagacagagcaagacaaauaaauauuuacacauccauguauuugucucuguuugcauaaagaaauacuggaagaauuaaaaacaaaauuaauaaaagauguuuauccaugguaggccagagggaacaggccugaugggacagaguuaggacucagacuucucaacagguaucuuuuuuuuauuguuuuaaucuguguuaauaaauuaucuauuuaaaaauaaaauaauuaagcuuuaacccaaaaauaaaaaaugaaugguuuuccguuuccuuugggcaucuaguaauaucaccuucccuauguuaaucuggcuuuacaaaagcaaacuccucuacuuagcaugcuucccaacaccugguguuaaugaaaaugaaauacuuugcuugccugaaacagaccacacuuuuuaaaagugaguugauaauaauuuaggguauccagguaauguacuuuuuagcugauauaacaagaaaucugacaagaaaggaauaggaagagcuccuuccucugugguuucagcuggggugcaaguuuucccaaauuuagagcaauauuuuuaaacgggcaaauuaagcuaccucuaaaugacagcgucucuuuuggggcugcucuuccuuucucaguuggguggguuucuguucuuuugacagauccuuccugcaguauacugguucagaacuuuuuaaaauuaguaaaggaucaugccaugcuaccaauucuguguaccuguucuuuuuaaacaucuugcuugucagggagagaacaaaagugucuauccucuuuucucuuaaguuuaucuguugcacaguucccucuuuuuggaacuacucauaucuuuuccuucugcugugaauucuguaagauaacuuauaaccagcagguguaauuuauaucuuuaaaguugauuuuuauauuugguaauuaaaucugaaaacuuagaagaaugugaaaauauugcauaguuuucacuuugguuuuuuaacuuaauuuuuuaccguuuuuaaauucucuuaacaugacgauugaaucuguaaguuuaaaauugguauuucuuuucaaaguacugcauuaaguauuuuucauucaguauaugcaacacuuaauauuuaagugccauguacuuaguggaaccuucucagaugaccuucacccauuguccuuauccauauuucuaugauaacaccuaccauacugcauuucauuuguguucacauuauucuccuccacuagacugagauucuugcgaucagcgaucauauuccuuucuccuugcuaaugaaugcucaguaaauguugguuaaaggagugaaugaaugccauaggguauauaugcuuugauacuaucuguaauuucugugucugugcaggaguuuggggaaaaaugaaagaggaacuggaauuaaugauucagaccuuuuuauagcuuugaggagaaugcagauuuguggcuguauaccaaaaagcagugauuuuccaccuucuaaaaacucauaucccaccccuuuugauacacuucaagagagucuucuacccuuucucacuaaaaguaaccagggcugcuuugagaaauggcugauugcaagucuggaguagauguacaugauaagcuagaacaucuugucauaucagaaagcagagaagcuuugaaaaacuacuggauucaugucguauaccgaggagccaacuugaagcuguucccaguaacuugaagaggggacauaaugaccaaaacugauugaaacacaucaaaauauuaaagacacaugaguuuauaaugauacuaaaaauaaaucauagucaccuuuggagguugcuagggaccaaauuuguuacucugaaaacuagugaaaagaauuuuuuuauccugccucuucugugcagaauguaaccaaauaguugaagagagcaagcauucaaggaagaauugcugcuaagaaugaagaugaaauccauuuuauguuuuuuggagacugggucucgcucucacccaggcuggaaugcagcagugggaugaucauggcuuacugcagccucaaccuccuggguucaagugcuccugcuacuucagccuucugaguagcuggggcugcagguguccuacucuaccuggcuaauuaaaaacaagauuuuuuuuuagagacagggucucacuauguugcccagucuggugucaaacuccugggcccagcgaucaucccgccuuggccucccaaaacgcugggauuacaggggugagccacugcgccuggccaaaaucuuauaauugggacauuccaguauuacuguuuagcaccccuaaugaaauaguguuucuaagcagugaucaucaauagcugcuaaaaaucaucaguuggaucaagcugacaacaucugaaucuaccaguugguuuuaaaaucacaaaaagacaggcaaacauugcugugucuccuuguaugauuugacaguggaugucugugauggucaccaaaaauucaaacauggacuucaucacaucccuagauauaacuacuaguuuacaaugaaaugcaggggaaauugauugaccacggggugcaguccagaauaggggaaauucuacuacacaaauaccaaguuuucucaacaaacaaauggcuagaaaaaauuuuaaaagaggggaggggcugguuauuagaagaaaccuaaaaggcuuaucagccaaaugaaauauguaggccuuauuuagauccugauuuaaacuaacuguacaaagacauuuuuaugcuuuaauuuagugcuauuugaauauuaggugaugcuaagaauugauuauuuuaagguaugaucauggcauugugguuauguuuuuaaguccugucucuuacaguacauauugaaguauuuacaaaucaaaacgagauaaugucugagacuucaucuaguuugguagggggaguagcugaggcauauacaucaaacgaacaaagaugggugauaaguaugugggaguuuaucauauuuccucucucuuuuauauauguuuaaaauuuucuaaaauaaaaauuuuaauaaaaaguacauuuccuuuuguccuaauguaaccuuauaaaaccccuguaaguucuuuuauguuuugcuauuaagaaaguaaugucuguagaguguaaauaauuugagugcacauaaauuauggcauaacugagcuagaauauugcuuuuugauaugaacauauugaauaauuacagagauuacaaaggauuaaaggaauuuuugagcgcucaagagaauuaaagaggaaggcuaaauaugaguaucaagcuuuuacaaaggaaauguggaauuggauuugguagggaauguaaauuuuaaauugagaaugaugacagagaggaggugagaggaagauaaacucucugagcuuuggcuuagaaggaagaagaauuuacuuggaauggcaauaaauuuaacuuaaagcaaaaagggccaaucagguuuggcaaaagauaagaucuaauuauaauaggaaucguugauaaagauugugaucaguuuuucaacuuuauuugaaaaauuaguauguaucaauuaagaguuauuaguaggauaaaaggauuuuucuaccaugagagguuuaaguuguugguuuuaggaagggggaagucaaaccuugcucacuauccuuuuauauuaccuguugaaacaaugugaacugucauuuccuuaacaaggcaucaagaugccuuuuuaguccacuucuuucuuaauaugauuuuuaucucauaucaaacugccuguggacauuuuaacuugguuauucaucuuucuuaagucuaaaacucuccuuucugucagguucuuaaucuuccaggcuuauuugaauuguuucucucuuguggccaaauuguguugacaauuuauauuauuuuaaaauuuauuuccauuaucaaacucucguuacuuugugucuucuaacugcucaucuugccaaagguuuuucaucuuuuuauucaucuuaaguaucaauagacuucucuucccugaauacccuuugugucuuuacuucucuguucauccacuuucaguagcucuccucauugcuuauaauacagucaaacucuagcgugacuuauuuuucaaaacuccuuuguuauuuaauuccaaucugcuuuugcaacaauuuguucaacaacauuuucaauacaaauauuuagcuccagccagaucuguuccagccaucuuguuuggaacaugcuuuuacuuaacucucaccuuuauauucuucuuuacucgugccauucucuucaccaagaauuguuguuguugucguuguuguuguucaaguucuacauauucuaugaaaaccaucaggccauaccuuccucauuaacucaguccuuucuucgguagccuacaauauuaauucucuauugaacuucauuaccacuuaauauuuggcauguacucauguuaccuuuucagaaaucugugguuugucucccuuucuaggggaaaaguuugguuuuauaugucuuugauucuuccacaggcucacagugcuaugcauauaguauguguuuggcaaacauuuucguggaugauuuaugacuacugguuaguuaguaucuuuugagaauucuuuaaaaacaaucugagguuccccccccccacucuggaguagauuuuuaugauguuaucuaaaggcagagauaggagcuaguucuucuggaggcuaccuugagccuccagagagagagggauuacacaaguuaagaggaagcgugugaaggauugagaugacugguaugaauuucagaacuuuaaaugcuacaaauguaacuuauuuuuuuuuuuuuuuuugagacagagucucgcucugucacccaggcuggagugcaguggcgcagucucggcucacugcaagcuccgccucccagguucacgccauucuccugccucagccucuccgaguagcugggacuacaggcgcccgccaccacgcccggcuaauuuuuuuuuauuuuuaguagagacgggauuucaccguggucucgaucuccugaccucgugauccacccgccucggccucccaaagugcugggauuacaagcguaaaaacaaucugagguuuuuuucccccccgccacucuggaguagauuuuuaugauguuaucuaaaggcagagauaggagcuaguucuucuggaggcuaccuugagccuccagagagagagggauuacacaaguuaagaggaagcgugugaaggauugagaugacugguaugaauuucagaacuuuaaaugcuacaaauguaacuuuuuaaacauuuauuaguuuaaacaaauguguauagcacuugauacauugugcuauauaucaaacauugauagaauauuuuuccauuuagcuuuuuaaaaaauguuugauuauacaguauuauauacuuaaguugaaugauuauauuuuguucaacauuaaaauugccuuuuuaauuagguuauaauuuuacuauaucugucugaauccauuuuacuccucguauccauuguagcugcuaaaguggaacaaugauuugauucacuuuguuagucagagagagcuuuuccauuacauuaguagugaggauuuuuaauucaaucauuugcauaaaaaaacuucucaaauuuaaauauccaaauauauguuauaauuguauuagccagucacuugguaaucauguauuuguagagaugcaaauauaagcauucgcuucugauuguuaacaucaaucaauuuauuuuguuuucauagaauaauaauaaccuggaugccugcugugcuguucucucucaggagaguacaagauaucuuuauggugaaggagacuugaauuuuucagaugauucuggaauuucuggucuacgcaaucacaugacuucucucaacuuggacuugcaaucacagaacauuuaccaccauggaagagaaggaaguaggaugaauggaaguaggacucuaacgcacagcauuagugauggacaacuucaagguggccaguccaauagugaacuauuucagcaggagccacagacagcaccagcucaaguuccucaaggcuuuaauguuuuuggaauguccaguuccucuggugcuucaaauucagcaccacaucuuggauuucacuuaggcagcaaaggaacaucuagccuuucucaacaaacucccagauuuaaucccauuaugguaacuuuagccccaaauauccagacuggucguaauacuccuacaucuuugcacauacaugguguaccuccaccuguacuuaacaguccacagggaaauucuaucuauauuaggccuuacauuacaacuccuggugguacaacucgacagacacaacagcauucuggcuggguaucucaguuuaaucccaugaacccucagcaaguuuaucagccuucacagccuggucccuggacuacuuguccugcaucuaauccucugucacauaccucaucucaacagccaaaucagcaaggccaccagaccucucaugucuacaugccaaucaguucaccuacuacuucacaaccaccaaccauucauucaucugguagcucacagucuucugcccauagccaauauaacauucagaauauuucaacaggaccucgaaaaaaccagauugaaaucaaacuugaacccccacaaagaaauaauucuucaaaacugcguucuucuggaccucgaaccuccagcacuuccucuucagucaauagccagaccuuaaacagaaaucagcccacuguuuacauagcugccagccccccaaauacggaugagcugaugucccguagucaaccuaaggucuauauuucagcgaaugcugccacaggagaugaacaggucaugcggaaucagcccacacucuucauauccacaaacucuggagcaucugcugccuccaggaacaugucugggcaagugagcauggguccugccuuuauucaucaccauccucccaaaagucgagcaauaggcaauaacucugcaaccucuccucgagugguagucacucagcccaauacgaaauacacuuucaaaauuacagucucucccaauaagcccccugcaguuucaccaggggugguguccccuaccuuugaacuuacaaaucuucuuaaucauccugaucauuauguagaaaccgagaauauucagcaccucacggacccuacauuagcacauguggauagaauaagugaaacacggaaacugaguaugggaucugaugaugcugccuacacacaagguaauaugaauacuaaaggugggaugguuuuccaugcugggcuuguuggugugcauuugauuucacaacagaaauggauguuagcauuguuauuucauuguuuaaauauugccccaaaugauguuauuguaacauuugagaguauuauauguauauacauuuuaauuuuaauuuuauuuuauuauuauaaaacuggaaguuugaguaauuggguuaucagcucuucagaguaaccaaaucugguuaguugguuuguuaauguuuauaacacuuucuuuucaguuaaucuuauaccuguggugaugcugacuuucucuuuaaauuuucuguaaauaaaaauuccuagaaauaacguuuuaauaagcaacuaguugacucucuugacuaauaugguaaauuugccuucuuugaccagauauuugaagaauaaguaauucuuggcugggcaugguggcucacgccuguaauuccagugcuuugggaggccaagaugggaggaucauuugagcccaggaguuugagaccagcuggggcaacauauggagacuccgucucuacagaagguuuugaaauuaugcaggcaugguggcacacaccuguagucccaguuacucaguagacugagguaggaggauugcuugagcccaggaguucaaagguuagagugaacugugaccauaccacucugccccagccugggcagcagagugagacccuucucugggguggggggaaauucuucauuuuucuaauacaacauuuuagucuuauuuuauauuaagucuauuacugcguaaguauuagaauaauuuaccucaaagagaaguuugaaucuuguuccugauauuugucccuuuuauucucccuuaaauguugguuaauauauuucuuuuuacauggaauuauaaggacauuauuuucaaaucuuucaauugauuauccuuuucugaaauagacuauuugauauuggcauacuacauuaugucuauauuaauucaaauagagaaauuucugucauauguuuuaucuaaccucuuaaguuacauaauuuucaguaggacuguuaaauaaauacauuuagauaagaagguggagguuauucauuuucuugaauauuuaugccaguuuguagaugaacugagccuuuuagaguaagggcauaucuuagucauauauguaucugcagugaaucauuucauguaucagcuguagguuggaaaauacuauaacaucacccucaggcagcaugcagccccuacugucacuaauauccucauccuuuuuuacauuucugauacagugauuuuacugcugagucucuuaggggguccuaauugcuuugccuuauuuuauguuuuaaacagcuacacuagugauucuuaguccaagcuggguugugguccuuucgaauuccaguaucauucauggagcuuuaaaaaaucagcugggcacaguggcacccgccuguagucccagcuucucagaagcuaaagugggaggacugcuugagcccagaaguuugagguugcagggcaccacugcacuccagcgugggcaacauaucgagaucccuaucucaaaaauaaaguacgcagggcucugcccaaacuuaaguaaagugaauccuagguaugcgugugcauguauuugugugugugcauuuuagggguacaugagugauuucaauugcccuagaaauuguguuaaaacuuuuauuuuccauauaucugugauuaacuacaaccauuuuuguuuaguuucagcaguuuauaaauguuauaugcuauuauuuuuuccacuuacaacuuaauucuccucuucucccaaagucaccuucucuuccuguccuuccaucaaaacaucagguuuccuaugguuggauaguugcugauucuuaaguagcaaauuuuuuaugaagauaauuugauaagggaaauuuucaaguaaaguaggcauucauauuuagugauauuaaaaagauauucauguuuaacuagaaugugaaaauaaaguguuucuuaaacuugcuaucuucaauuccccuccuauucuuuuuuuuuuuuuuuuuuuuuugggacagggucucgcucuuucguccaaauuggagugcaguggcauguucacagcucacuucagccucaaccuccugggcucaagugauccucccacuuuagccucccuaguagcuggacuacagguacacaccaccacauccagcuaacuuuuuguauuuuuuugcagacagggucucccuauguugcccaggcuggucuugaaccccugggcucaagagaucugccugucucagucucccaaagugcuaggauuacaggcgugaccuccacaccuggccugugacuucuuacuucccccaucaucacuacuguggucucagcaaucaucaccuuucaaauggauuauugcagugaccuacccauucucguccuugccuccuugcagucuucuuucaacucagcauccagggagauacuguuaaaaauaugcaucagaucauaucacuucucugcacaugaucacuaucuauugcacucagaauaaaagcuaugaagcccuacaggaugagcagcuucuccccccagcucuuuuccuuuugcuuaccaccugcucacuguguuccagcccuccuggccuucuuacucucuuccuuaaacauagaaggcaaacuuuagggcccuuuuauuugcacuaguauuauuuuuuagacuaaaacauugaagaacagauagauuaaguaacuugucaaaggacaaguggcagagucaaaauucuaacuagaggcugggcacgguggcucacgccuguagucccagcacuuugggaggccgagguggguggaucacaaggucaggaguucaagaccagccuggccaacagggugaaaccccaucucuacuaaaaagacaaaaauuagcggggcgugguggcagacgccuguaaucccagcugcucgagaggcugaggcaggagaaucgcuugagcccgggaggcagagguugcagugagccgagaucaugccauugcacuccagccugggugacagcaagacuuugucuaaaggaaaaaaaaaaaaauucuaacuaggaaguuagagaagcccacaauguuaaccacuaucauauaaugucuuucuuuccagauuuucauaauaaacccucuggaaagauauuuuaaguguaucuuguagcuucacuuauagcccaugguacaacacugugggggccacaugugccucaauuugagagggauguagcuaaaaaaccauuaauuaaaaaaaggcaaccauagggaaagauaacacaguaaauagauaacaacaaguagaaauaacuuaaggcugggcaugguggcucaugccugaaaucccagcacuuuggaagaccgaggcggguggaucacaaggucaaaagaucaagaccaugcuggccaacauggugaaacaacaugguaucuacuaaaaauacaaaaauuagcugggugugguggcgugcaccuguaguccuagcuacucaggaggcugaggcaggagaauugcuugaaccugggaggcagugguugcagugagccgaguuuguaccacugcacuucagccuggcaacagagugagauuccgucucaaaaaaauaaagaagaaaaaaaaaggaaagaaagaacucuaaacaauaaaguaacacccuggauagaaguagagagcacuuucagaggacaccugaaaguaaaaauaaaaaaacuuucugaugagagaagucugugguuugagagcuuaaauuaaagccuaccaagaaagcagguuucuccagaaucugccccucaaauugcuuaacagccuucggacagcucuaacaaccuugauggagguuaaagcucuaacaaccuuuaaacauaccuacauacauacagaauuuuauaacauuuguuugacuacauaguuuugcauuaucugugugugcacacuguuuugggauugguacuguucuccaacuuuucuucuccuuguuucuguuuacuauggaacugguauugauccagauugaccuaucacccaguaacacagucuuuuuuuucugagauagagucucacugucauccaggcuggagugcaguagcacgaucucagcucacugcaaccuucaccucccggauucaagcaguucuccugccucagccucccggguagcugugauuacaggcacaugccaccacgcccagcuaguuuuuguauuuuuaagagagaugugguuucaccuuguuggccaggcuggucucgaacuccugaccucaggcaauccgccugccucagacucccaaagugcugggguuacagacgugagccaccgcaccuagcucagugacacaaucuugaucuaguguuucauucacuuaauucaagacaaaggaggccuuugcuggaaaaugcaucuuuucugcuuuuacccuacauaguucacagacacucucugcaguuacuaaacgggguggccugaguaauccugaucuuuaagcaaggaucuuuucuaaacucugagugguauggguaagaaaaagaaaagaaauaucucggucuucugcagugaaauugauuuuucuaaugcuccuggaaauacuguuuuagaguagaaaaauaaguggagccaggcacuagaaucauaggaaaauacuuuuuccaaauugagaagggaacauacguacauacauaaauuugguaaccaaaaugcauuuuuucuuuuuucuuuuaaucuaccauuugaaaucuaaaauacugugauaaaaacugucaaaagugaaaauuuguuuaugaaagguauauuguuuaauacauccucuacuauagagugaucagaagcaaaagaaguaaauuaaugaaacaucaagaccccacucaucucagcacuaagucugucagcaccaccauccuuccuaaaggaaauaaauuaaacuugauuccuuaagguacuacaggaaucagagacaaaaguggaaagaacaaauuaagguuggagagaaauuuucaguuuaaaguuuauagauaugaagaaaauucuuauuuuacccauuaagaacaaauacagaagugaaauuuucuuacugguagucaguggucagauauagcuacauuuuccccuuaagucauaccacccaacucuagcuuccaaaaaauguugaaaacuaucauucagcauauucugagacauucuagugucuucauagugguauaccuguuguaacacuggcaacuuuuauagguauggaggacaaagcauuccaacaaauuuucaugguggagagaaaaaggccuacuuucuuauuuuguuacagaagccagaaacucuuaaaaaaaacuaacauugcugccaaauacaauuuccacacaacuccaucugugguauugacuuagcugguaaacuuuuuauuauuuaaagaaaaaaaauuacauauauaaaaugauaaauauuuuuaaugauacuuuaauaugguuuuuccucaguuauguuuaaaguccuaccauaguguuaagcaguagccuugacuuugaaccuaaaauagaaauacaaguaagaaaaauuaugaguugaaaauuagcuucuuggacuuuguguuucucauuccuuaccauuuuucacuaguacaucuauccaaaucacaacacguuucuuuuuaaugagauuuaauaaaaaauguuuauuguggcacaaauucaaugagcaagauacucuucaaaaggaaauauaauuuuauuuaguucagauucuaaaacuuguacuuuguuuaacuuuauguaucuuuucauuggaaauaccuuuuuguuauucuuuguugacauugaaaucacuuuauuaaauaaaagccuacugcaguagcacaugccuguaguucgagcuacucgggagucugaggcaggaagacugcuugagugcaggaguucaagaccagccagggcaauguagcaagacuuugucucuaaaauaacaauaauaaacucagcaauuaagauuaguugacauuggaccacuuacagaauauuuuuuucaaauuagcccuacuacuuguagguuccucccagucuuaagacuaaauaccuuuuuaauuugggguaaaugucagaauuggaagagacuuuaaagggcaugaagaauucuacuccaaagguuauccaguccacguacccauccagccuaucaaguguaaauccuuucuguacuuuaaauucuuaugagacacaaacugccuccuaagguagcauauucugguuuuggagagcucuaccuacuagcugguuauuucuuacauuaaauuaauaccuuuaaaaaguauuaugaaaauaacacacucaguaaaagaaauuuuaaaaaacaaaugcaauaaaaauguguuucuuuucaaccuuugacuugucacuuccuccagcuuuucccuuauuuaacugugagagguauucucuauuagcaguuacuuauccccuucccauuagauucacucaauccccuucccauuauauuccccuucccauuauauucauucccuuuauauucacauacacauacguguguguauauauguguauacacacacuguucuuaaagcaggaacacacuauacacaugggucugugaacacacgggauuauauaauaugcacauacucuacaauaugucugacauucacuaaaugagaacaguacacuuucuuaaauauauuaaguuacguaaaucuauuauucuuuaaaauuuuuuaauguuuagucauuauuuuaacagcuuuauugagauauaguuaauauacaugcaguugacuuauaguauacaucaguuuuuaguuuauucacugauaugugcagccaucacccagccaguagaacacuuucaucuccucuacaggaaaccucauauccuguaagcuaucaccucccuaucccauuaccccccacccucacucagcacuaggcaaccacuaaucuacuuucuuucucgauaaauuuacauauucuggacacgugauauaaaauggaaucugaucuuucaugacucaucuaugguauagcagcaacauguucuuuccuuuuuauggccaaauaugccauuauauaaauacacugcauuucauuuauucauucaucaguuaauagacauuuuguuuuuuuccaccuuuucagcaguggaauuguugccauacuguuuuccaaagugauuuguauucucaccagcugugugugaggguuuucauuucuccccauuuucaacaacgcuuuuaucugacuuuguguuacuugccauccuaguggcugcaaaguauuuaauugugauuuugauuugcauuucccuauuggcuaaugaugucaagcaucauuucaugugcuuacuggccauuugcauauuuucuuuggagaaaugccuauucauauccuuugccuacuuuuaaauuagguuauucaucuuuauuguuaaguuguaugaguucucuguauauucuagaaauaagucccuuccaugauuugcaauuuucucccauucuguguauugucuuucacuuucuugaugguguccuuuaagcacaaguuuuuuauuuggcugaaguccaaacucuauguauuuuuucuuuuauugcucuugcguuugguguccuaagaaacaguuucuaacucugaggugaggucauaaagauuuaccccuauuuuuuccuccuaagaguuauauaauauuaguucuuauauucuagucuuugaucuuucauccauucugaugcaauuucuauaucauggcaugaaguaagaauccaacuucauucuuuugcauguggcuauccaaguaucccagcaccauuuguugaaaagacuuuuucuccucauugagugauuuuggcaccccuguaaaaaaccaguugaccauaaaugcguggguucauuucuggacucucaauucuuuuccauuguucuauauguucuuuaugccaauaccauauggucuuaauuacuguaauuauuuuauuauuaaauugggacaugugaguucuccugcuugguucuuuuucaagauaggcuuggcuauuuagagucucuugaaauucuaaguaaauuuuagaaucaguuugucaauuucuacauagaagucaacuggaauucugauaggaauugcauuaaaauauuuuccuacauacuugcuuuuuuaaaaaacugaaaacagaacuaaaggguauauaaugaaaaauuccccucacuagagauaacuaguuucucaaacaguucauuuuguauucuucuaggauuaugucucuuuuuuuugucuuuaucucuuugagagaauuccaugucagcaggaucugcuuuuuaagaaauggcugcauaguauuguguaccauaauaucuaaccaguccauucuugauagaccuuaaguaguugcuaaucuuguuuuuaugaacagugcugcaauaaaaauccuuguguacacauaauuguacccauguccaaguaucuuggcagacugugagauuacuaggagugaaacugcuguguccaaggauauauguguuuuuaauuuugauagauguaucauuuaggcuugguuauguugcaguaacaaaccaugucuuaaaaacaacuaagauuuauuucuagcucacauuuccugucccauauagauuagcugguggccucuguucuccaucacccucaccaagggacccagguuaagggaagcuccaucucugugcuuccaugaccaaggaaacauagugggugagcaguggcuccuuaagccucugccucaacgcauguuacucuguagcuaaaacaaagcacacagccacaccuaauucagcaggaacagggaggcacaguucuaccacauaccugggagacagagagccagaagaauguggggaaggacacuaaugacugccaauaaauguugccaauuucaauuuugaggcucucucuaaagagauuuuaccaguuuaugcucccauacuuacaaauggguaacauuuuugguaacauuuauaagaauauucuuuccuccuuccuuuccccacucaucauauuuuguaggugguugaaaaaaguauuaucuagucaguuuaauagguaaaaauauauuguugcuuuagguuauuuaaauuuucaucuuuuucuugggagcuuaauuugcauauuuaaauacgauugagguugaacaucuuuucauguguucuuuuuccagccauuuguauuucucaccuuaugaacuugccuauuucuguaaaaugccuauucuuucuacuuuguuacuaccuuuuaguuagucaauaaaauuuuucugccuuauaaauuuuuuacuuuuacauauucagacuucucagaauuuccucuuauggcuucuggguuuugugucuuauuuagaaagccuuuccauauuccaagauuuugaaaaaagaauaacagaaaucuuuuuuuuuuuuuuuuuuugagaucgagucuugcucugucacccaggcuggagugcaguggugcagucucggcucacugcaaccucugccucccagguucaagcaauuccccugccucagccuccccaguagcugggacuacaggcaugcaccaccacgccuggcuaauuuuuguauuuuuaguagagaugggguuucaucacguuggccaggauggucucaaucucuugaccucauaauccacccgcaucggccucccaaagugcugggauuacagcugugagccacugcacccagccccagaaaucuuaccguuauuuucucuuuaguauuaccuugaaaccauauugaacuggucucauggcaucccuucaaaacuugaacauauccucuuuuaaauuguaaaucuggccaggcaugguggcucaugccuguaaucccagcacuuugggagcccgaggcggguagaucaccugagguugggaguucgagaccagccugaccaacauggagaaaccccgucuuuacuaaaaauacaaaauuagcugggugugguggcacauaccuguaauuccagcuacuggggaggcugaggcaggagaaucacuugaaccugggagguggagguuguggugagccaagaucacgccauugcacuccagccugggcaacaagaguaaaacucugugucaaaaaaaaaaaaaaaaaaaagguauaaaccuuucuaagccauaaucacucccacgucgcauaaugacucauccaaguuauauuguuuugaggcucuuuuggugcaucuaggccuguuuucauucugucuaaaauaaaaguuuuagauuauaucuuaaugcuguaagauuacaugcagaaucuuaauuauguaaaauaaaggccagcaaauuauuaucuagcaagaggucucaccaguuaugcuaaaaugacuaaaauucaucucuuaguagguucuuaaaaauaauuacagagauuaagcaucauuccucauacuuuuauuuuacaucuauugcccaaauuaugggcccaauugcagcacuguuacaagaucugauuucaaauugccuuuaaaaaugacaaaauaguuuaaaaguuugcuuuaaaguuauaauugccaucuuugaaucuuuuaugacucagucaccaaauaagugacuaugguaauacagugauauauaaaacagaugugauuccuguugucaacaaaguuacagccuagaaaaaucuugauuuauuuuagaagcugacauuguacuuuccuagguacaaugacuuaaguaugacuuaggcuuguuccugauuuagacauguaaaauugucauuacagacaaaaaacaaaaagauaccagaaguaaguaccuauuagguuuuucaauagcaaaauuuuuccuuuuucauuuaaagaagccuaaaaucuuuguaucuacaagucccuaguauauuuuccaaugacauaugucuuuucucaguaagcaaauucucguguuuuuguuuuuaaacuucuggagaaauuugacauuauuuacaguaaaaaaauaacuaaaauuaauaaaacuaacaccaucuggaacuucaagaguguuuuuuaaauuucaaauaaaauugaguaacgaagaaauuuucuccauuguucgugagcuaacaaaaguuggguaaguacugagcuuucuguauaaaccauuuagaaugcuuauagcagugguuuaagagcccuggugcuugaauucacuuaguacucacuuauuuuuaacaacaacuaagagagaguugcaugcuuaaauuaccuuuauccauuaaaauuuaacuuugaaagaggauuuaaaagauacugaauauuuuuuucuuuaccuguaauuccuucaucaucuguucacugcaaagcccagucauuuaucuguuuuccuuggaauuuuuaauuuuuguuguuguuguucucugccuuuaucauauccuuucagcaucuccaagauaccaucuguucauuuuuccuggagucuucucuucccuguuauaaauuacagucgccauucuuggaucuuauauuaucuuccuucuugguuuaugccuucaauuugcuagaacaugucuuuaaguauuuuccuaaugagacuugggagguaaauucucuuaaguccuuaaauaucuggaaauccccucauauuuuuagcuggacauagaauucuugguugaauaucauuucuccacagaaaaauguagugauuuccuuaucacugaggaaaucuggugucaauaugauuauuguaccuuuguauguaaucuacuuuuuuuucuuucuggaaauuuuuaagaucuuucuuugucuuuaguagucugaaauuuuacaaugguguagggguuuuuuuuaaucauccugucccacauuuaguggacuccuccauuuuagaggcuagugucucccuucagcccugggaaauucuuuucugauccccacuaugguuucuccauugucuccuucuagaccuccucuuguuuagcuauuuaauauccugaacgagcuuucuaucuauuucucguuacaucuucaguauauuucacgucuuugucuuucuuggggguaucagggacaggggcaggggcagggugucacgguugcccaggcuguagaguacaguggugcuaucucagcugacuguagccucgaccucccaggcucaaaugauccucccaccucagcaucuggaguagcugagacuacaggcgcgcgccaccaugccuggcuaauuuuuuaauuuuuuuguagaaacagcaucuccguuuguugcccaggcuggugaaacuccugggcucaaaugacucucccuccuaggccuccgaaagugcugggauuacaggcaugagccaucauacccggccccuccuugucuuuccauucuacauuuuaggagauuuccuuaaauuuuuuuccgacucacauaugaaauuuucauuuuggcagugauguuuuuaauuuccaagagcuaguucucugauuccuuuucgaggaagguuguuguuuuauggguacaauagugucuuaaaaucucuuaaugauauuaaucagaauuuaaguucucgucucucugcuauguugucuucacuuaaucuggauuuaguuuuuuucuuuguuuaugcagaccuuucacauucauaucagauuuuauuuuuuuuuggcagggggcgggggggcggggguggacagagucucacuuugucgcccagacuggagugcagugacacaauaucaguucacugcuacauccaccucccagguucaaacaguucuccugccucagccuucugaguagcugagauuacaggcacgcgccacuaccaccuggcugauuuuuguauuuuuaguagagauagaguuucaccaugugggccaggcuggucuugaacuccugaccucaaaugauccaccugccuucauaucagauuuucuucaacuaugaggugauccuuaaaccuacagcuaccuucccuuuaggauggagagaaguugacuguucgauauacagauagcuacuuaagccucuguguucuggcccuuuccuaacuccugccuucuguuguuaccugcauuuuccaaagucaagguuucugcagggcagaugaguugccauuuugucuacagcacccuccuuguccaugagacuucagcuuucuccacuccuucauucagcugucauuucaucugcuucuagccuuccagaaacuuguugacuucuguugugaguuaauugccuucuuuuucuuaauuguugguggauuguaccuuuuucauucauaccucauuuuuaugggguuucaggagacagaagauuuuuucauuuaguggaggcuaauuagagcaaaagugucucugcuguuuaaugaucuacuaacauuguuucauaaugagucuaaucacauuguuucauaauggacaaauauuggguguuauuuuguaaacucaagguuaaacuugcagacaaaacucacagcuagagaagaguuucgacuuuagcugaauuuuuacagcgauuuuuagaaauucacuuugaccccuuuuuucccuguaguucaucuuucucagauuccuaucuaaaaaucucaaaccacaaaugaaaagugaacuaaacacauaaaaauucagccacuuagaagaaaaaauugcuaagaaauagagaaccacuuuccuaguauauucauagcauuuuuaguuuguuuauaacagccauaccuagacaagucaaccaacuagguaugucauuucuaaguaauauagucauuauaacucuaaaauuuuguuuaaaguggaaagaaaugccucauaaauaaguuguaaguaauuguaaauggauuugcaauauuuuacuuuagagcuucagacuaaucauaagagauacuuugccuuuauucucagagguaagccacaucuucagccauugcaaaaccccuuugugaauuucuaaggaugcaauacuuauucagaaauauucugaagaauuuacucuuuaaccucaaaacaccucacaaccauauguguagcaacuguggcucuuucaagucuccuaaaucaucauugaaucagauuucugccugcuguuaaagucugucuccuacuaauauuggccuucuguguaucucucaaacucuaugauuuacuugcuuguuuugauagaaacauuaggaauaugggauuggggauugcugguggagcugugacugggagaaugcucaaccuuauccuggaauguauacuuuaugauguauuuguuggaaaauaaauuagauuauuuuuaugauuuuccaugcagaguugcauacuagcauuuuuuccuuuuaucauuaaguaaagaacaucuuuaucucauauguuuugcccuaaagucagauuuuuuucugaaauaauuauaugaaauuuuucuagcugcccucaagauuuucuuucuuugguuuucagcacuuugacugugaugugucuagguguuuuguuuuagcauuauuuggugaucuaugggcuucuuagaucugugauuuguuguauuucauuaauguuggaaaauuuuuggucuuuaucaccucagauauuucuccugccuuuuucucuccucuuuugccaguuacacauagacugauacuguucugcaacucuuaaguuuuuuuuguucuuuuuuucacuuguuucuugguguguucaguuuggguaauuucuguugucaaguucacugauucuucuguguccaguguguuaagucuguccaaggaauucuuuaucucugauaagaauuuuuuauuucuagccauauuuuuuauuucuagcauuugacccuuucaugauuuccaccucucuccucaaauugugaaucuuuuuuuugcaugcuguccaccuuuuaaacuagauccuuuaacauauuaaucauaguuacaucuuuaaguuuucugucagguaauuccagcugcaucaucuuugaguauaguucuguugaucacuuuaucucuugaugaugaauuacauuuuucuccugcuuguaugucucauaauuuuuuauugaaugccacacacuauguguaaaggaacagaggagacuaaaguaaaugguauuugcacccagaaaugaggacaucucuuuuucuuucagguuauuauuaugaggcauugcaucaauuuagucaggaguggagcuggguuuggguuuuguuguugccuucagugcaccacagucuucagauacuuccagcaauugacugcuauuacuuuaugcuucuuagaguagugccugaagugcaagauauuuauuuugaguccuuuuauuuugaaccugucugugcuaugauagauccccauuuuauucagaguccuuaauauggucagcaaggcucuacgugaucugguagagggccagauaguaaucauuuaggauuuuguaggccacauaaucucugucacaacuauuuaauucugcuguuguaaaauggaaacagccauagacaacaaguaaacaaaugagcaaggcuguauccaauaaaacuuuaaugacgaaacaggcagugggcuagauuuggcccaugggccauaguuugccuaccuguuuacccuuuguuuagagucuuucucuugcccuacucccuggccccaaucucugcuaccgugguaacgugagcuccgcaagggcaaggauuuuuuccuauuuuguucauggacuuccaaaaugccuacaacaacaucugacacauagacccucaacuuauuaaaauaauagauaaguuaauuauguuuugaguguuuuuuauaagcagcauauagcugagguuuuacaauucagucuacugaucucaucucaacagauauguuuaauuagguugcauucauugugauuucuaguauauuuggaauuaucccugucugguuuuuguuuuguauuucuuuccuuuauccccuccuuuccugcuaucuagguuuaauuaaauuucccucauuucuccuuagguucugucuuugaauuuagaaacugcacauucuguuuuaacuuccuuuagcacagaucccuaaauacugaacauguauauuuggcuuagcaacauuuaacuguauucuucuuaaauaccuucaagaccuuagaauacuucaccucugauuuuugcacuuccaguguauuguuauucuuuuccaauguuuuauuuucacuuuguuuuagacaaugucugcugcuccccugcccugccauagucuuuuccuuuguuuuauugucagagcuuuuuuuuuuuagauuuacucaucuuauuccauucuuuuguguuuaauuuccuucuuaucagaacauauauugaguaguuauuucagcagcuaucugugauuguugaauuuccccagacuuuguuggaaauaccuuuauucauuuguauucuuguauaauuuaauuaggugaacaaauuauuuuaucuucuaaaauuuguuacuuccuuuuuucccuucaauuuugaaacauuuucagccaauaucucuucacaucuugccucuugucuauucucucuguugucuccuucuggaauucuuuucucucucugucucccccuacccgcccccgaguuggagucucacucugucauccaggcuggagugcaguggugugaucucggcuuacugcaaccucugccucccggguucaagcaauucuccugccucagccucccaaguagcugggauuacaggcauccaccaccacgcccggcaacuuuuuguauuuuuaguagaaacgagguuucaccauguuggccagucuggucucgaacuccugaccucagaugauccacccuucucggccuccccaaagugcuggaguuacaggugugagccaccaugcccagccuggaauuuuuuucuuagaugucugugagaccuuucagaacucuucuuucauuuuuucugucacauuaucugugcauucuggguaacauucuuacaucuaucugacaggucaccaacugucuuuguauguaaucuacuguaaucuguuuggcuuuuucauuucagugacuuuuauuucuagagguuguuuaaaguucuuuuccaaaucugcuuuauuuuucucaagauagaaucaucccauguuguuucuuuauaaaaaguagauucaaguaucuucacuuccaguccaguauccuaaaggaugagauucauguccagggacagaucacaaaaacauauaccaguauuuguaguuuauuaugguuucccaaguaguucaugcugcaggauugauugcuuauuuuguuucuuuaaagaucuuggaagauauuuucacaaaauauaaucugaauauacaaaaauauaaguggcaauugggauaauuuaauguuaacauuuauguggagugaaaucaaucugccuguuuuauuuguugcauacaucaaaauggauucuacauucccuucuaaaauaucuauaacauuuucauauuagaaugcuucauucauagaccaaacaugacaaacucugaaguaagagagcuuguccuuuccgaggguagaugugaauuagauacaguaguaaguagguuaacugaaaagacgaaaaccuuuagagaagcuguagccuaaaaaugcugucuucauucauaaagugaauuucuccaaauccuagaaaacauuuaaaaaguggcauuuguuuaaaugacuaaaacaauuuuucaguuaaaauguuuggaauuuggccaggcacaguggcacaagccucuaaucccagcacuuugguaggccaaggcaggcggaucaccugggguccagaguucgagaccagccugaccaacauggugaaaccucaucucuacuaaaaauacaaaauuaguggggugugguggcaguugcccauaaucccagcuacuugggaggcugaggcaggagaaucacuugaacccaggaggcagagguugcacugagccgagaucgcaccauugcacuccagccugagcaacaagaguaaaacucugugucaaaaaaaaaaaaaaauugaaauuuuaaaugccuaaacuuacaauauuuuguuuuaauguagcuuugggauuucugacaaauucuuguuugcuuuuccaagucugcuuaaagguuaauugauuaaaguggguggguccucauguuuacuaauguguguugcagcucuuuugguacaccagaaggccagaauggaacgacuucaaagagaacuugagauucaaaagaaaaagcuggauaaauuaaaaucugagguuaaugaaauggaaaauaaucuaacucgaaggcgccugaaaagaucaaauucuauaucccagauaccuuccguaagucuuuauguaacuguugugaucucugcuugaacaugagaguaggccaucuaacauaaguguaauaucucuaucuaguuuucuucagauguucuuaacucuuguuuuucuguccuuacuuucuugugccaaacuccauucuuuauuaacuaaugacuaagaauucagugcaaaucuuacuuacauagaauuauuuuucagcuugaagaaaugcagcagcugagaaguuguaauagacaacuccagauugacauugacugcuuaaccaaagaaauugaucuuuuucaagcccgagguaaaguucaguguauuuguagcugaaauucaucguauuuaauucaccagcaguuuuucuguggcuaaaaacagacuuaucaaucauaaucuuacugucucagaacauguggcuuuggagccagacagacuuuuaagaauauauuuaaaaagucacccccaucucaauggcacuaucuuaacugauaaaauauagaagauaguaaaaauaagguuuauacauucuuuagacaaugauaguuucuuauacuugagcuauuaaugacaagcaauguuuucuuauaguaaauaauguuuacaauuuaauucaguuccauagagaacuaaaaggaaauguuaucacuuaaaccuaauucugaaguuggauaaauaauaaaaagauauaaaauggaaaagacaggaaggggaaggaaucuaaccaaaagagaagucuuuaaucacacuugggacuguguucuagaaucuguucaacuggaagaugauuauuuuuauuuuuauucuuuuuaaauguugauuaagcuauuuaucuuuaaacauucauagaaaaauaccauaauuuaacucuaaaaaguuggugcuguucuagaaacuacaauccuugaacuuacucuuuuuguguaaaauuuuaaccauucuauuacauagugcaagguuuuuauauuuacuugagguaaagcuguuuaguuacuuaaguccauguuugaucguuuaaaauuacauuuuaaauugugaaauuuuaaguuauuuuaacuugccacauagaacagggaucuacuucuacuucuauuaaugucuuaccagcauuaauuugacuucuuucacaguuuaccacuuacccguguuuaugaguacuacauuauaccuaagauaauauauuugaaauauguuuugaaaucuuacauauaauucgagguuagaggggcaaaauaaaugaaaagcauuucuuauagcguguuuauuuuuagaaagaaauacuuguuuuaaaaaguaaaguuguuuuugagcuauaagcauugauauauuuacuuuuuauauauuucaggaccacauuuuaaccccagcgcuauucauaacuuuuaugacaauauuggauuuguagguccugugccaccaaaacccaaagguuaguguauccauuaaaugugaaaacuguuacuuuugaaaagcaaaauuuuagaaaauuuuuccuguucagcaaccuuccucucuagaauugcuucaaacuuuggcauucuuaaaugaauucauuaagaagauguuugcuuauuuucauuuacaugcuugggguugggaaggaugcaaagauguaauauucuuagcuuuuuaaaaguaauaugcacgagcuuaggaaacacuauguacucccaaccaauaauagcaagucuugguuaaaaaacaauuacuaaguacaaaaauuuguaucauuuaaaacuuuagacaaaugauaaggaagauaccuuagggaaguuccccccccccaugaguauuuaguuuaauuuauauauaacuuuaaguaaucaaaauacccuaaauuccaggugaauaguuuucuaccuucuaucauuuuacaucauugauauucucagaauauaugcacaccaaacuaagacauuucaaaguaugucuguguguuuugauccaggcauuaaaauguguguagaaauggaaacagguacauaaauaucacugcugaagguaaaaauauagacauauuuacagauuaacacuuaaccgugguauauaauuuacuuucaacucuaauaagaaaguuaaaagguaaaaauguguuaauggauacauaauauuaaaagaagaaaacugcaagaacacaaaagugugggaggguggagguuguaaagaugcaguaguauuuuuguaugcauuugaaguuaaguuguuaucaacuuaaaauagaagaguauaaccaaauauaaucaaaguaaaucacgauuaaacguugucgaauaacaagacaauaagaggaaaagaggagcaaaacaguugucaaauagacaggaagcaacaaacugccaauaguaaguccucacuuauuaguaauuaccuuaacuggaaauggauuaaacucaccacucacaaggaguuguaugaauggauuuuaaaaacaggaucuggcagcagccaaugggaggccccaacagcucgugcuggcgcacacagcgggaggggagggagcccaggaugugcacgcacccucucccucauccaccgcugucaccuccugcugcucuuccugcugcucguguacucguuaggugcggacccgccaccucuuuugugaagcagcagcugaggagacuccgguguucaccauggccaacgaaaagcccacagaagaagucaagacugagaacaacaaucauauuaauuugaagguggcgggacaggaugguucuguggugcaguuuaagauuaagaggcagacaccacuuaguaaacuaaugaaagccuauugugaaccacggggauugucagugaagcagaucagauuccgauuuggugggcaaccaaucaguggaacagacaaaccugcacaguuggaaauggaagaugaagauacaauugauguguuucaacagccuacgggaggugucuacugaaaagggaaccugcuucuuuacuccagaacgcuguucuuuaaagaccaagauuacugcauucucaauuagaaaacugcaauuugguuccaccacauucugacuacuacaguauaguuuucucuauucuuuuguuucccccuuccacauucuuuuauuauacaugaaguaacugguauguguacacaagcauauugcuuuuuucuucaaaccaaacagccaaugguauguuuugauugacaucaaguggagacaggaugggaaaaaauacugauucugugaaaauacccccuuuauccauuaguggcauguucauucaggucuuaucuuuauauucuaguaaguuauuuugcucucacuguuuuaacaacaacaaaaaaaaauucucacauaccuuguucaauuggaggauuuucauguuuuucauuuaucauuguaaaaccaaggacaauuuuauaacuuuuguguacauagcuguuacauguagggcaaucugucuuuaaguagggauaaauuacucuaaaaaaaaaagaaagaauccuagaaaguuuuuccuucaagucaggcuucuuauuuaaauaaacuuuuuguuuaaaaugaaauaaaaauaaaaacaggauccaauaauauacuaucuacaagagacucauuuuauauuuaaagacacacauaggcagaaagugaagggauggaaaaagauuuuauauaaaugguagcuaaaagaaaucaaaaguggcuauaauuauaucagaaacaauagauuuuuaagucuaaaacuugagacaaagauuauuauguaaugguaaaaggaucaauuccacagaaaaauauaaaaauuauaaauauauacacaccccacaucagacuacauuaauauguaaagcaaauaaugacaguucugacgacagaaauugacagcaauaguaggagacuucaauaccccccuuacaauaauagaauauccaggcagaaaaugaauaaagaaacagcugauuugaacaagcacacacggaacauucuguaggauagaucauauguuaguucacaaaacgaguuuaaacaaaccuaagaagauagaaaucauuccacguauuuuuucuaaccacaguggaauaaaacuagaaaucaguaacagcaagaaaaccauaaaauuuguggaaauuuaaacacagucuugaauaaucauugagucaagaaggaaaucaaaagggaaucuuaacaguaucuucagacaaaaaggaaaacauagcauacuagaaccuaugggaugaagcaaaggcaguacuaagagagaaguuucuagagauaaacaauacuacauuaaaaaaaaaaaaagaaagaucucaauuauaccucagggaaccaguagaagaacaacaagcuaagccuaauguuagcauaaugaagaaaauaauaagaauuagagcaaaaauagagaauuuagaaacaacagaaaaagaaauaguaaaacuaagagguuuuuuaaaaaaucaacaagauugacaaacccuuagcuagauaaauugagaaaaaaaggagacaaaaucagaaaugaaaaugaagacaacagaugccucagaaauaaaaggaucauaagggaauauuaggaacaauuuuaugccaacagacuagauaaccuagaaaaaaauugauacauuccuauccaaaaaauauccaaaaaaaauugauaucaccuauuaaagcugaaucaagaagaauuagaaagacugaguagaccaauaacaaauaaggagauugaaucaguaaucaaaaaucucccaacaaauauccagcauggauuuagaaauuuaaaaaaaaauucccaacaaagaaaaguccagaacuggauggcuucaugagugaauucugucaaacacucaaacaagaauuaauaccaacccaucuuaagcucuuccaaaaaugagaagggggaacacuuccaaacucauucugaggccagccucacccugguaccaaaaccagacaaagacacuacaacuaaagaaaacuacagaccaauauuacugaugaacauagacgcaaaaaguccucaguaaaauacuggcaaaccaaacugagcacauuaaaaggaccauacgccaugaccaagugggguuuaucucugggacuuaaggaugguucaacauacacaaaucaguuaaugugauacagcacacacauugaaguaaaaugaaaggaauaaccauguagucaucuuaauagaugcuaaaaagcauuugaaaaaguucagcauuuauucauaauuaaaacucucaggccgggcacacuggcucacaccuguaauccuagcacuuugggagaccgaggcgggugggucaccuaaggucgggaguuugagaccagccugaccaacauggagaaacccugucuguacuaaaaauacaaaauuagccuggcuuggcggcccaugccuguaaucccagguacucaggaggcugaggcaggagaaucgcuugaaucugggaggcagagguugcgguaagccaagaucacgccauugcacuccagccugggcaacgggagcgaaacucuugucuaaaaaaaaaaaaaauauauauauauauauauauauauauauauauauauacacacacacacauauauauauauauauauacacacacauauauauacauauauauacacacacacacacacacacacacacacacacacauacacauacacauauagaaggaacuuaauaaaggccauauauaaaaaccccauagguaauauaaucaauggagaaaaccgaaagcuuucccacuaagaucuggcacaagcaagggugccauucuugccacuuauuuucaacguaguacaggaaguucuaauguaguauccauuuuuguguugcuguaaaggaauaccugaggcuugguaauuuauaaagaaaaaagguuuaauuggcucacaguucugcagaaagcaugucaccgauacccacaugcuuucuguauaggaagcgugucacugacaucugcuuaguuucuggagaggcuucagggaacuuuuauucauggcagaaagugaaggaagcaagcagaggcaugucauauggugagcgagacagugggaggugccacaccuuuuaaacagccagaucuuucaugaacucagagcaauaucucacucauuauugagaaaccugcaccaagguauucaugaaggauccauccccaggacccagacaccucccaccaagccccacuucuaacacuggggauuacauuucaauauaagguuuggggaggacaaacauccaaacuauaucaccuagccagagcaauuagacaagaaaaauaaagguauccaaaucagaaaggaggaaguaaaauuaucuguuugcaggcgacaugaucauauauguugaaaacccugaagacuccaccaaaaacuguuaaaaguaauaaaugaauuuaguaaaauugcaagacacaaaaacaauguacagaagucaauuguguuucuguacacaaggaacuaucaaaaaaggagaucaagaaaacaaucccauucacaauagcaagaagaagagugcuuaggaauacgcugaaaauuauaaaacauugaugaaggaaauuaaagaagacacagauaaauagaaacguagccuguguuuauggauuggaagaauuaauauuauuaaaacauccuuacuacccaaauuagucuacagauucaauguaaucccugucaaaauaccagugacauccuuuacagaaacagaaaaaaaucuaaaauuauauggaaccagaaaagacccugaauagccaaagcaaucuugaguaagcaaaacagagcuggagacaucacauucccugauuuuuaaaaauauuacaaaguuauaguaaaacaguaugguacugacauaaaaacagacauauugaccaauggaacagaauagagagcccagaaauaaauccaugugucuguggucaacuuaucuuugacaagcgugccaagaacacaauggggaaaggguagucucuucaguaaauggauauucacaugcagaugaaugaaauugaaccauuacuucacacuguauacaaaaauaaacucaaaauggauuaaaaauguaaacauaagaccugaaaccauaaaacuccuagaagaaaacauaggugaaaagcuucuugaccuggucugggcaaugauaguuuggauaugacaccaaaagcacagguaacaaaagcaaaaaugggcaagugggauuacauuaaacuaaaaugcaucuacacggcaaaggaaaucaucagcagugaaaaggcauccuucagaaagggagaaaauauucacaaacuauuuaacuccuaaaggguuuauauucaaaauguauaaggaacucaugcaaaucaauaguaauagaaaccaauaaccagauuuuaaaaugggcaaagaaccagaauagacauuucucaaaagaaaguauacagauagccaacagguauauugaaagguacucacccucacuaaucaucaggaaaaugcaaauuaaaacccagugagauaccaccuuacaaacuuauuggaaugguuacugugagaaaggugaaagauuauaugcauugaugaggacaaagagaaaagagaacgcuuguacacuuucaugggaauguaagcuggugcagcuauuaugaaaaacagcaugcagguucaaaaacuuuaaaauuguaugaucucgcaaucgcacuacugagcauauauccaaaggaaaugcaguaaguaucucaaagagauaucugcacucauuuuccuuucaguauuauucacaauagccaaaauaugaaaacaacauaaauuucuguauauggauaaagaaaacgugagagauacacacacacaguggaauauuacucagccuuaagaaagaaggaaauccugucauuugugauaacaugggugaaccuggaggaugucuugcuaagugacauaagccggagaaagacaaauacugcauuaucucaccuauauguagaauucaaaaauaucaaacuccuggaaacagagagcagaacggugguuaccaggggcugggagaagaggguaugggaagauuguggucgaagggguacagaguuucaacuauauaagauaaauaaacucuggagaucuaguguacaacagugugacuguaguuaacaguaguuuauuauauaacugaaauuugcuaaaggagaucuuaaguguucucaccacggugggggguggggagauaagcuaugugagguguugaauauguuaauuaacuugauuguaauaaguuuuucacaguauauacauaaaucaucaaguuguacagcuuauaauuuuuaacugucagcuauacauccauaaaguugugggggaaacaaaacaaagacagcaaaacaaguuuucauucacacaaauucuggaagucagcaaacacguggugaaucaggucagcacucauaguguuacaucauccucacuaguaugcugcaauaaauacuccagacuuacaauuuguuccccauauguuuguauuuucaaaugucuucagagauaaaaauuauuuguguuacuucuuccuucauaagaaacauuaagguuuguaggacuaggaaaguaugaauuauggauaggaaaauguacauuuuuccugugaagcugaacaggacacccuaaaaaaauguaugguuacugucauugagaaauucagugccuuacguaggggaggaaaaggagagguugagaaaaacaaaauuaggacauuuuaugaaucaggcaguuguucacaugucuacauacugguaggaauaccauguuaaacuggguuuuagacaaguggcuggcaaacagugacccauggaccaaauccagccugccgucuguuuuugucaauaaaguuuuauugcaggaaaagaaaaagaaaugggaacaaggaagaacuaguauauuacuggucuuuaguuuguuacaagaauuuucacauucuccuuucacauucuaauuuuuguacucuacuucauuuuuguuuguuuguuuguuuguuuauuuuuuauuuuuuugagacagaguuucgcuguuguugcccaggcuggagugcaauggcgcaaucucggcucaccacaaccucugccucccagguucaagccauucuccugccucagcuucccaaguagauggauuacaggcaugcgccaccacgcccagcuaauuuuguauuuuuaguacagacgggguuucuccacguuggucaagcuggucuugaacuccugaccuaaagugauccacccgucucggccucccaaagugcugggauuacaggcgugagccacagcgcccagccuccuucauuuuuauguauaauuagguguagcucuguccucauauuuuauuuaaauguuuuuaaauauagcuggaauacaaugaaaaguuauuacagaggaugagagugagauuagggcauuugacacaguaagcaaauguucagagacuagaugcuauuuggauguuaauugaauaaagcaguagagaugacagcgguauaagcacuaacucuaaaauaugcaagauguguuuuucagacacugaaugauuuuccuuaguauaaucuuccuacccuuuuugaaaaauaagaauuuuuucuuaugaaaaguuuccucuuuugcuucaacauaaucuguuacuucagaauaauaauaaucuguuauuucacauaagugaaauaaaauuggucuugacaguuguugaagugggaugaguauaugaagguucauuuugcuguccucucuacuuuuauauauguuugaaauuuucuguaauaagaaagguccaauaaaaacauccauuacuuaaaaguuuuuacaugaaagauagaaguuuguaugcuggcuguuuugggagaaauaaggaaucaauaauuuuuugcaauaaagcuaaaauacacauuaacuucaugaauagaaauuuaguccuugaagucaguucugcuucauaauguagagauuuuuuuaacagcuaaaauuaaauguguuuagaccauuguuugugaucuaauuuccucuuuuuuccaauuuugguuauuuaguuuccgaacaccucuaauuaaaaaaaaaaaaaaucauaauucuaaguuuaccaagugagauuauaagaaaaccacuggagauuuuucauuuaagaaaaauuuuauagaucccuuauugauugccuuagauauuacuuaaauaaucaaaaauuugcuggcauuuaauaauacauugaaguguaaaaagggacuuccuuauggucacucuuccuaaaauuuuaaccuuugcaguuaaacagaaucaacaagguuuuacuaaaaacgugucaggugaaaauguuuucuaaugccugagaccaaaauuuuaguaaguaggauggauccccagauuaaaacaauuauucuauaaaauguuucccagauguggaaugugagaugauuuuacgugguaaaaagucaaaaguuuuuuaaacuguauuucuuuucaguuguuucagggcauaguaacugguauugucagacccuugauuuuuuuagauauuuuuacuuaggauaagacuuaauucgauguuuguuuuaaaauuauucaguuuggggaaaauacuguauaaacaccauucaaguugguugugcauguggcaaaaauugugacaauggaaagccaacaccuaaaguugaggacuuagcaagaaaauuucuguacaaugaguaagaaaggugcugcuaaagggguacaaaguaccaaauaucacuuaauuauuuaaaauuugucauaaaauuugacuucuguauuuuuauuuacuuguuacaauagucucucuuuuaaaauagaaaaguuaucaguaggguagguggaauuugcauauuaauauacauuguuuuaacauagguuugauucuucaaauuaauaaccuugacaggaaaaauucaacaaugcaugcuccuuuuacuuuaaaccucccaaaauuaauuuguaggaauacuguucuaauuucauuaugggacccaaauuuuuuuaaguaguuuuauaaauguaaucgcuuguuagagauaaccuuugaggaauauaauuauucucuguauuuaagauaccacuauccauauaaacauucuagaacauuggucucuuagaguuccagugaccuuuauuuuauaaguaagaaacaaagagaccuagaauguauaugauuuaucugagaucacagagcaaaguauucaggaauuaguagcagagccuggaacagaacuccauucucacaacucucaauucuaguguucuuucuacuuuaccauaccaaaugugguuuuuaaaaauaaaguaugguaaaauuuuuacauagauuuacuucuccagagucuguggauaagacguuagauacuaguuuauauuuuauuugugucauccaaggcuuacauuuuuggcagauggagaacaugaauugacaaaaaaaacugcccuuucugguagaaaacgaauauaaauacuacugcagugggaaacgaaacucuaaugagacuuauguacacugacaguauuguuuugcaguaggacagcuuuuuacaaucuugagugguauuaugggaaucuuugcuauuagauacccuuuauucuacuauaaauuguagguaaugaugcuguuuucuccuuuaaggagauuggaggugauuacaucauguucauguuguauuucccagagggagaagugccaacuagauagagguugguagugaucgagcaugugugucagugucagcuagaugccccauuuggggagcaagcugcaucaggcugugcacuacaaaugguguuuaaaguugccuguaauuuuuuagacuuugugauuuuuuacuuauaaaauaauuuuuuucuuucuuacagaucaaagguccaucaucaaaacaccaaagacucaagacacagaagaugaugagggagcucaguggaauuguaccgccuguacuuuuuugaaccauccagccuuaauucgcugugaacagugugagaugccaaggcauuucugagccaaauggcccuguaucuucucuaaaaccacaucuaaaguucaagaaacuagucugucaucgggaaaaaguuucacugcuacauaggauuuugucaaauugaaggugugacaagaugguguucugcuaauguuaaaugucagcccacagagcuaauaauaccucaguauaaugucaugagcaguugaaauucaucacaugaaaaguaaucugcugaaagacuugguugcccacugccuaacuguguacaguguuaccagugucccauuauggauaauucucaauauguuaacaccuagguguucccaauaccuuuuuccccucaugucacuacugaauuuugacaggaggaaggaauagaaugauagcuuguuuuauuuguaaagcuuucagugaaacacuacauacacgaagaaaaggaacaagguuuaacuauuuaagaaccauuugcugccgcauagugccauuggauagggaagaacuucagaaaucugugguacucuuggccuugucuuugucuucccugaacgugucuccacucugugaagccagcaucuaggggcuaaagaugcaaaggaaagcagcaugcauugucuguacaaaugugcagcgaaauaccccaaagcuuuuccuacuguacagaucucucgagucugcuuuaagugauuucuuuucuucuugauuauuuucuuauauuucuauauguauaguguaauagccuuuuguuaacuaauuuucuuuuuuccuuuuaguaauuaagcacgaucaugucccuuuuuaagccuuaccugagaggaacaaugccuuaaaauaaaaaagcauuaaugagaugaaaguaugcacagaauaacuuuccucuacuuauucuguacuuugcccucaugaguuccaauguugugugaagacaggcagaugcugcacagugaauugcagaugauauuacagaagugaugucuguaggucacauuaaauacugacuugagcagugggugacacaacacaguguuugucuuccacagggaagcuuaaaacaaaagauauuuuuaacccacugacagaacaacaagguuaagcuucaucugcuuggugucccacagaacuugcacaagcaguuguuauugggaaaguacagucucaaaaccagcaacagcagcaguaccuacagcccuuuuuuuggagagaaguuuaaaugcuuuacuguuggggcaguccauuucuaauccugacuuggugacaguaucauguguauuuauaaaacaaggcuagccauauuuaggacaacugaagaaaagcuggaaaaaaaaacaagcaaacuugaacacugaagcaaccucaagcaucucuuuauuuugaugauauauuuuuguaaggaaaauauucagaugaucaggaauguauauaacugaaaucaagaaaaagaacaguaugcauuuaaaaagacagaauuaugaaauuauaugagugcuuagaauggggcuaagggaagugcugaaauagagcaaaggauggaagauaauauagacuaccacccacuguaaauguuugcaaguggcuguguuuuaaaugggauuauuacaguugaucucuaugaaugucagagcccuaacuuucaggcuuugcauuuuguauaugggaagaaauaugacaauccuagguaauuaaaccauagacccaaagcccuuacguuugaugcaauuuauuuuuaaaauaggccuuguuuuucagcuucaucugcaguucuaugugaagauugauaaaucaguuuuuacuuguuuuauuaauaaaacguaauuuggauaucuugaguugaugguuuugugauuuagcuggguaaacuaucuuuguaacagauaaguuauuuauaaaaauuaaaaaacuuauauucuaauguggau

SEQ ID NO: 16198 - RNA, 2228 nt, Homo sapiens
caggugaugaaacugaggaucagagagguugaaugacuuggccaagaucauguaaacagucaauuggagagcuggcauuugaccuaguauaacuuacuuugaagcccaagaguuuaaucacugugcuaaaaacuguacacgguuuaucauucccaaagaagaacuuucacuccaucuccucccacucaaaaaauauaagaucucaaagcaaaucuagagacuuuucugauaaucugcacaucuggccauuccaagucuuuaaacuaaaguugucuuuuauguauggauuaagaugucugacuguaauaaaccucgcccaucugauuccagucuaccugccuaacuacagcuccaccaaagcaaaucuauuacuuccccaagguauucaacccugagcagguuaaaacuucacccuccauacagaagaacugcuucccagagacuaugccaaauccaggggcgcuuuuagucacuggacauuucaaaauacaugacagcacagauuuagcaaaauaaguccuauuguuuuagccccaaacauauaaaacaaauauccuguaacuccacaaauugaaaaacugcaaaaaaaaguaggcaaacauuuuggcaguucugaguaaggaaauguuuguuuucccucuuguggucacacaacaaauggugaagagauaaacaucaguaacaucagccuuuucccuaauccagcaccaaccaaauauuuauuuacaucuacuuuuugaaggccucuuucucgccuuuuccacaccaacaugucagcaggugucccagauuaaacuguugaauaucauacccgauuguuuaaaaaacaccuuuugacgggaccuguggcugguuauuuuuuaauuaggguuugaaauccuauacuguguguauuuagcccccuaagaacuagagccagagaaggacgccucugcggaguggguugcccagugggugggcgagaagggagcccccgguuucagaggggcugcugcgaacuguacuuccugcgccgcccccuccccagguaacuuaccaggauacccaucacgucgguccagagucgggagaacgccucggaugugccagcacccggcuugggcuccgguuccggcuccggcgcgggcucgggcuccggcucgggcucgggcucaggcuccggccccgggccagcugcucccgcguccuccauggccgugucccgcgcgcgggccgugcgucccaguccccgcggcgcccucgccccgcacccgcgcgcagccugcccggaugccggguccccgcccgcggcgucaccgagccgcgcccccgcgcugcaugccccggcggccccggccaccccgcgggggcccuucgcaggcgcccgcaccucgggucuagguggccacgggcugcgcgacugacaacuccagaaacuuucccaccccgcucggcgcagcaacaggguagcaggaggcaaaguccgcaccacugaguuguacggcggggaauucgcucggcccagaagcaauuaaacccacugcaaaggcguuucuuccugugacgggaaccaacuaacuaaggcacgcgacucguuccuucuagcaagucuuggcaggacccggcagggguggccgcggagccucuagaucuuggagggagcuccccgggaccccucucuucaaaaugagcucuuccagcuccacaugacucucucccucgaggcuaaagaaagcguuuagcaacaaaaggugcucugaugucaggcucuuugcauggaaaugagccucggacaggagaacaaaucgccuguugaaagagcagccgcgccgcggucuccggcccgcacaaguuuccaaucacgcuauucacggaaacgcuuuugguaacggaaacccgagaaaguuaaucuuuaagcgacucccgcccaaaggcuucacaaguaguccgugucgcuacaaugcauaccucgccccucgugaagucaagcgacccaaggaauuacaaauccugccucugccagccaagacuucucugcaaaacaagugugaaagcuugggcacgagccauuguuuggaucauuuuuuaugagugggggcauuuuggcuccugaaugcccacaaugccaugcauugcuagggcuuucggcuaauuaagggaaaugcgcuuuggguuuuaauuauuccuuuacauuagggacacagggaagggcuauuuucgaaacuaaauucaaaugauuguguagccag

SEQ ID NO: 16199 - RNA, 2312 nt, Homo sapiens
ugccuuuaacauuacagauuuuaaaaaaaguuaaaaaaacaaaaaacccucauuuuuuucaagcaauaucccauauacuuacaguccaacugauauuuauugacuaucucugacaugaauagcucuaauaaguuauuuuccuauucgaugacacaaagggaugaaacaaccaaaacagcugucagauuaagaaugcuguugucaccaucaauuaaaucccuuugcuagauagcucugaccacgcaccuguuuccuuuccuuuuccuuuuuuuuuuuuaaauggagagcuacucucccccccuuccccuucuccuuguauugaaagaaaggcaggaggggaaagggacgauaauuuagcugaaggucaacuagggcaccugcuaauggcucccucuccucccaucacugauugccugaaaauaggaaaucagcccaaaucuauuguugugaucagggagcaaaagcuguaaugcuggugagugagcacgugcuucuuccugccucuuuuuccuucgaagaaaaaugauuacuacauuuaacugacacacuguagagcaaaucccuucuuuagagcucaucagucugaagggugauggggaugcggcccagaagaacuggucuccccugaugaaaacaccugcugccagagccgcccaccgccucuuuccucucgcuucccucacguuuccaugguucaaggugauccuuaaaaccauggaugaagugugaggcuugcaaugugucagcaccuaaaaguggguacgcuaggguauccuggauuuuccuguguuugggagaauaaucagcgaugacucaguucuaagagcaggccagacccaugauggggagagaaaaagcaacugugagaagcugauggugucccagccugcauccagucugacccuugucuguccuuccagacaggauaugagcaaaguuaccuagcagcaccagcgggaacugagccaaugaaaacccccugcccugcugcauucuaauuucacaggugcccccgccuuccgggcacaacaggaaaugagucaaggcaaugaugauaaugagaggaagaaaaaaagugcuuccucuguacaaaaugcuuacacacagguaaucucaucuuuuaauugacuucuuccucaaugcaaagcagguuauuguccuuaucuuuaagaaugaagacauagauuuucugagagaggugaaggugauguaugaggucacaugaaggucacagcuaggagcugacucagcucaugacaccucucggaagacggggaaauuuccaacugaacuuuuuguaguuaauacuugaaaacuuuugccucucaugagacuagguuuuuuugaauauuauuuuaaaauguuuuauuuccugacaguauacaaucuuuaugguagguaauauauucuuagagaugccaagaaaaaaaaauuauuaucaccaucuacaaaccacugugaauuuuugugcuuccaugggauacuaagagucaaagacuuuuuauauuuuuaaaucuaucauuuaccuuuuagcaaguaucugguuaguaacuuggcauaauguuuuacucucuucauuuuuuuuuuuuaagagacagucuugcucucucacucugaugggaguucaguggcacuaucauagcucacugcagccucgaacuccugggcucaagcaauuccuccuacuucagccuccugaguggcggggacuacaguagugcgccaccaggcuaauuguuuuauuuuuuggagauacagcaucucucuauguugcccaggcuggucucgaacuccuggccucaagcaauccuccugccucagccuaccaaaguguugggauuacaggugugaaccaccguacccaaucucuuuuucauuuauuaaaugaaauuaaucaaauuuaccugauuugaaaauuugaaaacaauaaacugcuaagcauaccuguauuuuggcuuuaguuuaaaaagugaaagauggcaaauguuucuucaauuaaaaaugcagucacaauauaagcauaaaauaacucauauaacauauuaggacuacccaggaaacaacauaugcaauaaaaaaaauagugacaaauauagaaauacugaauuuguaaggucauucaacuuuuuguacuccagcagcaacagauuaugaacugguuuuauuaagcacuguagccccaauaauuaauuuaaagguugcagcuagcacagugucuggcccaaauaaaguauugaguuaauauauguucccugauuagcuugcuucaacugcuucacaaaguuuacuuacauugaaaaaucauguuguac

SEQ ID NO: 16200 - RNA, 15104 nt, Homo sapiens
uguuguccaauuaauaugaacagggugggagaaggauaaaucuuauucuguauuaaaauuuguacauggccacacagcaaaaucaucacuagagugguuccugcaaaaaugucaggcacaauuacauggaugaaacauaaagggcauuccucucagcaagauucacaauaggaggugugucauaaacagggaaaagaaaacuguucaacaaagcugguuauaucuugccuuuaagcaaggaguucaccauuaaagacauuuucuggauggaaaguccuguggggugugugcguauguguauguguuuuauacagggagagagaauuuacacacugucauacugguaccaagccauauaauagcuccaggaauaauacugagauuucauaauccaugaacuuucuuauuuucagcaaacucccucauagccacucagugucagaaugcggauuguguguuuaucuuuccuaaagaaguaagagguagucgccuugcucuuccccuccaucccccgacaucaccucugcuccacuugcuauccauuuucuuaaauagaagauucagggggaaucccuggaguagguuauaauagguugucagaagaaaugcuucuauuuuaaaagaaaaagcagugagaaaaagaaauuuucguuagcucuaucauauuccuucugagaagcugcugcuuugaaggcaaaucuacuccuccuacugccuucacauguuucuaggagauaguugugugagaaaacccucuguacuaagaauuuuucuauucuggagauauuuuucaugaggaguggucaacccaacccccuguagaguaaaugagacaaggggccuguaccagaacacucuuaugagacguggcauuuaagauccaguaaaauaggagauaauauaggagauacagaagcccuccuggucauacaccauaaaugaugaugagauuuugaauugucuguguucucaccugccuugcagcugcaguauuagaagcccaggauccugagagacuugggguuuucucuauuugaauuauagcauauguucaagcuauaucccuaaacuccugacugagcuacuaaaaauaaugacuccugagacaaacaaugaguaauauacucugaacagugcuauagcagagggaguggaauguuugcagcugagauuugaaacauaagaaucagcgagggagagagauaaaaaaugacugcaagaguugauauaaaaaaccugcuucaguccaauugucucccauuuugucugucaaaaugaaugagcaucagaaacaaagauauugaagagauucucagagaauggcccuuggaaaguuuaaaauuaagaaagcacaaucuaaaaugauucuuaaaauuaaaaaauagcauccaggggaauugcauaagauuauauccugauuaaaccacaauuuauucuuguaaauaggaaaaacagagcaacugggaaagguguaguuccauuaugaacagucugcgaaugucaguaucauaagaagcaaacaaaaaguuuguccugugacuuagcuucacaccuucugagaagcaggaacagccuaaauauaccccagccaggguuaucagcaaagaaccaugaaacaaagcccucagcuuuucaucacauuaaggcaguugagaaacugcaauauuccccuuauguuccuuguggguaauucuaaauuaagcuuuaaauaaagagcaccaaccauuguucaucaggccugaaccaaaucaauaaaauagaugagauuauuuuggcaaguggcaugagauguuggagccuagagcuggaagugccuaggugucaauuucugaauucuuucaagggaacuaauucagaugauauuuaucaagacaauuuuuagaguuaaugcaauucacauaauuuuccaaguuaaaauaaucuucacaaaauuaaaucucacaguucagaaacaugcagaaaagaguagccuuuuacauccaagugaacaacauuugacuuuaaggagcaauugucuuaggauuuuaaaaaugagaaacauaagcucccccaaauguauacaucaauugcaaucugugguuugaaacuuucuaaccaaaaauacacucugaauauuguggcagcuguuccaaaacaucuuucaaguaguuauuauucauuuuauauugucuuaagauauaaauuugauauagaugaacucuccuuaguauuauuauuauuuuguauaggaaagaagagacacauacuuccccaaacacugaagacggauuuuuaaaucauugaucugauagcaaaaaaugaguaagguacucuucucgcaaagcauuaaaucagaauuuccaagcucaucagagagcaguaagucaaugucagaaucugauaaacucacucacuagucaucacaauagucgcauuucaacaguacaauuauaaguacaaacagguucgggaagcacuaugugaagaguuaagcuuuggggacauggccauuuuccaugcaacccaagaugaccuccucauggauucuggugaguagagaggggcuaacucauacagucuugagcacuugucccaagaaaugacaucaaauucuguucaauggugaauccagugaaaauuuugaccauuuaaaaauuaacccaacuuuccuagaaguauggcccaugagauaagaguuauuuucugucaccuaaucuccagaccacacuaagguuuggagucuggcuacaagcacagcuguaucugcuguaggacacuagggcaaaaucaaaaggucauaaguugaucaaaauguauccauauuuuggcaagagaauguggaucuccaggggaggaauagaagccuuggcacacguccuuagcuuguuggggagcugaaucuguggggaaaagaauggguuaaauuuugccuaggcuauaaaguaaaucgcaguaaagucgguaucuaaugcauuaugcauggaaaaaaagaugcauaaaauguacauuccaguaauuaauuucagaagcucuucagaggauguuaacucaauucuauuugacaaauauccuuaagaacuugagcuauguaguguggcaagcugagaaaaagaaacaacaagggcaugcaaagauuaauacuucaaucaauauucaucaagugccauauuagggaaaugcugugggaaauccuguacaugggaccuuaggccucucucaugggccauguaauaaugucucuucuuauaggagcaggagguuaacaggcauugcucaugugccccauccuacagcugaauugccuaccugcaguaagggaaggaaaaggaauguuggcaaagcuuuuuaaagaccuuugcugagaaaucaugcuugccagucaguauuccaugcuucuaggaauauugggaaaaggcugucccuuugcaucccaaauaaggcaauacgaaauuguaacuggaugcuaccauggacacccagauucuauccaggagaacauaaauagaagugaugagaacacccucucccugcuggaaauacauguggggucccccugugggguuugacuguagguucagggcaaaaugacucugucuuuucuaaggcggcuccaccaacccugaggugcagaagcuuaugaguauugaagaaucuuaccugcaauaaaggacugcaaacacuacaaagguggaauacucaacauugugguuaaacgggaauaaagugagaguaaaagucuuugguuucucuuuuaaugcccugcaaugucuaucucaucaagaaccgaaagaaucuaaggauggucuugcacacaggaauugcaaggguuaagcacuuucuaagaucagggauuuaccaaauaaaugacucuuccaggggcagagucagcaaacaucuaacaauaaggccaguuagauacuaagaauugauaaucuaguaaaaauaauaacacaaaacauaauuugauuguuauuuaagauuaaggagaagaaacaagccaugcaauugggaaaaaacaagagaaagauuucuucuaagauauuugaggaacaauucgugaaaaaucaccaaguuuggaauuaaauuuuuuucaauaccuacauauugccaagagugguacaaaaacugggaauguaggucuaaaagggaaauagaagcaaaauugaauagaucuguuauuuuccaguuauaucauaguggauaagugaguaagccagcccacauucugugcuuuaguccucucaucuauaaauucaacauaagauggaaugaggaaucuuaugaggaugacuaaacugaugccaauaugguguuuugauaucuuuagcacaaagagggaugaaacacauuauuauugauccuuucauuaaacaacuaguuuaaaggagcacuaacauuaaaaaaaaauuauguuauacuagucuuguaucugagauaggaaaauagguugcucugauguauucuguuuuauuuuauauuuuuaauuuuuauuuuagguucagggguacacaugcacauuuguuauaucaguaaauugugugucaugggaguuugguguacagauuauuuuguuacuuagguaauaagcauaagguccuaauaggaacucuuuccaucaccacucuccuuccacccuauacuguuauauaugaacaaguuugcauuauaugagguccuaggaucuuuggaaguauaaaauacacuuuauagaggguauaauacuuaaggcuguuuuguuaauuucaauagauuauaaauuuucaauauaaguaaaauuaugagaagacacuuaagaagacauuggguuaggugcuggaaguaugacaguaauuaagagaucucuuauucuuuuuuuauuauuauacuuuauguucuaggguacaugugcacaacaugcagguuuguuacauagguauacaugugccauguuggcugguugcacccaucaacucgucauuuacauuagguauuucuccuaaugcuaucccucugccagcccccacuccccaacaggccccagcgugugauguucccugcccuguguccauguguucucguuguucaauucccaccuaugagugagaacaugcgauguuugguucucuguccuugugauaguuugcuaagaauaaugguuuccagcuucaucaauaucccugcaaaggacaugaacucaucauuuuuuauggcugcauaguaauccaugguguauaugugccacauuuucuuaauucagucuaucaucgguggacauuuggguugguuccaagucuuugcuauugugaauagugccacaauaaacauaugugugcaugugucuuuauaguagcaugauuuauaauccuuuggguagauacccaguaaugggaucgcuaggucaaaugguauuucuaguucuagauccuugaggaaucgccacacugucuuccacaaugguugaacuaauuuacacucccaccaacaguguaaaagccuuccuauuucuccacaucuucuccagcguuuguuuccugacuuuuuuaaugaucgccauucuaacuggccuaagauggugucucauugugguuuugauuugcauuucucugaugaucagugaugaugaguauuuuuucacgugucuguuggcugcauaaaugucuucuuuugagaagugucuguucauauccucugcccacuuuuuggugguuuuuuuuuucuuguacauuuguuugaguucuuuguagauucuggauauuagcucuuugucacauggguagauugcaaaaauuuucucccauucucuaggucgccuauucacucugaugauaguuuuuuugcugugcagaagcuuuuuaguuuaauuagauccuauuugucuauuuuggcuuuuguugccauugcuuuugguguuuuagucauugaaucuuuguccaugccuauguccugaacgguauugccuagguuuucuucuaggguuuguaugguuuuaggucuuacauuuaagucuuuaauccaucuugaguuaauuuuguauaagguguaaggaagggauccaguuucagcuuucuacauauggcuagccaguauucgcagcaccauuuauuaaauagagaauccuuuccccauugcugguguuugucagguuugucaaagaucagaugguuuuagaagugugguguuauuucugagggcucuguucuguuccauuggucuauauaucuguuuugguaccaguaccaugcuguuuugguuacuguagccuuguaguauaguuugaagucagguagcaugaugccuccagcuuuguucuuuuugcuuuggauugucuuggcuacgugggcucuuuuuugguuccauaugaacuuuagaguaguuuuuuccaauucugugaagaaagucauugguagcuuaauggggauggcacugaaucuauaaauuaccuugagcaguauggccauuuuuacgauauugauucuuccuaaccaugagcauggaauguucuuccauuuguuuguguccucuuuuauuuuguugagcagugguuuguaguuuuccuugaagagguucuucacaucccuuguaagguccagucuuauaagguccaaaaaagucacaucccuuguugaaucagccuugcaucccaaggaugaagccgacuugaucgugguggauaagcuuuuugaugugcugcuggauucgguuugccaguauuuuauugaggauuuucacauccauguucaucagcgauacuggucuaauauccuuguaagauggauucccagguauuuuauucucuuuguaacaauugugaaugggaguuuacucaugauuuggcucucuguuugucgguuauugguguauaagaaugcuuaugauuuuugcacauugauuuuguauccugagacuuugcugaaguugcuuaucagcuuaaggagauuuugggcugagacgaugggguuuuccaaauacacaaucaugucaucugcaaacagggacaauuugaccuccuguuuuccuaguugaauacccuuuauuucuuuuucuugccugauugcccuggccagaacuuccaacacuaugcugaauaggaguggugagagagggcaaccuagucuugugcugguuuucaaagggaaugcuuccaguuuuugcccauucaguaugauauuggcuguggguuugucauaaauagcucuuauuauuuugagauauauuccauugauaccuaguuuauugagaguuuuuagcaugaagggcuguugaauuuugucaaaggccuuuucugcaucuauugagauaaucauaugguuuuugucauucguucuguuuaugugagggauuccaugcauugauuuguguauguugaacuagccuugcaucccagggauaaagcugacuugaucaugguggauaagcuuuuuaaugugcugcuggauucgguuugccaguauuuuauugaggauuuucacaaccauguucaucagggauauuggucuaaaauucucuuuuuuuguugugucucugccaggcuuugguaucaggaugaugcuggccucauaaaaugaguuaggaaggauuccuucuuuuucuauugauuggaauacuuucagaaggaaugguaccagcuccucuuuguaccucugguuagaauucagcugugaaucagucugguccuggacuuuuucugguugguaggcuauuaauuauugccucaauuucagaaccuguuauuggucuauugagagauucaauuucuuccugguuuagucuugggaggguguauguguccaggaauuuaucuauuucuucuagauuuucuacuuuauuugcacagagguguuuauaguauucucugaugguaguuuguauuucugugggaucaguggagauauccccuuuaucauuuuuuauugugucuauuugauucuucucucuuuucuucuguauuaguuuugcuagcagucuauuuuguugaucuuuucaaaaaaccagcuccuggauucacugauuuuuugaaggguuuuuuguguuucuaucuccuucaguucugcucugaucuuaguuauuucuugcuuuccgcuagcuauugaauuuguuggcucuugcuucucuaauucuuuuaauugugauguuagggugucgauuuuagaucuuucuugcuuucucuugugggcauuuagugcuauaaauuucccgcuacacacugcuuuaaaugugucccagagauucuguuacguugugucuuuguucucauugguuucaaagaacaucuuuauuucugccuucauuuuguuauuuacccaguagucauucaggagcagauuguucaguuuccauguaguugugcaguuuugagugaguuucuuaaacuugaguucuaauuugauugcacuguggucugagagacaguuuguugugauuuccguucuuuuacauuugcugaggaguguuuuacuuccaauuauauggucaauuuuagaauaaguacgauguggugcugagaagaauguauauucuguugauuuaggggggagaguucuguagaugucuauuaggucugcuuggugcagagcugaguucaaauccuggauauacuuguaaaucuuuugucuucuugaucuguguaauauugacagugggguguuaaagucucccauuauuauugugugggagucuaagucucuuuguaggucucuaaggacuugcuuuaugaagcugggugcuccuguauugggugcauauauauuuaggauaguuagcucuucuuguugaauugaucccuucaccauuauguaauggccuucuugucucuuuugaucuuuguugguuuaaagucuguuuuaucagagacuaggauugcaaccccugcuuuuuuuugcuuuccauuugcuugguagaucuuccuccaucacuuuauuuugagccuaugugagaugggucugcacgugagaugggucuccugaauauagcacauugaugggucuugauucuuuauccaauuugccagucugugucuguuaauuggggcauuuagcccauuuacauuuaacauuaauauuguuaugugugaauuuuauccugucauuaugacguuagcugguuauuuugcccauuaguugaugcaguuuccucauagcaucgauggucuuuacaauuuggcauguuuuggcaguggcugguacugguuguuccuuuccauguuuagugcuuccuacaggagcucuuguaaggcagcccugguggugacaaaaucucucagcauuugcuugucuguaaaggauuucauuucuccuucauuuaugaaacuuaguuuggguggauaugaaauucuggguugaaaauuauuuucuuuaagauguugaauauuggcccccauucucuucuggcuuguaggguuucugccaagagaucagcuguuagucugauggacuucccuuuguggguaacccgaacuuucucucuggcugcccuuaacauuuuuuccuucauuucaaccuuggugaaucugacaauuaugugucuugggguugcucuucucgaggagcaucuuugugguguucucuguauuuccugaauuugaauguuggccugccuugcuagguuggggaaguucuccuggauaauaccaugaagaguguuuucuaacuugguuccauucucccugucacuuucagguacaccaaucaaacguagauuuggucuuuucacaucgucccauauuucuuggaggcuuuguucuuuucuuuucacucuuuuuucucuaaucuggucuucuugcuuuauuucauuaauuugaucuuuaauugcugauauccuuucuuccacuugauugaaucagcuauugaagcuugugcaugugucacgaaguucucgugcugugguuuucggcuccauucauucauuuaaggucuucucuacacuguuuauucuaauuagccguuaaucuaaccuuuuuucaagguuuuuagcuuccuuccacuggguuagaacaugcuccuuuagcucagagaaguuuguuauuaccgaccuucugaagccuacuuccgucaacugaucaaagucauucuccguccaguuuuguuccauugcuggcaaggagcugcaauccuuuggaggagaagaggugcuguggcuuuuggaauuuucagcuuuucugcucugguuucuccccaucuuugugguuuuaucuaccuuuggucuuugauguuggugaucuauagaugggguuuugguguagauauccuuuugguugauguugaugcuauuccuuucuguuuguuaguuuuucuuauaacagucaugccccucagcugcaggucuguuggaguuugcuggagguccacuccagacacuguuugccuggauaucaccagcggaggcugcagaacagcaaauauugcagaacaggaaacacugcugccugauccuuccucuggaagcuucaucccagagggacacccaccuguaugaagugucugucagccccuacugggaggugucucccagucaggcuacacggggcggggucagggacccacuugaggaggccgucuguccauucuuagagcuugaaugccaugcugggagaaccacugcucucuucagagcugucagacagggauguuugagucugcagaauuugucugcugccuuuuguuccacuaugcccuguccacagagguggagucuauagaggcaguaggccuugcugagcugcagugagauccaccaagaucgagcuucccagagcuuuguuuaccuacucaagccucagcaauggcggacaccccuccugccgccaggcugcagccucacaggucaaucucagacugcugcgcuagcagugagcaaggauccaugggcgugggaccugcugagccaggcacaggagggaauauccuggucugcugguugcuaagacuguugaaaauugcaguauuugggcgcaaguguacuguuuuuccagguacauucugucacggcuucccuuggcuaggaaagggaaaucugccaaccucuugugcuuccggggugaggugaugccccgcccugcuuuggcuugccccccuugggcugcacccacugucuaaccagucccaaugagaugaaccagguaccucaguuggaaaugcagaaaucacccgucuucugcguugaucucgcugggagcugcagaucagagcuguuccuauucagccaucuuagaagcaacccaagaucucuuauucuuaaggaaccaacagagauuaggaagaaagucacaagcaaauucauacagugagacucuauaguauacacauguacaaaugaauauggcaacagaggaggaaaagcaacaaaaucuaucaaagaauucaggaaagaguuuaccaagaaggugauauuugaacugaaccuuauugauggaauuugcuaucuauaggcuaugggauaaggacagaccaagcagaugaaaguacaugaaaaguucagagauaucaaagaaugaaugacaaaauguuccacauggcuggagcucagguugcagguguuaggaaaugguagcuaaauaagagaccagugcucuuccugcauggauauugucuuuuauuuaaauuauuacuuuaugacauccaagcgauuuuuuuucugagaauauuuguauauggacucuuuuuugccacaauuuaucaacuauuauaguucuauaugauaguuugaaauaguuuccuacauaguucacuaucuaaggauuaaagugcauguaaugauuucucuucuacauagcucaccugacuuuauaguugaucuaaaaucccuaauuaugagaugguuaauuugacauugcuguaagccacuaaaugcuaauuacuuacaccaccuccaaggggcuuuguaaccgcauauuuguagcaggguuucuguguaauaguuuagcagauauugcaaacuagucacaacaaagagaugggauacuuaauuuuuagauuugaaaguucacacaccuuauuuggcuagaauagaaaguugauaaggucacagggaaguggaguuuccuugcuucgaagccaucaaugcgacacuuaucuagaauuagcugacucacaaaugcagacccuuaaucaaaaaggacuucauguaaacacguuuauaaauaacaaaaucauaaaucccaggauugaagacaguucaauuaaucuuaacugagugcauauuugucaggcagugcucuaagagauggagauauagcagugagcaaaaugaaauccuagcucucaaagguguagguucuagaugcaggaggccuccaggaugugcacacacacauacauacaugcauauguacauacauacauacauuacauguguguauacaugaaaugggguaaagacaauagagugaugaagguauggagacuguuuuauguucacaauuagggaaggccuccucaguaaggugacauuuuagggaagaccugaaguguaggaauauaucaaacagcaagagcuaaggucauguguugucaacuguugcuggggaagagccaggaagcuggugugauuggagcagagucagggaagggaaggugauagagggaauaucagagcaacaucagggccuaggucauauagagcccugugguucugguaaggauuuuggauuugcucugaguaagaugagaagccuuuggaggguuaggagcaagaaauggcaugaucugauuuauauuuuaaaaugaucacacuggcuaguauggagagaaaagacuauaggugauaaggguggaagcagaggugcuacugcaauaauuuagggcuguaguaguguggguggggaggugaugaaagauugcuugauuguggaucuauuuuaaagucacaagaaccuaagaguagggauuugaucugcuuuauucucuucuguaucugaagcuuccagaacaguaccaggaacacagugggggcuaauaauuauuuuuaaaauacuaagugaagacaauggcuggcagauuagauauagggaguaacagaaaaaauggagucaaggagaguuucaauuggccugcacgacacaaaaguggagauaacacuuguugagauaaugaaaauugaggaggaacagguuuugggguaggaacggaguuugguuuuggccaugguaagcagggagguaggucucaaauucaggggucaggucagauuagagaugaacauuuggaggucuucaaaaugcaaauauauucauauaaaacuguaagacuggaugauuucacccagggacaaauguaaauaaaggagagaaccaggaucccugaggaacaccaauguaucaugguagcauagaugauggagccccacaaaagaagucugaaacaaaaagcaaucagagagggaggaggagaaccagagaaggaugccccauuagcaagagaaggggaugcaucugucaggaggcucccuaggggugccagugcagugagaggcaagaucucagacuucaccaagaaaagauuauuguuaucuuuacaacagacaacgggagaagaaaaaauaggagaauuaagcagagaacauauuuugaagauuuguuuuuugccaauggagaaaaaaaaaagagagagaggguaacugaauaggaggaugggucaagagaauugcccaaucaugagggaaaaccugacaaucugagagauucagauaaaaagacagcgacagcugacaacacaguaguucaugcauaauacaaaguaaauauugaaaugauaauccuucaaaucucauuauucuguuuuacuuacuuaucacugaaauaaaauugacuucaaauacauuugaggauuggcucccuccagcaauaccccuaauucuaaaguauguucuugccugugcaaacuuaaaacuaacugcauuaucuugucuuucucuuuccucuuccucccuuauuaauacauaggucagaaaugaacgauccaucugaguucauuugguaaggaugcuggcugccagucuuucccucaguuacucuuuuagcacuuguguaucucuggaacagcugccuccuuugcuggggcaaugcccucuucuccagaccuccaucuccagguccuuacacucaaagaggcagaggaauauuucuuuauuacuacuccuugacggagagaaaccucauaauuaucagccagaaucaaaaucuugggaggugguuaaauucuugcaugguuuugcugaaucuaguaugaaggaugaauuacuuaaaggcaaguaaauugcuacaauaacuuaaaaguucacacuaucauuucugaaacuagcagaaggaccccuaagcauguuaauugggauggcuccaucaaauaaacucaucaugcaaagaaagcaauaaaccuuaagauauuugggaaauuuguaucuaaugagaaacauuucaguuuaauuuguuucacucaagcuuaccuuguucaaggcacuaugaggaguugugugaaauguacaauugaaugagaaauaauuccugucauuuuagaaggaaaaucccaaagcaauaaguauacaauuauuuauagcaaucccaauacccaacacaccacacacaaacacucucucucuccccgcccccaacacacacacaaacagacacacacacacacgauuaauuauucuccaaaugcauuaagcguuuuuaugucuagcguuucugcauagccauucuaacuuucaaagcacccuuccuccaguucucugcuguugaaaugcuacuuauccuucaagauucaguuuccagagaacuuguggguuucuccaaugagcauuaaucccuccuucccuauuuuugcaacugaacuauuuuacuauugauauguacauaucugcucaccccgucagauugugaacacauugaagauagcuauuauaucuuacaaugcuuuaaauccccucagugucuagccaggugccauauccauaagaguguaauauaguuuuguagaacuaaauuguuucauugaucaucagccugaggaagcucaaucaaggacaaaaagccuacauaauuguuggggucccaguaauguuguuuagaauuuauuaaucuaugccaggaacuaugcuaagagcuacuuauaaaguacaucuaauuauuacuuuaaacccuauaacauccccuuuga

SEQ ID NO: 16201 - RNA, 80487 nt, Homo sapiens
cggcagcuaggcgcugugguuucugggucucccgggggaccccuacacguuccggcaaaaagcgcucgugcccaccucaagcccauguucgguggguggcgaaugcgugcccgugaucugcugggucuguagaggagcgcaggccuggugcaaacagacucaagaggcucggagaaccagcuuggguaggcgcuugggugauggaaggucaggggucagaggucgggagggagggagggagguggucuuuggccuccgggaccagggagggaggacgcugguuguccuggagcccgggaagcucaagggcugagagggagccgcugcgcgagucuuccccaccucuucccgaucccggacuagcgaacuucggaccaccacgucccuccggggauaaaguggggucgugggaaaggaggcugugcuucuccucaugcacuggggccugcgguguuugucucgagcguccaacacacuaggauccgggaguccgucgucacgcuccuuggccucgcggucgcuuguuugcucggccugcugggagcgauccggcgcugacagccccgcucagacuccgggagccgcuugugggucuuucggaagauaacugaguggguaccgugcgccgcagaucuacccccggaggcuggaacugggucgccgccucccuucuuugugcgcggcauuguauuaguaaaaggggaggcagagguuucucagucccacucaaaguucuccguuaccuuuggagccagauuaauuacauucgaauucagaaccacucuuugacauuguacaguuugacugguaguugcuauguuuaugaacgaagauaggguguuauuugaugauuaauagucacuguauaaugaucaguuaaauaaugaccaggaagcuugugcccuuuuuccaaguaguuugacauuagcacgagguagaaauccgagauguuugaugccuuccaacuuguacuuaaggaacuuaaggaacuuggggcuuuuucugaacaaaauaagauaaaguuauuacuguuacuuuaaauuauuccagugggcauuaguaggaaugaugaaacucuugaauagaaacgauccaugauaucucuacugucacaaaaaagacuauuuaguuuaugauuaguaaacaugcuggagacagagcaguccugagcaguauuguaaugauuaugucugugcucgauaaccugcacuuucuagagcuuuaaaggaccaguuaaccaguaagcuggcaauugagaauaaaauaguuuacuuuugagagaugcucuuguauauccucuuuguccacccgaaaggagcuggacuuacagaauuauuaaaacaaaacuuuuauuauuaagaguuuaggccaguaagauuuaggggaaacaauuugcuggugaaaaagcuucuuaugagggcauuuuuaaaguuuauguaacuagcauauuuuagcauucaguagaagaaaauacucucaccuugcuggaauuauuucuacagaaaaggaaaagauuauguuaacccugggucauuaagagcuuccuaguacuuaguaaugagugggcuucauuuccauaacacaacauuuuggacaggaauauggcaaguauguaauccuuuuugcccuuaauagccuaaacccagaucuaccauggauuuguuguaauucaagauuuguguguaucuuuuaaagaggaaauaauauuuuggagggaaaaaaugugaauuuaaguuguguuauucauuuguuggauugucuuaguaauguaacauuuuauguuuauuuuucuagcauuccauccuuguuuucuguuaaagauacaguucaggcaguuuucccugccucguucuaguauuucauuuuucucagaaauacuaguuucauauuaccuauagucuucuagaauguggauaagagagacuucuccaaaaagaaauaagaguaaaguaucguuagguccucaaaaggagggaauacauccacggaauuagagaucuuuguuucacccuuuuuguaugucuuuacuuccuagcacugaccuggcauugggaguacaacacugaauaggauacuacuccugcccaucuuucaaagugaacacucuagcaguugggaucgaggagagagaggcccuuaacucagcuucucuagucauggaagccuuuccagggaagauugggauggagacaggcauaaaagcaauucaagcaaaaggcuuuuauauuuaaauacaagacaguaaaagugcgguccauauagaaaacuucacauaauuacguuuuacccaaacacugcuaauuaaggaggaggaagaaguaguugugacugauaagguaugaauaaaaccagaagaauaugggaugugguuagauacagaauuucaccaguacuugacuuacuaguugccaaauugcauuuuagucauaaguauauuugaccaaauacuauuuucuuugguucaagaaguuaacccugaauagagauuuccuuaaguaaagacucagucaaaaccaggagcuuuuuguuugguugguugauuuuugaucaugaauguuuacucaguuaagaacuggacaaagggagagcauugcuagaaauucugguguugacuuuucugcaguuuaucauuaucacugauaaguaccuugaggcacuaauauuggaagaaucaggcugaaagaauacaucugaaggaaugugcaaauuauaaugguguacauaauuuaaaagauacuggauagguuuuaccagagaacagaauaaauaguugaaguaauguuuucugguuugguaauaugucuguuacaaaauuauugugggaaacauggcacauauuacuucucacauuccauuggcuaggacuggucacaggaccaaaccaagcugggcagucauuucucaacuacucuauacuuugaguggaaauaaguggauuuuaguuggcagcugguuauccauaacaagguuuuuugaacuuggcugcacccuggaauuuuuuagggauucuaaaaaauaaagggaguagugccugggcccuucuccaagacauucugacuuaguuggcucgacaucaggauuuuuuuaaguuccccuggugauucuaaugugcagucaaguuugagaagcacuaaucuguggucccccauccugcgacauuacaguuugguuauugugaaaugugguuuagagcagggguccccaccccucaggccauggaccggugccaguccguggccuguuagaaccgggcugcauugcaggaggugaguugcgggcaagcgagcauuaccaccugagcugugccuccugucagaucaacagucaguagauuaccauaagagcaugaaugcuaucgugaacugcauaugcgcaggaucuagguugugcacuucuuauuaaaaccuaaugccugaugaucuaagguggaauaguuucaucccuaaacaacccccucuccacuccaccccucuccuccgguccauggaaaacuugucuuccaugaaacccauuuaugguaccaaaaagguugggaacugcugguuuagaguguucucaggaugaugauaaguagcaacuaccauuuauggaauacaggccaaauuucuaguacugcuguuguacuuaaauuauuucuaaccacaauccugcuaucauccccauuuuagagaugagaaaauuggcacagaagacuggauaacuauuccaaugccacacagucaguaaaugccaaagcuggaauuagaaugaauauaagacuucaaagcauugcauucucaccuuuaagccacaucgcuuugcuaaugugagacucugcuagacaguugcuuuuuggguuuucagaguuaaugauuccacaauaaccauguuauuaauauuauuaugguuagugugauacauuguguaacuggcccaauucccuuccaacacucccucuacccuuccaccccccauauccaugcucuuugccaugugcaguuucaccuaguaaagagguguaguauauuucuucaccacuugacauuggguccauggauaugucuugcuuuggucuguggcaccuuagugguuuuuaagcacuuugaaaacuacuugugugauuggauuugcaguaauacaccucaaccauugccauaaagaacauuccugaguuacuuugcugauccaaggagaggggauaggaacuacauuaagcagagccaaacugcuuuuccagaaaccuagccuagauuagccuccuucagcuaaugugcagaucuaugagaauaaaugauugcuauaucaagguauugagcuuugagguaguguguuacacagcauguuuguggcaguaguuaacugauaagcuacuauagcauaacuuuuuaaaguuccugcagagugacccacuuucaguauuccagcuuaugcuuugaggaaaacuggacaaacauaaacacuuaggaaauuaagagcuuucuauauuauuccacuaagauaagagaggauaagaugcuuuaaaaguaguugaccauagccaaggauugauuuuaauccaucaccugcacauucauaagugaagcacgggcuaagggaauagaauucucaugauugacuuaaacaagcacugucugauacauagacuuuuugcaauuaugugaaugcucuauauuugugcuguccaguacaguagccacuagucacauagcgcuacugagcacauggggcuagugagacugaagagcugaguuuauaacauuuaauuuuauuuauagucaugcaucacuuaaugauggggcuguguuuugaggaaugcaucauaggcaaguuuguugugugaacaucuuaagaguauacuuacacaaaccuaggugguaccgccagccuacuacacaccuaggcucuaugguacagccugcugcuccuaggcuacaaaccuguacaguauauucgguacuggauacuguaggcaguugucacaccguaguauuuguauauuuaaacauauuuaaauauagaaaauguacaauaaagauaugguauaaaagauaaaaaauaguacaccuuugugggguacuuagcaugaaugcagcuuauaacacugaagguugcucuggguuagucagggagugaaugugaaggccugggacauuacuguacacuucuguagacuuuguaaacacuguacacuuaugcuacacaaaguuuauuaaaaaauaaaguaaugcggcuaggcgcgguggcucacgccuguagucccagcacuuugggaggcugaggcaugcagaucuugaguucaggaguucaaaaccauccuggcuaacacaugaaaccccgucucuacuaaaaauacaaaaaaaaaguuagcugggcauaguggcaggcgccuguagucccagcuacucaggaggcugaggcaggagaauggcaugaacccaggagguggagcuugcagugagcagagaucacgccacugcacuccagcugggcaacagagugagucucuaucucaauaaauaaauaaauaaauaaaugcauuaugauguuacaauggcuaugaugucacuaguccauaggaauuuuucagcucccuuauggaaccacuguaauauuuggucccucauugaccaaaaugucauuauacaaugcauaacuguauugaaaguuaaguagucacaugcagccaauaacuaccuuauuggauuugcuuuggccaauaguagcuagaaacuacuuccuuggaggugccaaggaaaucacuuccuuugaaucauagggccaccuuguuccuaaauaaagguucagucaucagggaaggaggauagaccuuaggcagguaaauaaugucacuuuaguuucuuuuaugguuauuggucuauucauauuuuccuucuugggccaguuuuguucauuuguauuuuguuagcaaaauuuuaucacuuuauaauuuaucauuuuaucuagauuuuucagauuuauugaauaaaguuauacuuaauauuaaaauuucuaaaucucgugcaucuuuuuguuuuugcucuuuaaaucaacuuuaugauauaauuuauguauaagaaaauucaauuuaaaguauauaauuugaugaguuuugacagauguauacucugcaaucauguguugaacauuuaugucaccccaaagccugccuuccugcuccuuuacugucagucaccucuuuauacuuccuugccccugguaaccacucaucuacuuucugcaaucagguuuuugccauuucuagaauuucauguaaauggaaucauauaguauauagucuuucacaucuagcuuucuucaguuuagcauaaugcuuuaacaguucauucagguuauuuuacagaagucucuuuuuaucacagaauaguauuccauugugugacuaugccacaauuuguccauucaccaguugauggacauuuggguuuucuuccaguuuggggcuuuuaauaguaaagcuguuaacauucaaguuuaaauuuuuguggauuuauguuuugauuucucuuggauaaauaccuaagagagggauuacuaggcugcauaguaaguuauauucaauuuuauuagaaacugauacuuuuccaaagugacugugcuguguucaaauguuggagaguucaguucuguuugagccauacucucaguguuuuaaauuuuugacuauuuuaguauaugaauaguggcaucucauugugauuuguggguugaauuuguauugcuuuaaugacugaugcuggugaaaauauuuucauaugcuuauuuuacacuuauaggucaucuuuggugaaaugucuauucaaaauuuuugacuuuuuuaaauguuugucuuacuauuaauuugugagaguucuuuauauauucugcaaacauauccuucaucagauacuugauuugcuaauauuuucucccaucugugacuugcugucauauuuugaugacaguaucuuuugaagaaccaaaauauuuaauuuugaugaaacuuaguuuaucauauucuuacauagucuaugguuuuuguuuccugcuuaaaaauuuuugugccuuuuuuuugggcuaauccaaugucauuuagguuuucuccucuguuuucuuugagaaguuuuaguuuuagcuuuuauaguuuauuaucuauuuuuaguuaauucuuacauuuuaggagguaaagcuucauuucauugcauauugguauccauuuacuaaaaggauaccuuucccauugacugccucugaacuucuuucaaaaaucaauugaccauccauguguggguccacuacaggacauuucccuugaucuauauguuggucuuuacaccacuacugcaccauuuuuauuucuuuugacauaugucuuggaaucaguguaagucauucaacuuuauuuuucuuuucuaaaauuauauugacuuuccuguauuguaggcauuuuaguauaaauuuuaacaucagguugucaguuucuacagaacaaaccuguuggaauuuugaaugggauugcuuuucuauaggucaguacuaagaaauugacaucugaacauuuugagucuucuaguccaugaacauaguacacuguauagaucucugauuauacuguuauacuauuuucuaaauuuuuauguaugcuugaaaauuuucagaaugaaaguauaguaaguuaucuuuuacagaaauuuaaaaaucaagaaaaaaguuuacuauauuuauacacauauuuuuuguuuuugcuuuuuauuuccuuguguguggauccagauuuccaucugaugucauauuucuucuacccaagcgcuucuuacauuacuuagauuguagguauacaggugauaaguccuuuuggcuuuuguugaucuuuuuuucaccuucauuuuugaaagauauuuugcuggguuuagagcuguggggugggagcagugucuaaaccagagaaauagggccaaucuggagagaaguccucacuuuucaguaauuuaauuauggcauaccuuauugugauuguucuuuauguuugcccugauuggguuucauugagcuucuugguuuucugaguugaugguuuuuauagaaguuggaaaauuuucaugcaugauuuuuucaaaaaguuuuuuguauccuuuccauucuuugcugcugagauuccaguuuuaugcauguuugacuccuuaacauugucuaguagguuucugauguucuauuuauuguuuuuucagucuuuguuuaucucuacuucauuuuugacaguuucuguuguuacuguuguuuccauuguuuaagcuuauucugcuucuuuuuuucuuugccauuucuaaucugcugguaaucucauacaauguguuuuucguuuuagauguugcauuuccaucugcauaaauucuauaggagucacuuguauaucuaucauuuuucuuugucauauucauguuuuccucuaccuuuaacauauugagaauauuuacaguagcuguuugaauguuuguuucugcuaauuauaucaucugugucuuuucuggggcuuuuugauuuuuuucuuguaaugggucuuauuuuucuguuuuauuuucauuuuuuuugcgugccugauaauuuuagauuugaugccagacauuuguguuggauuuuguuucgcucuuuuaaguauuguugggcuuuguucugaggggcaguuaaauuacuugggauugagagauuuaccuuccuauuauauugcuuauuaaauguauuucuacaauuuauuuuauuuuauacaacaaauugccuuuacuauuaaagacuagcaaaaccauuagaauuuauuugauaaaugagauuaugguuaauauguucauuccuuagucauaaugaccugguaaaaaaauuacucauugccuuauaucucacagaagauuucauauuauguuuaugggcuaugaauuuaugcugaauuucucaucugguaacccuuaaauacuaaaucaucucuuguuauaccuccuguuguuucauuuguccucuagaguucacaguuaccagccaagaaaacuugaaaaugagcagccgacggaaacgugcuccuccagugaggguagaugaggaaaagaggcagcagcuucauuggaauaugcaugaggacagaaggaaugaaccuaucaucauaagugaugaugacgagcagcccugcccagguucagauaccucuucugcucauuauaucauucuaagugauagucuaaaggaagaaguggcucacagagauaagaagagguguucaaaaguggugagcuucucaaaaccaauugaaaaagaagagacuguugguauuuuuuccccuuugucuguaaaguuaaauauugugauuucucccuaucauuuugauaauuccuggaaagcauuucuaggagaauuaacucuucagcuucuuccugcacagaguuuaauugaaaauuuuuccgaaaggaguauuacauugaugaguucagagucaagcaaucaguuccugauuuauguucauucaaaaggugaagauguagagaaacaaaaaaaagaaccgaugaguauuugugacaaggguauucugguggagucauccuucaguggugaaauguuagaagauuugggguggcuacaaaagaagagaagaauaaaacucuaucagaaaccagaaggaaaucacauuaucaagguacucaguuuuuuguggugucuuuuuugaggcucuucuacauuggcaguccaauuuuaaauuaacuugugagagaagucugaaaagccagcaauaagccuuucauuguuaaguuucaaaguacacuuuaagcuuuuaauaacuauucaaaguauguuacaacuaaucauuuucaggcuacacuuuuucaagaucuuccaucucuacuuucagugacuuguuuugguccucaucaucaguuccucuuacugcagcagucauuuaaccauuuaucuguuugcuauuuugccuuuucaaaugcuucgauuuugucucuggaauuguaugauugaaugcaaaugaaauucuacccauuacugccuacagaauuaaguauaaucuuucuaaucuggcacacaaguuccucccuugacaagcccuugagccuuacccuuuauuacucugcuuuuuauuuugucccagaaacuccaaauugauuuauuuucuccauauaccacacugacuuucugcgucuuugcuuuuguucuuauaguuccuucugcuugaguuguucccuuccccuucccugguaauuccugguuauucuuuaauauuuaguauagcauuuaauucacccagggagaucguuucuuaaaucuauugguaguauuaugugcccucuccucagaaucucugguagauuuuuuuuuuuggccuuggcggcuugucacauacuuaacauuuuagaucauuccccucugcuaaacuaugaagccuuucaucuuuacagccuaguaaaguaccugguaccuaaauuuucaguagaugaaugaauaaauuuguaauuuauuucagucucugucauucacuggccaaauaacuuuaugugaaucauuuaaaugcucuaauuucaguuucuuuaugaaauguaaauaauacccauucuucuuacagcauagaauuguguugaaaaucaggccagauaauguaagaaaguauacuuuguaaacugugaagcaaguuaauaugcuuuuaugcuaaaccugaaaauuuaaaauguuaauuucauguuguuuaacugaaaacugucucauauauuucuugcaucgauaaccuuaguuauaguuuuagaauugucagaaggaaaggagaacauuuagaauuauuagacuccaauuaauuuuucccuguacagugaaacuauguaaucaaacauucccucucuuuacugauuuugccaaaauuguggcucagugauaacaaguauguaacaauuuaugacucacauaucuguguucuaucuacguucccuacagaccaaguguuaaucuauucuguuuuuccugauccugaauuuuacaaauauuuaaacauuuauugcugcuguaguaagacaucaccaagcgagccaagacagaauacuagcaguaaugaaauacacucuuugucauucauuucuguguaaggcugguggauuccuguucuguagugaaagaauaugagauucucagugauuagggagucagguacaacauagucaacaugaaguaaagggaauuaacauuuauugagugucuaccauuagaaacuuuuauaguuauauuauuuaagauggacuucucuccauuuuguaaaugagaacacuuaggucaaaaucaauagguuauuuuucucaaauucauuuagcuuccaaauaucaaugccaguauucaaaaucaagucuuucaacuguaaaacuucauaccacauugcuucacuagggucaaaauauuaacauuaaucaaggucuguuuuuuuacacguuuuaguguuugauucaguaaugaggaugcccaaaccuaacugugcagaagauuccuagcauguaugucauaaucuucuggggaaaucggcauuuuuaacaaacuugacugauuaauucaucaguuuugggaaucauugcauugguagauagaacuagguguucuuaucacauucucccagguucgauuucaguuaggggaauauuuuuuuccagcaacucgaauuguacauuguaggcacuuacauuuauaauuuguuagugaaaaugaaacacgugggggaaauuugguaggcauguauuuauuguuugugucacacaugcuaugaauaccuuuaaaaguagugaugcuaauuuuuucuugcuuauguccucauaaagaaugguauauuucaaaugaaacuacuuuuauuuugauuaauuguuuuuagguuggaauuuaucuuuuggaagcuggccuagcaaaacuagacuucuugagugaugcaaauucaagaaugaaaaaguucaaucagcucaugaagaaaguaauggaaaaguuacacaauucuauuauuccagguaauauuuacaguaaacuuaaaaauugcuauuacuuaggaguugugaguuuuuuccucuaaccccuggacauaacaaucagaaaaacagcuaauaaagccauaauaaaaauuaaaugauuauauggcaaauuauacuuauuugaaaugcacccacuaauauaauuuguuucuuugguuaacucugugcuuaccuuauauuaaauauuaaagaaauauuugcggagucaauaugcaagucaaaaggcagagucuaaagggaucugagcugguugggauuuuugcauuauuccugugcuuuuauuuugucaugggccagaaauucuuggcuggcguuuauuccaccucuccuuugcagucugacaaauaauuucaaaagccugguucccauaaagaccagauaacuuugcucuguuucuuggcaagacguugcaucuuuggucaggacugcagauucagaguugucugccauuggucaccuugggagaguguggauggcuuggugcagcucaucaacacuacuggaaaaacagcccaaauucuccaaguucugcucauggugggucagcauuauuucaggugcaaauuauagaacauugucauacuggaguauuugaaaaucaguuucuaacuucgauuguuauuucucuaguacauucuuugcaaugcuuuauaauaucaguaauaguaaaucguuuugcaaguuagauacuuuaaauuaggaaaucucugguuucgggauuagaaggaaugaauuuaaguacaucuagaguuuuuaaacuuauggccuuuuaaaaauauuacaauuuguucauuuuaaagccugguaucuaaggaaaacuucaaauuuagcuauuaaucuuagauuauauaauuauaguaaaagucuaaaacaacugagcauaaagcuguacauuaauugugaaguuuuggaaauuuuacauggcauauuuauuggaaaaaaauaaguugugaauuuuuuggugucaucuuuuaguuuuagaaguuaugagguauguccuauaaaaguauauaggccucuuucaaagcaauucagaaauaaaugauauacuuuuucaccuugaaagaauuauguuuuuaauaaagaaccauuagcugaaaggaguuuguaaauauguucaagguuuuuauuacuuuuuucauguuauaguaaguauaaaucuucuuccacagaacaauugugcccaccaagugaacuuaguguuuuuacaaauuugcauuaauaacauaaucacuugucuuccaguuggcugcuacugcuaccaaaugccuauccuuuucuagcauaagaaauaaaaugagaacccauuucuuauugggcauagaacaguuaugucuccauauggauuuuguauguuaaaauuacaaaaguaaaguaaguuguuccuauauaaacuucaaacaguauucacauugaguuccucaaauguuuauaaaacauccacaauagacaauacacgugucagcuacgugucagcuucucugaggggcuacaaaaaugaaaaacuuugccuuuguuacccuggggaaaggaccaguggacauaaauguuugcaguaccagauagauuacaauguaauaauacuguauccacagaggagaacauaauuccagccagggaaaacaaaagaaaaugccauggaaaaaguaucaguuaaacuuucuugaagaauggaugaguagauuuuugauuaaugaagaauuaaagauagggccuuucagugacaaaacacacugagcaaggccccagaguugggcaaguucauuguaugcucuuagaauaagaauugcuuauaguuagaaaaaaccuaucaguuuuugaguacauuugcugugugauguacagauguguuggaagaggaugaagaugauccggagagugagccagagggacaagacauugacgagcuguaucacuuugugaaacaaacacaucagcaagaaacgcaguccauccaaguggauguccagcauccugcauugaucccuguguugagacccuaccaaagagaggcugucaauuggaugcuacaacaagaguguuucagaagcaguccugcuacugguaagaauaagauguuuaaagaaaguccaauugauuagagagauuacaucagagacaauuagggcagggugaaauugaucauuaaaauaaacauccugaaaauauaagauagaaugggugccauaaaauuauuuucuaagaaauucuuuaaaauugaaaucuagaaaaaugaauuugugaguuucuucauucauaaaaguuuguacugguuuuucuugccaaaaggaaaucaauccugccucaauuggaauuuuuaaaaaccaagaaauuuuuuuuacauuccuuucaaacaaagaauugcucuuuagaaucugguccagugggaaucuuacugaccaucugcaagaaacucacaauguaauggugaauguuggugacagaaagcaaauuuacaaaaguaggagacuuaugugugaugaauuuuccuagacuuugcauuuuuuucuuuacaguaauaaaaugucaucuguugaguauuuuuaugaaaguaguaguuuuacgggaggcauuuaugccacuucuuuauugcugucuuuuuucaauaacuuuguggggguaaaagugguuuuugguuacauggaugaauugcauaguggugaagucugggcuuuuaguauacccaucaccugaauaguguauaucguacccacuauguaauuuuucaucccucacuucccuucugaguuuccaguauccguuauacuauucuguaugcccccauguacuuauagcuuagcucacacuuguaaguaagaacaugugguauuuguuuuucuguuccagaguuacuucacuugggauaauggccuccauuuucaugcaaguugcugcaaaagacauuauuucauucuuuuuuguggcuguauaguauuccaugguuuccaugguguguauacacaccugccccccuccacacacauuuucuuuauccacucauugguugaugggcacuuaaguugauuucauaucuuugcaauugugaauuuguacuucaauaaacauguaagcaugggugacuuuuugauauaaugacuuguuucacuuuggguagauacccaguaguguucuggagugaaugauagaucuacuuuuaguucuuugagaaaucuccauacuguuuuccauagagauuguacuaauuugcauucccaucagccguguaaaagcauucccuuuuuacuggcuucgugccaacauccauaguuuuuugaauuuuuaauggccauuuuauucuagaauauaaaaauauaaaauaucuauuaaucucuaaagaagccaauuaaaaauuacuugcuguuucauugguggguagagacaugcuacuuauuuggcaguugguuuaaauaaguuaaaauauuaaggagaaggcuaguggaagauucugguagaaacaaacucagcacuucugaguuaugguuuuagauauuuuuuucccaguuaaguaagccuuucuucccacucucagacccguagaagaggucaggucugauucggguaaauguauuuagccaccuagcauaugucuauugaguuauucaaagacuucauauaauuuauugcaagauuuauuaaaaauagacucauucaucagguaggagcugguuauauguauuaguuuuccuguuaauucucuguaaucugccacacuuugcuuaucuguccuauuauuugcugauguggauuugugcccaaaacaaagggagcuaaagaguaauaucagaagaaaggaaauagagggacuuuuagcuuuuuacucauguguuaaguauguggcuuuuccagaaugagauuucacaagaauauggguaucacuaugccagaguauccucacuguuaaccuauucuuuuuuuaaugugauuaucugacugaagggaaaacaaaaauuuguuauuaugauuauauuuuucuuuagaaagugcccugcacuucuuauggcgagagauuguuacaucugagggucugaaacucuacuauaauccauauacaggcugguaaggcaaaauuuuacuuauaugcuugauuuaaaaaauaaauauaaugaaaaacugucugagauuguuagcauaucuguaacuuugacucuaccucaugaaggaaucaaaggugaagucuugauuagacauaucuauggauaggauagauuuagaauuaauagcacuugucauuuuucaguaaaugaauuuggaauaauagacauaaggugcuuaguuaucaagacuaaaagagauuauuauuuaaaguaaaaauguuaucuuguuuauuauggggucaguuuuauuuuuucuuaguaaucauuaaacaucaugaaugaauaguaguuauugcccuuuguauuuuuuuuuauucauagauucauaaaggucauagaaagaaggcagacguguucucuuuuaacuaccacucauuucugcagaguuacuugucagcucaggcaguuuuuuugguuaucacaguucuaauguuuguaaucuaagguuugaauuguuuugcccuaaaauauaguuucaauaaacuuagacuuuaugcauugcuuccaguucucuuuaggaaaaguaauuaggaacauuguaauuuguauucacauuccuaugaugugauuuaucuuguuuuuuuccucagcaucauucgugaguacccaaauucugggccgcaguugcuugguggaauuuuagcagaugagaugggucuuggaaagacaguggagguuuuggcucugauucugacacauacucgacaagaugucaagcaagaugcucucacucuucccgagguaggaggguauaguagggcuugcaaaagcaggggacauauguucucgaaaagcaucguauguugaacauuugcuuggcacuuaagucaacacuuucuguucacucuguggguaaugauuuauauuagugguuaguuaacuucaagugggcagagagaaugggguguuugugacccagaagguuuauuuuugaaguaauguuggccaacuaggaagagaauuugugaucacuuacugaacuuucuucuaguuggcagagaaacuccuuuacaaaaguacuguugacuccucaaauguuuugucacuaauaaagucuccauauuacuacuaaauauuuuuaagagcuauuuaaaaauguuauacaaaucucauauauauaaaucuuagaaccaaauaauuagaacuuuguuaaagaacaaguagcuuaguaaauagauugcuaaaugaaacaaacuucaaguccuugucccaaaauacauaauuguguuuaaaaauauaaauuuuagaguuacagaaacaaaguccacuaaggcaaauauaguauauagcucauauuuucuaguaaugaaaucugaaaucagcccuuacauuaaaucuugcugaaaugaagucaguaguuaaagguauaauuauaauuaauuaccucuaggacccaccagucucacagcuuuagcauuauguuaucuuucaguagggucaaguuugcagaauuagccuuucagauuugaguagaaaauuuaaaaaaaaaauguuuuuuuuguagacaaaugacuuggaauauauugacuuaacuaucaguaacuucuuucugagauuuccuacucauuacuauuuuaauuccaaguuauuuucauauuauuauaaauucaauggguuaauuuuauauuuaaauauaccuuuaaaaguuaauuucagagguuccacacauaacauuuagguaauuuaagauaauaugcacaauuuuuuaagugauagcuagcuguaaacucagaaauaaaacuguguauguaucuacagcuauuuggcccuuucucuugcaauuuuuuuagaacuguuuugcauuuccauaaagaaggaaaguuaauuucaauaagcaauucagaauacugaaagcaaaacacuguguaacuacugacuguuguuuguaucagggaaaaguggugaauuauuuuauuccgucacauuauuuuggaggaaaacugaaaaagacagaaauccagaauaucgaauuugaaccaaaagaaaaaguucaaugcccucguaaguaagacaucucuuaaaggaaauaccuucuuauagugaucuuugcuagaguucuugcaauccuuagagauaucuuguaauuguuauaaacaauuguuuuuacaguuauauaugcuuuugauaaaugaauucaauuacaagucauaauaucuuaacaaaaguaaagauguauuauuuuguuugacuuggcccagguaguucuugcucagucuguuauauuuaaaucucuuuagcuuacaguuuaaaccaggcuuuauuuaucuuuuaggaaaugaauguuucgcauacuaaugguagcguauacuuaaauaauugugagaguuuucuuuuauaauuuugaaugauuguuuuauaguauuaacaauucaauaugaguaauucuuccuuugauuauuuuuauuacaguaauuuguuucuuaauaugcugagauacauuuuuauuacauauuuuuucaaaauggcacucugcuguaauaaaucuuugauuuauuucuuucuuaacucaguccucaugcagauuaagauuaaccaaguuuuacuuucuuuucauuuuaauuauuuugacugauuuagcauauccuuuuacauuuagcuacacgugugaugauacugacagcugugaaagaaaugaauggaaaaaaaggaguguccauccuuuccaucuauaaguaugucaguucuauauauagauacgauguucaacggaacaggagucuuuugaaacggaugcugaaauguuuaauuuuugaaggucucgugaaacagaucaaaggccaugguuuuucugggacuuuuacauugggaaagaauuacaaggaagaggauauaugugauaaaacaaaaaagcagguaacagagcuuaaguucagcucuauauuaaguacacguaugugauaccuuacugaguacauugacagaucccaccuugaaacugaaacucuuacgaucugaagauaaaaaaauaggaaaaguacuuauaucuguaacuucuacuuucuacuuuguggauauaaacuccgugagaguaacuuuacuuuggcuaucauuaaaccuagagaauaaugcuuggcacguaacaaauacucagauauuuauugagugaauuaaaaaacuaguuggcuaagcguauuauagaguauaaagcaucuucuguauuauuuauuuuuauuauuuuuuuaagacacagggcaucuauugcccuggcuagaaugcaguggucauagcuagcugcagccuugaacuccugugccaagcugucaucuugccuuagcuucccaaguaguugugaguacaggcucaugucaccaugccugguuaauuuuucuuguuuuuuuguagagacgggguucucacuauguugcccaggcaggucuggaacuucuaaauucucauuuucuuuauauuauuaucuuauacaauuucugcauuuuguuagaaaacugcuucuguugggccaguaauuucaauuugcuuuuaggaaaauaguuauaauauuugcaaucauaaauaaagauuaaugacaacaagucaaaauguggagcuaccagcucggccaccaagaaaaagacaaaaaauuuauuuucuggaguagggagucuauauuauccuuggguagcacugaagacagcagugaacugugcuuuugguaauccugcuaccaccaaaacuagaagauuucccucaguuaaugccauugauuacauguugugucuuaacuccccuguucgaccucagcccugauaugccuuggaggaagcugucccuauuaacuaccugccuaucauacucccacuauguuguacaacccucuuagguauucccauagcaucauuuuacuuuuuacuguucucacuuuuccaguagaccccuuugaaaccgggggccaaauauuguucauauuugugucccuagcaucuaacacaacuacuggcacagaauuggcauuuaauaaguaauuguaagagaggacauauguagaaaagggaaggaaagaaggaaucaauuugcuaauugcaguaaccaguggauuaucuuuuacuuucuuuggaugcuauauuuuaguacuugguguuuuuguaguugcccugauuuguauauuuauguacucgaaaaguacuagucuuguauugauuuagguagacuaaaucauaguagguaaauaacaaaauaucaguagcuuccuuuaucuuucuaauuuuucaucucuccaaaucugacacuuguagagccuuccuuuuguuuugagaugaagugaggguccuuacagagggcagauuggaagccacuuaucaggagugauucuccucagggaaaaggguagcaaagacuggcugcuacauaauuauaugaaguacuuacauaaagucaggaguuuaauuucagaaaugcaacuaguugcaaucaauuaauuaaauauuuuuuucauaggcaguagggaguccaaggaaaauucagaaagaaacuagaaaaucagggaacaaggacacagauucugaauacuugccaucagacaccucugaugaugaugaugauccuuacuauuauuauuauaaguccaggagaaaucgcaguaaauugaggaaaaagcuuguuccauccacaaaaaaaggaaaaagucaaccauuuaucaaucccgauucacaaggucacuguccagcuacuagcgacucuggaauaacugauguugcuaugucuaaaaguacauguaucucugaauucaaccaagaacaugaaacagaggacugugcugaaucucuaaaucaugcugauagugauguaccaccuucuaauaccaugagucccuuuaacaccucugauuaccgcuuugaguguauauguggugaacuugaucagauagaucguaagccucguguucaaugccugaagugucaccuguggcaacaugcaaagugugugaauuaugaugagaaaaaucugaagaucaagccuuuuuacugcccccacugccuuguugcaauggaaccagugucaacaagagcaacucugaucaucucuccaaguuccaucugucaccaguggguggaugagaucaacaggcaugugaggucgucaucucuucgagucuugguaaggccacuuggacuaaagagggagaggaaaauguaaaguuuugcuucuucaugauaguuuccuaaucuuuguuucuuugugguuuauccucaaaacuaacugaaugauuuaauaguaauguuaaaucaaagcuuaaagaaaaaaauugagacuaagaacuagaacaguacaauguuauucuuuucuaacaucagaauuucaccaauuaaagcauuuugaguauaaagauguggaagcuuuuuaaaaauucuugaguauguaaaugagaaauucuugguauaagcauuuauagucuucagagagaaaugcaauccaaaggcagcacuguguaauaggagcuacuuaucugaucugccaucucuuagcuccaaaaucauccucuaaagcuucaguuaccucagcuguaaaauaagaauuuacuuauacagcaaaucuuuauugaccacuuauuaugugccaggaacugcugaguuuuaaaaauaguauccagucauuugugaagauaugauuuugucaaguacugggcacauaguaauguuauuguuuccuaauauuaauacccuucacuaauuucauucuuccuucuuuccaugcaaguguuacugaagguuuuuguauuucauccacuuuacauaggcauggagaauacuguaauaagcaaaacaauuuuugcuguuaagaagcucuauucuguguggguaggcaaagcuuugagucuuaguuccaucaguuuugagcaagucacuuuauuuuucuuaugugugggauaggaauauuaacaaccaccaacagaauuauuguugaaguuuggagauaaugcuuagcacaguaucugaaacauaaaaggcauuucauaaauaauagcucuuauuguucuacuuuuucauaccauugugcuuucacauaugcuauugauuccauccuccuaccuacauauagcccuuuucucuuuuugccaccuaugagaaccuuuaagauauaccucagguuuuaacuccucugugauuuuaccuucuccgcuacagaauuggucuuuccacugugaugcugucauguucacauuuauuacaguuuguugcacaucaguuauguaauucaucuuccacacuaaaacaugucuuucuccaaacagguaugggaucugucucauagcaugaaugcuccuaagaaaauagagaggacuuaguaaggguauaaaugagugaauauuucauugccuuuagugagccuuuuugcaauaacugccuguauugauuauuuccuagguauaucaaggagugaagaaagauggcuuuuuacaaccucauuuuuuggcagaacaggauauaguuaucauuaccuaugauguacugcguucagaauuaaauuaugucgauaucccacauagcaauagugaggaugggcgucgccuacggaaccagaagcgcuauauggcuaucccgagcccccugguagcuguggagugguggaggaucugccuugaugaagcucagaugguugagugucccacaguaaaagugagaguuucugcaaaaucuuuugagggcuggggaagaagggugaaaaggaauuaggggaccuugaguaguuuaauaguuuaagcauaguuaaccuguaguacugauauuggucaaaaguuuguuauuaaacacuacuugugcuuuucucuugugcuuugaacuacauaacccuuugaaauuaguucuguacucugugacucauugcucuauaugaaauauauauuuuucaguaagaugucuguuuauauaugaugcagaucaaaguaaacuguguuuaggaacuucuguaagcauuucugcuaacugggagcucaucguguagccucugauagcuuugaaccaaaguugacuuugacagucuuuuaaaucagaggccaaaugguaacagaaaauacuacuuuagaggacagaauuuugauucagccuuugaaugucauaugucuuuauucuguugucuuuggccagucuguaaccugaacugaauguaugaaucaugucuguuaguauaucuggaggauagagugaugcagggcauggaucaguuauucagggggcuuuuucauuuuguacguauuugaacuaccccucuguuuuaggggacugcguggcagccucccacuaaugagaaccacuguacuggaagaugguccauugaauaugacauucaacauugagugugauaacuguuaaauaaaaguagguacaucucaccagaaguguagcuuuuaaugggcuguuuuucaugaguaugccugacuucuguguucuuucugugguuuucuggauuucauuuuuauuucauuuuucccucucaucaggcugcagaaauggcccagcguuugagugggauuaaucgaugguguaucaguggcacuccaguacagagaggauuagaggguaauguaugguuuccucacauauugcaugcauuugaaaagcuucauuuuuuagagagaaaaguauuguuaugcuuaaccuuugcugcagucccuauugaagugaugauucaugucuuuauaguugacuccuaauaguuucaagcauuuaucuuuuuaaaugggacucaggugauuuuucuguuuauguauaugaggaccgauauauauuaagaggucucauugccuuaaguugaacaauuauuguaccugccuaaacagcauagauauaggucugaauuaaaauuagaguuccaaagucauagguagaaaacaaagaaucuaacccaaaaagaaacaaagggugggggggguggggagaggcagaaaaagagagaaagggaauuaauuucaauuaacugugucuaugaaaauggagacuauaauuuuuauugugugaacccaggaauacuagggccauaauuuuaguaauuauauaaguuauuaguagucuuauaaugucacacuauauguauauaccguuauuguuucuaccauuccuuuacuugagcauuuagauugugucuaguuuuuuccuccucuccacacgugcauugaaaugauccuucuaccuuaaucuuauucaauaucacaguagaacggacacugcauuucuaaaaccuuuauucaaguugugaauaucuaaaaugaaaaguuuaaaucuuguuuuauguauuucccuaaaaguuguuauuaaaguguaguuaaauuacaaaauuuaaacauacuuggaguucuguaguaaauacucaucuucaaaacuuaucuuucugaaaauccaaguuuucguauguuuucagcagcauaacucacucugcuaaaacaaaaaucucaguauccauuacuuugaccuuuaaaagcaguguuuuccaaugauuauuuuuaggaggaaaagguuuucuaguaauauuuucuaguauauauuuaaauauuugcaucacuuaaauguuacauuuagauacauauuuauagaauaauauuacguucaguaaaggaccacauuuaguggucuccuuucauguuuggaaacugucgaaauuguaaauguuuaggcguuaauaaggucugagaucuuacccagcucaaaaguuagcugagaggguacagaaaagaguacaugacuaucagaguuacuuuuucucauuuuaauguugagagaguaugagcaauaauuucuuaguuccugggucgguuuuuuuggagauacaagauguuggcaaguguuuugagcaccugucaccauucaacaaauuccuaauuuuuuaaaaaccaacuuuaaugagcuauuuggacuucauugagauauaaaugacauauaacuaaauguuuaaaauaccacauuugaaaaguuuugacauguauuuguagccaugaauauaugugcacaauaaggcaaguuucgucguguuccaagucagcuccaaaagagcuuuuccagacuuucuagaauuuugucuuucuuccucacuuccauaucucucugguaucuuucugauucuugcaauuaaauguuuuuuuucuaguugucacacuaggaauguuagccugcucaugacuuacucuguuguauuuggacauggaagucucauuuguuuucuuuuugugcuaaacuaggguuucucaacauuggccauauugacauuuggggccagauaauucuucuuugggaauuguccuguaugcuuuaggauguuuagcuucuacccacuagaugcugguagcacuccuacaauucugacacccagaaaugucuucagaaauugccagacugaaauaaugucaucuacuugggaugucaaauauggaagaaugcuuccuaacuccuuccacccgccacacccuaugucuacauaauguauucauuuguauaauauagaaagcauuggcuuuggggaauauaaaaacugggguuuacauccggacuuauuaguuguauguccauaaacaaauuccuuaaacauuuaaguccuuauuuuucuuaucuauaaaauaagguguuuuaaagaugaauuaugaugaaguauacaaaggauuuagcacaguaccuaacaaauauuaaauauucaaugaaugauagcugccucuacuucuccuuuuguuguuuuuauuuuccauuuauguagucauuuauuuauuuuaaugucuucgaaaguauugacuuuaacaaguacuuugugaugcauuuauuauuucauuuguuauuauuuauguauuugauuuauuucuuugugagguaggauagaaucucagucagauuuuugcuguuaggauaccacagacuggauaacuacaaagaagggaagucuguuuaacucgcaauucuagaggcuggcgcaucuaagagcaugacacuggcaacuggcgaggaucaucucaugguggaagguggaagggaguacaugagauagagagaagcaccaggggcuggacucgcuuuguaacaaccaacccuugagauaacuaacccgcuccugcaauaaugacaauuaauccacucaugaggguuccacccucaugacugagucacauauaauuaggccccaccuccuaauauuauucacuggaguuuaagcuucuaacacgugaacuuuugggggauacauucaaaccauagcagaugaugagcaaaaguacauacgaucccuuaucuauugagcuuacagcuuagaggagaacauacauuucuuaaaauguuucuuaaauacuuagauaaauauuaaauugcaauugagauaacuuucacaaaugaaaaaaaggaaaauucuaacuauaacagguuucauuaaaaaaauaguuuguucuauaacaucauacaauugggaugcugacaacugagcugugaucugaaacauuaacaugagcuagguaaagaggaaaaggaaaaauccucuauuguagaggaaacagaaaauauuaauguaaauagaucauguggcagaaauagcguggcuagaauguaaagagcuagggagaugaugguggauagagagacuagguagguagagaugggaccauggaggauguuauuugccuuguuaaagaauuuuauuuuuuuucuuaagaguaguaggagcuauugaaacgauuuaaacacagugguugggggucauuuugugguuagauuuguauuucaaaagaucacucuaguugcaguguggagaguggcuuagaagaggguaagaguggauguuaggauauuaauugauugucuauaagaaguaaucuaggcaaguggugcuggcacuuuugauuuggacuagguuuguccuaaagauaacagaaaaaaguggauaaggcaaaauuaacaagccucagugacagaucaggagauaccaagauuucugacuugcauaaauccaugaauggugacugguuuccccagugaauacuaccagaaaagaagcaugggccaguggcucacacuucuaaucccagcacuuugggaggcugaggcggguggaucaucugaggucaggaguuugagaccagccuggccaacaugaugaagccucgucucuacuaaaaauacaaaaauuagcuggacaugguggcagacgccuguaaucccagcuagucgggaggcugaggcaggagaaucgcuugaaccugggaggcagaaguugcagugagcugagauugcaccguugcccuccagccugggcgacagagcaagacucugucucaaaaaaaaaaaaaaaaaaaaaaagaugaagcaugugugcaaaaagauuaugaauuugagauuucggcaaguugaguuugagacggcuuugggaccucaaaaaagagguaacauauagcaauugaauugauuugagcuaaaaauauaaaucuguggaccuuugcauagcagugaugcauugguucuuucagauguugcuaacucccagcaaccaucaagguaacuuaauucaaucuaaauauuuguugaucaucuucagaauaaguguuguaggugugggaaggauauuuuuauuauuauuuuauggcuucugaagagaauauaugcccauugugaaaaaauuugaacuguacauaaaaguauaaagaaaauuacaacccggacaugguggcucacaccuguaaucccagcacuuugggaggcugaggugggaggaucacuugagcccaggaguucaagaucagccugggcaacauagggaagcccugucucuacagaaaauaaaaaaauuagccaggcaugguggcacacaccuaugaucucagcuacuugggaggcugagguaggaucacuugagcccaggaaguugaggcugcagugagcuaagauggugccacugcacucgagccugggcaacagcaagaccuugucucaaaaaaacaaaaagaaaauuacaaaauuacacucauagucuucauuugaagaucuuuucuauauagauguuuauauauuugagcuuauucugcaugcacaauuuuauauuccuuuuuuuuuuuccacuucauauccaaagcaguuuuucauuaaguccucacaaauaaauauauggaaaacuguuuaggguauguuaagugggcagguggaggggaauagaauauaaaauugacugugcccaguaaagagauaaacaagaagucccaugcucuaaagcuaacaaauacaaggcaugcugaaucagaaaagaaaaauaguucuauuuugugggauuacuauaauuuauuuauuugagucauuuuucuacauauuguugcuaugaauaucacuguguaaguaaaucuuaucuauauuuuuauuacucucuuaggcuucuuuucuaggagaauuauuagauaaaggguaugagaaauauugcaucagagaauauucuucaugucaucugugugcuuagaaauucuuuuuuccaauccagcaaaucuugcaucuauugguuucagagcaugguauuucuuauauaugucuuaccaaguacauucaguugagugguuuuuugguuuaacuucugauaacaguuucagauuuuugaauuaaguauaagcuguauguaaugaaugguugcauaaaucuaacauuauuuuagcaccuagcccaaaaccuagggcagaauagaugcucaauaaguauaaauggaauuggaauugaauuucagauuuaagagccuauacagccuguauuuuaauucauggaaaguucuaugugcuguguaaugucuguagaaaagcuucugcaaacuaguaaugaaguaauagaguuauccucaauguauuuuauuuuuucuuuucagaucuuuuuggguuaguggucuuucuugguauugaaccuuacugugucaaacacugguggguucgacuucucuaucggccuuacugcaagaagaauccucagcaucucuacagcuuuauugccaagauacuguggaggucugcaaagaaagaugugauugaccaagucaguacaauaaguuuuuauugauaaagguacuauaagagaaaagaaacaauugggauggaaagauaaauuuuuagaugauaucuuuuuuuuuuuuucugcuccuuuucacagauccaaauaccaccacaaaccgaagaaauacacuggcuccacuuuucuccaguggaaaggcauuucuaucaccgucagcaugaggugugcugccaggauguggugguaaaacucaggaagauuucugacugggcucugaagcucagcagccuagacagaaggacugucaccucuauccuguauccauugcugaggcucagacaggccugcugucacccacaggcuguucguggagaguucuugccacuccaaaaaagguuuuauuaucaacuuuuuuuuaauugcaguugguauaucauaauagacaauauuucaggcccacgguuucauucagagacauguaacugaguugucaguuaucuuuaaugguguagaggguuuucuuugguauggaagcucauuugcaacggagaauuaccagaauuauuuucaugguuuuaagcauuucucuuuugcaguggguaugguguuuuuuuguuguuguuuguuuuuuuuuguuuugagacggggucucacucuuucccaggcuggagugcaguggugugaucauagcucacaguggcagccucaaauuccugggcucaagugauccuccugccucagccucucaaguagcuaagacuacaagugcacacugcuacagccagcuacuuuuuauuuuauuuuauuuuauuuuauuuuauuuuauuuauuuuuugagauggaguuucgcucuuguugcccaggcuggagugcaguggcacaaucucagcucacugcaaucucugccuccuggguuccagcaauucuccugccccaccccuccaaguaccugggauuacagacaugugccaccaagccuggcuaauuuuguauuuuuaguagagacgggguuucaucauguuggucaggcuggucuugaacuccagaccucagguaauccaccccucucagccucgugcugggauuacaggcgugagccaccacgcccggccuguuuuauguuuuuguagagacagggccucgcuauguugccugagcugauccugaacaccuggccccaagcaguccuccugucucacccucucaaacuguugggaugacaggcaugaaccaccacaccuggccuugaacacuucuuuuaaaauuaggauuauuguugagguuuuuuuuaaaauuauuuuguuauuuaggguuuuggcuguacuccagauaugaaaggcuuuugcucuuauuuuauuucauaguucccacaucagggaguuagauuaccguuaaauauuuucuaucucucugauuauucauucugagaacauuaagaaauuuguguucauaauacucuauugucccagaaaguuuuugugaaucagacugcaacucaggaacuggccuuuggcuauaagagauagaaagaggauucaguuuugucuuugcuuuuaagcagguuauagacaaauaagggaaaugaugaaaauuauagauuucuaaaauaugaagugaacauaguaaauuucaaaagauauaugaacaaauugcuguguacaguuagaguccgaaaacaauuuauauaugaaugguuaagguuagacagccuuuugaaggaauggcauuuaaccuuagaggaucuucauuuuuuacugauuaaaaaaauauucaggcucaaagagguuuucuaauuaaguugcagugcugggauucagagucagucuuacauguuaauaccuguaauguuucaaauaugucaugcuguacuuuguacuugaggaagauuuuucuaguuucauucucccuuuacugaaaugggaaaaacuuaaagaaggaugugaucaaauaaagguacuuaugugggaaaaaauaaugguaaaaauugaggcgaaaaaaaaugcuagagauaccacaaaaacugcgagucucauacacucuugaucaugugagauauaacacucccacugaagucacacuugggauuuucuuucuaguuuugaacagucuaccuuuucuuuuagcaccaugacaauggaagagcugcugacaucuuugcagaagaaauguggaacugaaugugaagaagcacaucgacagcuaguuugugcucucaauggcuuagcaggcauucauauuauuaaagguagaaggugauugcuuuaucucugauucuuucaaacacuuccugaggaagguuaauuauagaaaaaauagauuuugauuuuugggggggggauuuuucccccaaaaagauacucucacacacuacugaauauaguuuaaauagguucaacuuaauauagagcaguuucauagaacguuuugaaaaccuucaaaguuuacauaugauuuaaccaaacauuuccauuuuuaguucuuuuuuaaggaaaugaggauacacagauuucccuugaaguuguuaaucuuagacuuuaauaguuuaauaguaaacaacuguaaacagucaaaaugauuagaaauagaaaaaugguuaaauuuugacacauuaaaggaauuauuguucauugguuuaaaaauaauaguuugugggaucauuuuuucagcaaauauuugugugccacaucugaucuagguaacgaugauaugguaaauaaaguaacucugaucuugcagaccuuaaauucuuacagagggugacaaguacacacacacccucccacacacacacacagaacguauauguguaaaguuauaguguuauauauuaugcacaaaauuaaagcagguuagaaagagcaucuuauauuuacauggaagaguauuaguggcuucuccaucucucacggaucacuuuuuuugcauuaggucuaauaucuuacaaacugucauuuuguauauuuugccuguuauuguaguuuuugcagggaagaguaaauccauugucuguuacucuaucuuggcuggaagcaaaguuauauaacuggcacuuuuaauaagcaccauauagacacaccuuuccauauaaauaugagaaacauuaaaacuguauuccauagauucaagagugaagaugaaacauguuaaguagaaaccuugaaaacaugcaaucaaacuucuggaaaucaaaauuucaaugucuaauauagaaaauucacuuaauaaauagaagauuagacaccgccuaagaaaaaaaucaauaaagucaaaguauagaauagcaauagaaacucuccaacaugaaaaacgaagaagacugaaaauuuugaaaagagccucagugagguuguggacaacuucacauggccuaauauaaauguauuggaguccccaaaggaaaaaaaaaaaaaagaaauauauuguggguuuuauaucauguaaauguacaauguguaaaagcaaugauacaaagucuguguggggagacguggauguauaauauuguaagauuauuauccuauauaugaagagguauaauauuauaugaagguagacugugugugacaaggcaaagaaugugcacccuacagccaccacuucaacauacaacaaggaguuagagguaauaauccaaaagaauagauaaaaagaaaaaauaaaaaaucaggccaggcacgguggcuugugccuguaaucccaguacuuugggaagccgaggcaggcagaucacaagguuaggagauggagaccauccuggccaacauggugaaaccccgucucuacuagcugggugugguggcaugcgccuguagucccagcuacuugggaggcugagacaggagaaucacuugaaccccggaggcggagguugcagugagcugagauugcaccacugcaccccagacugggcuacagagcaggacuccaucucaaaaauaauaauaaguaaauaaauaaauaauaaauuaaaaaucuucaaaaaaaagaaaaaagggugcaaaaaacaaaugagaugauuagaaaacaaacagcaagaugguagauuuaaaaacaagcuuaucagugaucacguaaacugaaauggucuaaauaucccaauuaagaggccuggauugucagacuggauuaaaaacaaacaauaaccaucaauauguucucuauaagaaaccuacuuuauauuuaaagaugcaaauguaagaggaugaaaaaagauauguuaacacuaaucaaaagaacgauaaagccacuauauuucuaucaaguaaaacagauuucuuauuaauacugccugcuaacugauuguaccacuggaacuuauaaaguagauuucagagcaaagaauauuaccaaggauaaaggguguuacuuuaucacuagagaaaaaaauucuaaauauuaacguaccuaaaacaagaguuucaaaauaaauacuaaaaacugauagaauuauaacgagaaauaaacaagugcguaauuauugucagagauuucuacaucccucucucaguuauguauagaauaaguaaaaaauaagugagggcauacauaguucaaacaccgcugucaaccaguugaccuaaucaguguuuauugacuacccaaccaaagaggaauauacauuguuuucaaguacacauuaaauguauaugaagauagggcauauucugggcuguaaaacaaggcaguaaauuucaaaggauucaugcuuacagaguguguucuaugcccacagugguagauaccaauaacagaaggaaaacuggaaaguccgcaaaugcugugaauuaaauaacacacuucuaaaccuuuggguuaaaaaauaaaagggaaaguaggagauacuuugaagugaauaaaaaugaaauaucaaaauuugugggaugcagcaaaucaguuauuaaaaagaaauucauagcauuaaacauguacuagaaaagaaaaaaguuucauaucggagacuucagcugcuaccuuaagaaauuuaaaaaaaaagagcaaaugaaguacaaagaaaucaguugcccaaagaaaugugugcuuuuuguagaauauaaaucuucuuacauuaagccucuuugaguagcccgucuguaguuguuagcucuuuagcauaauagaaccagaaauggaaagugucucuuauugugcuagauacuuggguagaguuauaaggauucucagaagcugagcagaaauagcucuagacaagaacugaauagggugggccuacuuacaugcugcaguuggaacccugugaaaugguauauauuguucaagauuuccgaacuucagugucuuugucaauaaaauauuacaggugcuuuacuuaccucaacuauuguucuuaauacaaaauguagaagcacauugaaaacguuauaaaaacagagaugaagaaugauguuauugguuaugguaauaugaagguuaccucagauucuuaccacuuucaaccugcucacaauguaaauucuguuaucaauaucuaauagaaaagggccuauuauuauauauucguguuaaauuguucacauauaguacacguaacuuugugugcaaaucuucccucuagggcauucccuagaaaguccucaauuuagcuagcaguguauuguugauuauuaagagaaauccgccaccagaaaguccauuaauagaggauauguuccuucugaauuguaauuuucaacuuaauuguaauagauuugcugcuuuuaguuuuuauuaacuucauaguaauguguuaaacaauauucauuuuuuaaaguaacauuacauauauaacuuacauaaauuagauucuucuaaugugaagaucagacagugaaggucugacuuuuaaaagaaaucuaaaauuaauuucaaacucuaaaaagauuugcuuauauuauauguaaauaaauacguaugauacauuaauacauauucugagauucuccuugacugguauuaaacacauuuuauuauuccaauuuugaacauuguguuuucugcagaugauuuucggagaaaauuagcuugacaauaucaaauccaccaguuuucuuagaaauguuagcgccaucaaguggcugagaauggguauuuccaaauuugacuuaaaccuuuauaacauugaauauggguuuuuuuuuaaucuuccucagaaagcaugucuuuuuaaaaauaaacaugcaaaaccagguauuauaacgaauagauaaaauucagcugcuuuacauuauaguuuaaucacuauaccuucuuuaaaagguaugguaauuaugaagagaaaauuguuaauugaauuauucucuacaaaugguaguauaaauacugauagaauucauaauguccuuugaaaagcuuuaaucaagacucuuaacuaaaaaaagagaacucacugugaagauaauugaauguuaaugccuacguuauaaaguaacuuuauuauugugaaaauaaucuucucccuuauuuaaagggaauagaaauuggcugacuacaguucuuugauaauguguguuuuagaaagcuuuguauuagcuaacuaauagaacuagauauaaagcaaugguauaagagcuauuguugcaaaauuuauuuuaaauuagguguuuugcacaacacugaauauacauaaugccacugaacuacacacuuaaaaagggcugagaugguaaauuuuauguauauuuuaccaaaaucaagauauguauguaaacuuauauaugagcuaaaaacagaaccaacuucaaaauuuacaaagguuugcauauauauauauaucucauuguaacuaugaacaugguccuaauuacaugauauucauaaaaccagcuugaaguuuuuuuuuaaaagaaaguaugugugauacuuaggaaaaaaacuuucucagcaaauaaaagcuagaacaucuuguaccuuuuuuugguauggauugcaugguuuugccaguguuagguuuuuacuuuaauaguauuuauaauuuaccugucuugaauuuuacaagcagcaguuaagauagauucuauuauucaagccauuaaaaauguucaucucuuacuuuauugagauaucaucaaacuuucuguguaaagaagcagauaauacauaggcauugcaagccauaagaucucugcgcaacuaucagcuuggcuguuguaguacaacagcagccacaggcaguauaaaaacaaaugagcagagcuagguucuaauaaaacuauggacccugaaauuuaauuuucacaugucacgaaauauuuuuuuugaauuuuuuucaacuauuuaagaauguaaaauucauucuaagcugaugugcccaacagauaggcagaggguagaaaugacccaugggccauacuuugccagacugugcuuuaaucgauacuuuuugaauugcuuuauuugaaugaggugcugauuaugaacaguagaaaacagcauacaucucagaccaugauuugugugaccagaagaagagggagaucccugaguuucugacaugaaguuuuuaauugcaaauuauuuggccuaauaccaagaacaauaauagcuaccaagaauacuauauuuuucugaucgcuauguguggguugguuggagugucuuaaauuuuuuuuuuaauaaauaaucuauaauuaccuuaaguuuauccuuaauuucaaacaucauaaugacuacugauugccaccuuuuaacuucagcaagaggaaauuuuuuugucuaaauuaaaaguuuauccaauagcauaaucucaaaacauuacaaacguuugauuauaaacauauuucaguauaauuuuaaaauauuauaaauguaauauaagaacauuauauuccauggaauuaaaaaaggaacuguacucagccuuuuuuaaaacuugggcaaucauauuaauaccaagucaaauuucuuuacuuaaaaaaaguuauaaucauuacauuuuauuuuuacaguauucuuaaauaauggacaacuagaugacauugggaacuaaauaugugacucucguaugcuuuaaauacauuuuaauucuuuaggugaguaugccuuggcagcagaauuguacagagaaguguugcgcuccucggaggaacacaaaggaaaacucaaaacugauucacuucaaguaaguaaagacuaaacaguuucauagguauucuguuuguuuuuuuaacaaaauaauuuuucugaauguuuaagaggauaaaugguaacaaacagucauaaucacugggugaaacuugggauucagucuucucaauaagcauuuuagaugauuuguauguacacuaacauuugagaaucacuacuauuccauucagggaaguuuugggcacaagccugacaagguaagucuauauaagcuacaguuaaaaauagcucaaaguacuuguacuuccaagaguaggucaguuuuaucacuuugacauaugaauaucaacauauuuauucacaugguuuucauuaaaaagaaaaggaacuaagcaauaaaaucuaucuaaugauaauuuuuagaggucuuuagggagauuuggauauuuuaauuauaacacuuauuucucuuucccuucuuggaucugucauugacucauauagacaaggcucucuagcuaaauaagaaguagaaauggguuuauuaauuuuggcaaguuuagguuugagucccagguaagaugucauuaccauucacaauauugaccuugggacugacuaacauguucacaaguaccagaguggauauuuagaggaacauauggaaaaguggagggagaggaaaaauuaaauauaaaucugauauucugcauggauaaggguuacaaaaggcagguccuagaccuuaacacccugcccuugaguaaagaaaacaaaguaguaguacucagauuuuuuuauaggaaaaguauuuggugauaugaucuuaaugugguguuaguguucugugugccauauuaauauuagguucucuucagagucuucugcauugacugucauaauuacugccuuugauauguuuguagagacuucaugcuacccauaacuugauggaauuguugauagccaggcacccagggauaccaccuaccuugcgugauggccgacuugaggaagagguaauuauuuuuuucauucugucuauaaaaguauauuuucuucaaacuuuaugcuccauauaguugauauauccuaggacauacaacauacaaauaaauguaaucauguuuuccuguuacuuugauguuucgaauuuuguugugauuuuggguagcagagaauggcagcaguacguauuauuuggcuucucugcugaucuaccugcaguuaugugauaaaugcuuguuguagauauggcuguugguagccaacagaaugggauguaaauaaaugaguuuuaaaaaagaaacuuugaucucauggcagaucuacaaaagagguagcuuaguaaauauacaaacuuuugcacuuucuccacauuucuguguauuuuuuaaggggguaaauaaagucaaauuuuuggugguaguucucccaaagaaguuuccucuacaaaaagugucgccucuuuuugaaaagaaugacaucgaaaagagugauauuauaaauuauuuuacuauaaauuguuaauagcuuauuaugcagauucuuccagggauuuuugcuguuguuaaacauuaaagagcuaaaaucaaaagaguagguauguuugaaauguauugaaccuguaaguggaggcuuuauuugagucaacaggauaaaaaaugagauuauauaaauaagcacagccuuuuugcacugguuguuuugggggcggaggugcccugguaaacuauuuuaauuaacaaaaauuuuaucuauucaugaguagagacugauguuuugauguauguagacacuagaauagcuaaaucaaacuaaaucaauuaccucuuuauuuuuauugcaugcauguguguguguguguguguguguguguguagugagaacauuuaaaaucuacuuucuuagggcuucagcauaugaauuuuggggaaacaaaauucaguuccuaacaccuguguuacuguguauucucaaggauuauuuuuaaacugcaguaacuaaggaauuuuaauaacuaaauuagccaaauuuuagaaaggugucuuugcuuugccuaucauuugaaauauuacuguucuuuuuuuccccucuuugcuuauucuaacuaaaaaaaaaaauuaaauaagaaauuggcaaacaaauauucgguguuucugaaauuuuguuacuuggacaaguaaauuuuguuaacuuccauauauaaggaauuuuuagcgugacuuuuauguucucuacaguauacuuggacuuuuauguuuaaaugcaguuaaguagcuuuaaauguauaaaaugacccauucuucuugaaacaucauacugaauuauauucuagauugggagugaaaguuuauauucucuguuucaacacaggccaaacagcugcgagagcacuacaugagcaaguguaauacagaaguugcugaagcccagcaagcuuuauauccugugcagcagaccauccaugagcuucaaagaaagguaugccaaaaugcaguguuucuuacuuguauuugccuccagauaucauuuugaguuuugguuuuuugguggggagaaacuugaauuucuuauacauuuugaaauccuuagcaccuagcacauugccugacccacaauacaaguuuauuuuacuguuagcaaugauuuauugguugagugaacagaugcauaaauaagucaacuauuuugaguucucuuucuuuugaacucauggguuuucucuuaccaugaguauauaacaguugucuuuugaagaaaguaaagacuucuauaaccuccuuuuuaucuuguuucugagauguuuuaaaauguuaauacauuagaaccacagguauuuuuccugcagaauauauaccacuugucauuucuaaaauuucaguuuuaugaaaucagcagcaaaaucuaaagagguuacacaaauacacuuuuauuuucaguuuuuaaaucagguguugcaaauuuuugucuuucuaauucauucauuauuuaguauucugggauauaauuuugugaguuauuguggauuauucauuaaguagaaucugguucaguuaguuaaagauuagaaugaaggcuuucuuucuuaugcugauaaagagaccugugaccuuuucacacauauagauugaguauugaauuuucauuuggcguaaacaguuuuuuuaguuacagcuuuguuauauaaaugcauucaauaaauucccauuuauccagaguaguuaggaaauagggguuucucuuuaauuauauuuucaaaagaggaagcgagcauuguacauggaauauguauacucgucuccccucugugauagucccuuugagaauagcauuuauuacuuucuuugaauuuuggcaucacccugcccagugauggaagcuuagugaguacuaaaaaaaauguauuaauugauuaacugcuaccuuuuuuacagauucauucuaauucuccuugguggcuaaaugugauccacagagcaauagaauuuacuauugaugaggagcuaguucagcgagugcgaaaugaaauaaccagcaacuacaagcaacaaacuggcaagcuuucuaugucagagaaguaagaaaacaggaagaaaaaguaucuacucauaauuuuaaaagcaaagaaauccuuguauuuucuaguuucuaauuucucauuauuaccggcuuuuuuucuccauucauaaaccuauacagacacauucauacuucuuuuuugcagccuuuuuuauucacaguuuaucaaaaugguuauagguacuauaauuggguuuaacuccuaacugcgaccuaccuuuguuacuuuaguuacuuuaauauuuuacacuucauaaugugagcacauuaguaacuauugaaauuauacaggaaaagugcuuggcaaagugccucguauauagugcauaauuacagauuuaauuaaguauauauacauauauauauauauucaaccaaggaauauaacucuuagccauuuuucuucuuucuucccaauauucugcuuuuauguuucauccugcaggcaccuccucauauagagcaaggaugucaggaaggcuaucuguagucaggcuuaaaacggaagaauguggcagucguacacuuucaaagauaucugagacagacauacauuuuucaugcucuuuuucaguuccugagcacaggacuaucaaauuuuuuugguaucuuuuacgguagacagcccaauauuauacuuugaauacauucugaaggaaaacucacucaaauguugcuguuaaaaaaaaaaaaaacagcaaacaguuucuuuaacacuuuguuuggcaaccauucucugaauuugaggaaauugaccuauuauucuuuucuuuguauuguguguggugcuggugugggaaucagguuccgugauugcagaggucuucaguucuuacuuacaacacaaauggaagagcuaaauaaaugccagaagcuaguaagagaggcuguaaaaaaccuggagggaccuccaucucguaauguuauugagucugcaacagucugucaccuccgaccagccagacuuccucucaacugguagguaauagaagaaaucauacaaugaaaugguaccauuucuuuaagcuagauuucuuagagaagaaacaauugacucauauaguaaagguuuuuucauuuuaauugagacagaaguagaaagagauguauuaaucuaauuuaaagaaaaauaaagucucaaggacaagguaugaaaaaccaugugauuuguuuuuucuaaaauggcauaucuaguggaaagaaaaaugaagucaaaauauuaagcuucuccuuaaaauuaccagauugcugguuauguuugugaauauuucuguuaaucucuuuuuuuucagcugugucuuuuguaaagcugaugaauuguucacagaguaugaaucaaagcuauuuuccaacacguaaguucucuauuugauuauuacccaucaagaaaaugaaacauuuugcaagacucaguuaugugauauaagacuauguuuucccccacaguaaccuuuauuauauuguuucuuuaauuaaauugauuaguacaccuuugguauuugauuguuuaauaugcccaguuuuaccuauccagaaguuauccccuaaauguucauaguguaguaauauauaauuaauugagaugcaguuuuguggagugguaaaaucccagacucuagaauccaguggauuugaauuauacagauuuugcuagcauuuuacugcuauucaagguagaacucauaauguccggcauaacuucuucaagaauaaagaaugacacaaucaaauauguuauuacuuuaaugaaaccauaaguaaacauugucacaaacaccuggauucucagagggaagcuuguuagaacaauaaauguguccacuuucauccagguguauuacuauucuauuuuaggucaaaucuuuuucuguuauuacugaaguaaauaauacauuucuucauguuucuguccaaauucuguuuauuuaucuccaacagauauaacuucucuaaaauagaaauuuuccucacauauuuccuugccaaacguucacuucugcaugucaaggaagaaaacaagauuuuuguguuguuauggcaaaugaaucaguagcuuucuguuuauuacaguggauauaauagaauuuaaaaaaaaaaaaacuggccaaauuuaugauguuuucagcuuuuucaagguugcuuugguuuuuccaaagacuugcaaacauguucuuuuagaacucacauugaagguugcuuuucacucacugauaccaguuacuguuguuuuguucugguauguuuucagagucaaaggccagacugcaauauuugaggagaugauagaagaugaagaaggacugguggaugaucgagcaccuaccaccacccggggucucugggcaauaagugagacagagcgaucuaugaaagcaauacuaucauuugcaaaaucacauagguuugauguugaauuuguugaugaaggaagcacuucaauggaucucuuugaagcauggaagaaggaauauaagguauaguauuuuaaaacuuccuuccaaaauuaaaaauucuucuuuuuuacaucaauuuuaacugcuacuuuuuucucucuccaguuuuuuaaaaucuucuuuugagauugagguggcauaauuucucuuugccugaaauguaacuguuguaauaaaggauagcaaauaccauaauacucaaagacauucuauuuauuaaauuacuaaaagaaaaucauuauuaaacuggaacuuauaugaaacuuuuuguuuagccgugaaaguguguucauucuauuauuagcuugaucuuccacugcuauuauaugaaauuagaguuuuguuuuuguucugugaauaacaagcaagcaucagcuaccuuaaagauuggggaacauaguaaauacuucuuauccuauaaguuuggaaaccauuccaauaaauaaagcccgauaugcccuuucauauuuguacuuuaaugauuccaucauauuauaccucuguacuugagauuucacaauucauuaauuuucaauuauuguuuuauuuggauuaguuauccauuguacugcuuuacaggugacauagguagaggaaggaaagaaguguuuuuuuauaaugacauuuuuauucaauuucuuuuuuaaaaagucuugcuuuuuaaaguaggauaaaaauuuuuaugcagagagauaguuauuuguacuaucaguucauaugucauaaauuggggaauacauuuauaacaucaaaaucauugguuuauaauaauguuuuucucacacauuacucaugugaauacaaagcacguuaacacaguuaauuacaguaagccuuggaagaaguguuacuuaugauguucaguugccccuguauucuuccuuucgacucaguuuggccacauacccuuuguccagaagagagcuuacugugcaguucucccaggucuugguacauauuuucugcauaacuuugcagaccuuuucacagaagagcaauugaaugagcuccugcuguacauaucuaccagaucuaccucaaaauguaaagucagugaagagagccugucaaaaaauguauacugauugauaccauuucugugaauuucagaaacauauauaacugaauuauuaagaauauguuucacauaguauaaguucaaugaaaaguguagcaggauaaguacaauucagaauagugguugccccaugguuggguacugaaggaggaauaugugaggaaagagugauacaguugagaaagaacacacagagccuuuccaaggaauucauauuauucuuucuucaauuaaaugaugaguacuugauuguauauuuuaguauucuuguugccauuuauacauaguugaauaugugaaauauguuauaauaaaacuauuuuuaaaaaauaaaacaagagauucugucagccuaaaacuggacuuuauaaagauuuuuggucuuagcaagaaaucuuuauauucuguuacugagaaucuaaagaggcaguguccuauagagauuuuuuucauucacauuucauccuaaaaaugaccccaggaacuacuuguacguuagacacauagcgaaaaaguguaagaucucauugaagacuuuugcuuaaggcacaucuuggugguuuuaaccaguuuuaauuacaugcuuuaccacuguguuugucuuuucuauuccuucaguugcuucaugaauauuggauggcucugaggaaucgugugucugcuguugaugaacuugcaauggcuacagaacgacuaagagugcgugauccuagggagccaaagccuaauccgccuguucuucauaucauugaaccacaugagguaauuggcaaguaaaucacagaaaagggaacagcaagcagaugucacagauaucuaagacccauagaaaaggcagaaucagggcacugagcucuacuguaaguguguauuuaaucuccauuuuuaauuugacccauagaaaauugucuuuauagaccaaaaauggucaaagaugagcaauuucauaucuauuacaugcuuaguguucacuauuuuggggcaucuuguuucucuccagguugcgcauucaucuguuuuugaguuuaaaaccuuguaugugcuuaagaccaauagauauucucagucacuuuuuagacauuuuugucaccucaguuuuaucagaacuagaaaaaucuuccuuaaaaacaacugaaaccuuuucuuuugcaguguuucuuuugcuaaugaugaacuaauauuaacaacuuaccuucuaauaacuuugucuuuguaacucagguuuaaaagcauuacuccaccaaucucuuuuauucuccauuaaaagauauuauuuccuuuauaauucauuuuuauuccuuauuuguuuagugccuuaagucuguuucuguacagcuuggagacuguaacuuggaaaaauguagauauauucauuauauacuaucucacuuaaaugugaauucugaagaaguuuuucugagaaaauaaauucgucuuguuugaguguuccuucucugucugcuguauucuaccagggggacagaggaaagaagggcagagaaauucuuuccuggauuucaugaaaucacugaggccagagcaacagaucauuuaacuuuucuuuaucccguguauguauuacugaaaaaaaugguacauaauagaauuugaguuuauuuuuaucugacuucagguacauagggacacuuccuguuuaaaagaacucugcauugaauugugccuuucauaaagcaaaaaaaaaaaaaaaucauuugaaauauauuaucuaguauccauuuugaaaacuuguguuuuagaauguaaauagguuuuuuuuaaaaacaauacauuuguauuacuggagaauuguccauauuuaauauaauuuaacugucuuucugaaagaauaaagaaguuuuuauuuuuauuuucuuuagguagaacaaaaccgaauaaaacuacuaaaugauaaagcuguugcuacaucacagcuucagaaaaaacuugggcagcuucuuuaccuaacuaauuuggagaagguauuguuucuaagacaugcuacuuuuuccuaugcugcauuaucauaaaccacuuuagugacuccuuucauaauuaauggugcaaauuguuguaauuaguauuugguguuauaugagucagaacacuaccuaugucucuacaauagcuucagagaucacaaaagaauauuguaucuauagaaauuuauuaugcagaugauauagaaggcaugcacucgauaguagagaacaauguaaauggacuguaguucaaagccuugaauaguaaaaguauuaaaacauaucucggugaaacuggcauaaugcaauuuauacacaugcauucauucaucaauacaaaaauauguuguaauuuguuauuugaaacugaaguguguuucgaaagcuacuaaaucagaguacaugguaauaaagguagacuucaaauauuaaguaauucaaaacacauguucugaguuaugaucugaguauuauacuggacacugaugaauuggugggucauugauuaaauauaauuucauuuuauugcaggaaucauauuuugcuaguuggcagagaaccuucuaggggcaagauauaguaguaaauauuuggauagggcaagugaggacaagauauagauuugaauucuucuggaaacugguauaacauauacuuaagugaaucaguaaaucucagacaaaaugaaaaguuagacauucauuauagauauagcauggcgacuaagaagguagacuuuggaacuggacagcccaauuuugaaucgugacucaacuguuuucuagauaugugacuuuauuuaaguuauucaccuuuccucgcaucaucaguaaaaugagaaugaugucaacacuacuuuauaguauagggcugucuugaggauugugugaauuaauacauguaaaaugcuagaguaguuucugaucuauuaagcacuuucuagguuuuugcugcuauuaauauuauuaagaucauuauuacuguuaugauuaccaacacuuauucugaaagauaaaaagaagaaaaaaauuaaaaaguuucaugcaaauugcuaacauuaagaagauaacacaggcugggcaugguggcucacgccuguaaucccagcacuuugagaggccgaggaguuugagaccagccuggccaacauggugaaacccugucucuacuaaagauacaaaaaauuagcuggaaugguagcacacgccuguaauccaguucccaggaggcugaggcaggagaaucgcuugaaccugggagacagagguugcagugagcugagauugcgccauugcacuccagccuaggcgacagagcgagauuccaucucaaaaaaaaaagauaacaggaaaaaugucucaacauuccugaacauaaguuuuuuaaauguaagauuucuauacuuuaaauaugauagucaaaauaaaaagacaguuaucuuguacgucauuguuuauauguuaaaauauuuuuuaaaaccuaaaauuuuaaggauauaaauauucuaccuaagaaaauccaauuuggcuguuaauaaaagaaaaagcauuuaaucuauaaugauggaaaaucaaauuacacaggugcuauuuucugccaacaauuaggcacagauuuuuuaaaugauuacacaccccaguggugaaaaaggacagggaauggauacauuuuaugcauuaccaauggaaauauaaauuuauauaagcuuuucuuaaaagcacuuuaacaauaucugucaacaauuuuauguagguugaacaucucaaauccaaaacuggaaaugcuccagugagcauuuccugugagcauugcaucagcacucaaaaaguuuaugauuuuagagcguuuuagauuacagauuuuuggauuuggaaugcucaaccuguaugugaaagaaaggaaaaggaaaacuggacaacauaagaugaacuggaaucuauacaguaggauuaaaugaacauuauagaacugcagaaauacaguaucugaaaucaaaaacucauuggagaccagacacagaaaaagaugggauucaugaacucaaguacaguacaaaugaaaauacccaauuugaaguggcauagauagaaaaagaacaaaauagggcaaaagagauuugagacacaguuguuugaucuagcauacuuguaauuucauagaucuagcauacuuguaauugaaguucaagaagaaaagagaauaggacagaagcuugaagagauaauagcugagaauuuucuaaaacucauaaaauuaugacaaauaucuuaaagauucaagaaguucagaaacacuaagcagaauaaguaaagaaaaaaacaaaauacugccuagauacaucauagucaaacugcuggaaaccaaaaauaaugaaaaauagaaauaaaaaaaguugagagauaaaacauuuaauacuuacaaaggaacacuaauaaaacugguggcuacauagagauguuuuucuuuucaccuuuaaagauguuucgguauuuuccauaguuucucuauguaaccaguugacauuggaacaucuucaaaaugcuaaaagaaaaaaacagccaaccuagaguucuauacuuaaagaaaauuuccuuuuuuuaaaaaaagugaaauaaggauauuuucagacaaacauaaacuggaagaauucaucuccaguaaacacacaucacaauaaauauuaaaggaacuucuuuggauggaaggaaaauuauuucagauugaaggaugcaacuacaguaaggaaugaagaacaaaagcuuaaauauguagauaaauaugcaaggauauugacuauuuaaaagcaacaaugcugucuuauggguuauacaacuuauauagaacuaaaauauaugucaguagcacaaaggaaagagguaagcagaggauuauuaagauuuaauuuaauuuauuuaaauuuauuaaaauuuauuuuauuauaauuguauuauaauauuuauauuuauaauuauauauuuauaauucugccaaaauauauuuauaauuauauuuuauuauaaauuuauuuauaaguuuauuaaaauuuauaaaauuuauuaaaauaauguaauuauuuuaagauaauuuaaucuauuuuaagauuccuucagaggaauggacaagaaaguccguaaggauauugaacauuugaacacuaaugaacaaauaugacccaacugacacagaccauuacacccaacagcuucagaauacauauuuuuuagguguacguggaacauuuaucaaaauagaccuuaugcuaauucaaaaagccgcucuuaaaaguaugugagaguauguuuucugacugaagaggaauuuaaaccagaaaucaguaauggaaagauaacuggauaaaucccuaaaaguuuaauagaaauugacaggauacuucugaauaacccaugggucaaagaagaagucaaaauggaaauuagaaaauacucugaacugagugaaaguaaaaauaugugacagugcuuagaggaaaauuuauaacuucuuuaacuuaaggaucugcaaauuaccaugcaugggaaaaauucagcccgcugccuuuuuucguaaguaaaguuuuauuggaauauggucacacucauucauuuacguauugucuguggcugcauucaugccacauuaguggaauugaguuguuacaacacagaucauauggcccacaaggccuaaaauauuuauaaucucaccauuuauauaaaugucaacucuuuauugacauauuggaaaagaagagcuguugugaauuaugauagauuguuuacaaagugcuacagcaaugacccucccauucuuguugcucuuuggaacuccaugagacuaucucaaaaagccuaguuuacuuucuugagcagcagagcccucagcucagcccagcccucccugcagaccagauagccuaccaacugccaaacaugagcaugaggccaucauagaccauccaaccccagccaacucagcccauccccaaaucaccuguagaaucuugggaaucauauguuuguuuuaagccacuaaauuuguaggugauuuauuauauguaaaaaggaaaaguggacaacauaguaaaaugaauuggaaucuauaugguaagaucaaauggacauuauagaacugcaaauauauacauacauuauugauuuacuuauaaaaaucaauaauuaacagaggaaaagaauaauucauugguucaauuuguuuaaaugccuaaucugaaaaucuguuaccugaaaugcuccagugaacauuuaccuugauugucaugucagcacucaaaaaguuuggauuuuggagcauuucagauuucagauuuuggauuagggauauucaaccugugugauuaaaauuguuuucauuuuuuuguucacuccuugaauaaaugauauuuguaaggaagucucaggaauaaucuuguuagguaauauagagaucgaugggucaucuaaauuguuagauuauguaaauuguaauugccaguauucacuuccauaaaugaguugcaaaacauauaucagguuuuauauguaaaaacguaacuaauauauuuuuuaauucuuuuuuggauagucucaagauaaaacaucgggagguguuaauccagaaccuugcccaaucugugcucgacagcuaggaaaacagguaaaauuaugauaaacaucacaugcauuuauaaaauaccuuacaguuuucaaagguuucuacauaaaaucuuucucucguuuuucucaccacuaguuucuaugaaaggcaaguauuaccauuaucuuaaagauagcacuagagguuaggugacgugcuuaggauuagauguuugagcaaugcuuuucuuaaaugggaagugaaaaaauauuucuagaaugacgccaucuuuuucauuaaagaugcacaguuuugaacauuguuuccagucacaagguuguguccaguaauuugacuucgucagguuaacauaguuauucaauaauuauacagaaauguaauauaacacacauagauuuacuuaagguauuacauuaguauagaaucguaguucuuacuugccaguauuaaugucucauaauacuuguucuucagaguacaaauuaaucucuccuagggaaauuuagaugugauuuugguagaccacuauauuaaauauauuccuuuguggauauuaguauacauaaugucuauaaacaugguagaaccauauucuccucuaggagaacugcaauuuaugaaaauacaaguuucugcuuucuaugauaaaucuauauauauauauaucagacuauucauugcucuugaaaauuugaaagauaagccuauuacuguugaagaaguagaaauagucuuggcuguuuuuuucuauggaacugagaguugaaagguaaauauaugcauuccauauucugaccaguaauaaucaagaagaaaguaccuuuugguuucuaagauugguggagaaggugagaucacaagaauacuuuauuugcuaauacaucuuaaagggagagauacuacauuggaaacugagcaaaauaguacuguacaaaugcugguuacuucugacaaaagucagugaugaaacugauaaaaguugugauaaaaauggaagaaaucaugacauaaaguaguauuuuuugcuuuuaguuuugauaagauuuauacaacuggacugucucagauauuucauuuugucuuaaacauuuucaguuuuuaaaguucuuucauauacauuaguucauuuaauucuagcauaaccuagguuuccugcacuuggaagaccauauuggauuucaauaauaguaauaaaaauacuuuucaagcucuguucauacuuacaauauauaguagccguauuuuuuuuuccuuuuuggauccccaguucuccccccuucuaauuuagggcuauuaaauuagaaucuaucagaguuaacccauauguaccagcugaugcaccuggaggcauugccauuugucucuucuguuugggucagucagcuuccugucacuccuaauggucaggugccagguaucucguugcuucuucuccauugcacauguagguggaccugucuugauguuuaguugguccauuuugagcucuagugagucacaaaacuccuuuccaguagaguaccccaguggcacuagagguacauaaaguacaauauagugcugcucugugucauacaaaaaugcuaguaaaacagcucuucaauuucauuagucucaacuccuguggacucuggcagaggugcagcuagagaacaguaggaauaguauuagcuguuaauaggcaaaauagugguuugaaaaccaagcuuauauaccucaguuuucucuucuuucaaugugaguucuuuuccaaagagcaucuuagaugauccagcaaagaaucucaagugggccagguacgcacuuucuuuccauacauguccaaaucuuaaaaaaaacauagcuuaaggauuuagaagcuuugucacucaaaagacacucaguuuuucuuauuguuuuuaccagaugaaaacgguuaaaacuacauuuguaagaugccauagcuuuuagaacuuacaccuagacuaaaucuauuguucuuacgucucucguugccaaagagggcaaaagucuccaugguauguugcagagauucagagaggauuauuuuauuuuucccgaauaggacaagggguuucuuaaacauuucuuuuuggcugggcgcgguggcucacaccuguaaucccaggccgaaguggauggaucaugaggucaggaguucgagaccagucuggucaguguggugaaaccccucucuacuaaaaauacaaaaauuagcuggucguggcagcaggugcuuguaaucccagcuacucaagaggcugaggcaggaaaauugcuugaauccuggagguggagguugcaagguugcagugagccaagaccgcaucauuugcacuccagucugggcgacagagcaagaaugucuaaaaaauaauaguaauaauaauaauuucuuuuuguuuguaauuuuuuaaauaaccagaaccauuuucaaaauaaauuugagauacuaucccauauuauuuucuauauaagugcuuuaaugugugaaaauauaaaucuguuuuuuaaauuaaauggaacauaucgaguaugauauuaucuccaaauuaauauucuaagucccucuguuauaucuguuguuagagugcugaaggacuaauuuacauucuucccaaauacagaaaugagaacaccaccuuucuacaaaguaguggugacugacuaucauacucacuuuuaggauaaacagaacuaaagauuaugaaaacuuacuuuggaauaaaaaauuaauuugaaggcacaacuuggcuuuaugacaaagaauauuaauguuaugaaaucuuuaggaggaaaaauugcgaaucucuuuuuaauaugcuuauaaauuguaaggcaucuuugauagcacuaaggcuuguucuguuuucuuuuuagugggcgguacugaccuguggucacuguuucuguaaugaaugcauuucuauaauuauugaacaauacagcgugggaucucacagaagcuccauuaagugugcaaucugccgccagaccacaucucacaaagaaaucucguaugucuuuaccucagagaaagcaaaccaggaggaggacaucccugugaagguaaaguaggucaggaacacauagaagcauagguaaggcaauauaauauaggaagcaguaucugauuaagaaagcaugaacaucagaacaagcuugacagugaauagguagacgccacuguugucuguagauacacugccugaaagccucagcuuaaccauguaauuuuuaauuguaggaggaacacagaacacuuauucaaacaugguuagcgauagucauguacacugugacuaaaauguaacaucuuaaaauuacaguuuccuauccucuauaauauuucuauccaccacaaguagacagaggucugguuacauuagagauuuauuuaaagaaagaguuuuccucauucuuuuacacaucccugaauguaaggaaaaaaggaugugucuaacuaaacagaaggauaaaauaaauuggcuaaugaagacagcuacaagaaagaggguaaugugcuuuuuaaacagcauagauugauauuccaggauaaagccaaauuuuggcuuuauuuuccuaauuuuuuuccaugcuucauucagaauuuuaagaaaauuacuauaaugugauauccagacuggaucuguaauuggauuuacugcuuuuaagggguauuuaauaaaaagccaagacuauuuugcucuuucuuuuccuuaaauaugcuuuuuuaauauuuuuuuucuaaccaaacuugaacaaaggacacaucgguaucuaaauuuaguagcaaaugugggcuuuaaggaauagagaaugagaauuagagaaugaugggguugacucuuaagcaagaugaaguauucuuuauuaauuccuucugaguuuuugauacuccucacuuuuaaguaauguguuuuuuaaguagaaucagcuacaaguugaaauucacuaccaguaguuaagcaguuauuaggguacccuucucccaagaaaacuguagcugcauuaaagaacuuuuaauugcucuuuuuucacuguuauuugaguaaaaccugaaaauaucaguuauauugcucuuuagucuguugggauaaacagaauuccacaguuagaauaagcauucauccauucauuccacacauauauauuggacacguacuagcacacaggcagugugcuaggccucauagacacagcauacacauaaauaaaacagauaugguuacuacuuuuguggagauuggugaaggaguuugaguuggggcaggaagcacagauguuaauaaauaauguguuauaauugugauaagcacuacaaaagaacaaagcuggaggcaucaugcuaccugauuucaaacuauacuacaaggcuacaguaaccaaaacagaaugguaccaaaacagacauauaggcgaauggagcagaacagagaccucagaaauaauaccacacaucuacaacugaucuuugacagacccgacaaaaacaaacaauggggaaaggauccuauuggguaaauggggcuggaaaaacuggcuagccauaugcagaaaacugaaaccggaccccuuccuuacaccuuacacaaaaauuaacucaagauagauuaaagacuuaaauguaaaacccaaaacccuaaaaauccgagaagaaaaccuaggcaguaccauucaggacguaggcauggacaaagacuucaugacaaaaaugccaaaagcaauugcaacaaaagccaaaauugacaaagggaaucuaauuaaagagcuucugcagagcaaaagaaauuaucgucgguaaacaggcauccuacagaacgggagaaaauuuuugcaaucaacccaucugacagaggucuaauauccagaauuuacaaggaaugugaacauauuuauaagaaaaaaacaaccccaucaaaaauuggacaaaggacaugaacagacacuucucaaaagaagauauuuacguggccaacaaacaugaaaaaaaguucaucacugaucaucggagaaaugcaaaucagaaccacaaugagauaccaucucacaccagucagaauggcgauuauuaaaaagucaacaaacaauagaugcuggcaaggcugugaagaaauaggaacguuuuuacacuguugguaggaauauaaauuagugcaaccauuguggaagacaguauggcgauuccucaaggaucuagaaacagaaaucccauaggacccagcaaucccauuacugcauauauacccaaaggaauauaaaucauucugcuauaaagacauauacacacaaauguuuacugcagcacuauuuacaauaacaaauauauggaaccaauccaaaugcccaucaaugauagacuagauaaagaaaauauaguacauaugcaccauguaauacuaugcauccauaaaaaggaaugagaucauguccuuugcagggacauggaugaagcuggaagccaucauccucagcaaacuaacacaggaacaaaaaaccaccacauguucucacucguaagugggaguugaacacugagaacacauggacacaaagaagggaacaacacacacaccagggcuuguuggggcaggggaguaaggagagggaacuaagagggcagauaaauaggugcagcaaacuaccauggcacauggauaccuguguaacaagccugcauauucuguacauguauccuguuuuuuuguuuuguuuuguuuuguuuuguuuuuuaaggagaaaaaggaaaaaaagucucugagggaaugacaguuaagcagguaucuaaaggaugaaugaugaauuagucagccugaggagagaauagguuggcucccagacagagaaaaagaaaaccagaagagagccagugcauggaaaagccuaagacaaggacucaaauggaucugaguggcugaaguguagaaagcaaggagaaagcaguugaauaagccuggagaccuaacuaggggaccagauguugaagggccaccugaacauuugagaauuuuauuuuuauuuaaggagaaagccauuaaauauuauaagcagggauguaucaugaucaaauuuggauuucaaaaagaucucucuuguguggaaaacagaugaugaggaacagaauagagcagaagaaauuuggagagagcagcuuaggaggcuacagcaggaguaaugguggcuuugauuuggcugauggcgguagaaauggagagaaguggguauauucuagacauguuuagaauaaaguuagagaauguuggcagcauuagugaaggaaauuucauagaucaccccugguuucugaugugaauaagcagguggguaaugguauagcuaaugauacaagauauuuggaagaggaauacauuuagacauaucauauuuaaggugccuaagacauccaaguagaacuauccagaaaaguguugauauguggagcuggagauacaaaauucggagucacuaauagaaaaguuugcuucagauugaguccuaugaaguccauaacuuuaaaagauugaaucaaguugggagggcuggaaaaugagaaggagcaacuagggacaggcaauccaggcagguacgcuggcaacaaagaccacagggaagcucugcuucggugaggagacaguagugcugaagguggaucaacuacaauguggacuaauuugucuaaugaggucacugaugacuuuagaaggagcucuuuuaauacaaauguagaggcagaaagcagauugggagggauugcgggaugagcaggaagucaacaaguagaaaaaaugcccaacuguuucauaaacuuaacugugagauagaaucagaauuguaaccagaaccuaugaaaacagaaagacaucacuuuuuuguuguuguucuguuuaagacaaaagauucuugagcauguuuagucuccagugaaaaaaggauagacugaagauauaggagaaaggauaauuuguaauacaaguuucuugaaaagaaggagaauguugauguauagaaaguagaguuucauugaagucaaauaacagguauaaauugggcuauugagcacaaaagauauaagcauagguguucuuaucugagaaugggagaucauagucauuccagagaggacaggccugccagaugugacuguagaaguaggugacucaagugagguggagaagaaaagaugcuagaagaugaaacagugagaccugaauuuuggaugagcuguccaagcagacaguauguaauaucuagaguugagguauagaguaaauuaggcaccaaaguucuuuagugaauguaggguaggguucaauaaauuauagcaaaggguagaguugggauaacugggcuucagggggcucaaaaaauggaaguuguuacacaaaugagaacuaaugcucugaaaccugcauuuguggaccagcacucaaaugcaacagucaaauccuucacucaaaagggcugcugagagaccaguaugcuuagaagauagccagguucuaauuaaagcagggaagugaagagcaguauuucuacaagagguagaaaauaugaaacaauuuguuucauaaaauacggguuccagggggcgccagugaaagguccaggagugaaaggagaaaaauuagaggguaaacaagcaggaaggaagugcaggacaguaugggaauaacagaacaggcaaggauacgugaugagagcaucaugaccuaaggaucaucuaguccuguucccucucugugaauccccugaauacauuuuacagucagcccuguguaucuguggauauagccaaccauagaucaaaaauacuuggaaaaagaaaaauuccaugaaguucuaaagagcagaacuugaauuugcagcaugcugaguuuacauugaauccacgcaaaugcaaugauguguagggauuauaugagguaaucuagagaugauuuaaaguauacaggaggauguguguauguuauaugcaaauaugacaucauuuuauauaagggccuugagcauccugggauuuugguauccacagggguuuuggaagcagucagucccucacagauacugagggaggacuauauuuuuaaagcaaauaccaaagaguuauugaaggaagaaguaggugacuuauggugcagcccugaggcauuugacaguuauucuuuauccugccugcacuuaggagcuaugcugcuucccagucccucucucccuuucuucccacuccuauaguuucuccuuuccuuuccauaaagauagucuuucuuagcccuuccuuuuuucucuucuuucucuuccucuggccacagcaucucaagggccacagauggccuuuguggcuaagaagagguggcucacccuuaggugacagcaugcaucacaguacaaggaacuggcauaagaaagaacugcugugucagguuuugcgcagagagguuaaggaagugauugcucuagcuacugguaaacagcacagccucuacgaaacugagucauugagcccaucaaauccaaacaccuguucauuuuauggcagcuuuccuagacacccaggauagagauuggcacaguuacaugugcugugcuguuggagcagggauaucgguauauaaauacuguuuauugugcucucacuucucgcugucuuucaugaguauugauuaacacgugaauuaacugaagcaucuuuuaaaaaaaauuaaguuuauagaauuuacuaaagauaauuucccuuuuuaucauagaugcacauguaauuacauuuccuuuucuuaaacauaagacuauuguaccauugugcgggcaaauuuuaucccuccucgacguugucacacugcuucacgccauguuuagguuggcucuucacugcuuuuucuguuaccauuugugucugccacauuugccuugugcuuccugucucuucuucugacuucugucacauuucuggccugcugucugucacuuccuccuugaaacaucagcuuauuguauucugagacuucaccccucucuugugacucuuugaaacuuccacauaaaugaucauauugccuauuuuggauuaguauguaaauaaagauggcuuuguguaaauaauuaaggcauuauuuucaaauuuuagaaacuacuaguuccaauuauuucuaaaccuaguuuuuuucuuuauauuacuguugauuaucaaaucguuguucuuuaacaagcaauacugacaaguaauuuuuuauuuaauugaaauguuuauauuaucugaaauauaaaauuuauuucugaaaugauuauuucacuguauuuaugucaagauucucagacauagcaaaccauauaucguacagaaugcuuaaucauauagcuuuuuuguggauaaaagauauuuggaaagcauaaaacuauuauuuauuaguaguagacauuuuuaaguaguauuucuuggaaauaagagauuuuacaauguaaggaaugcuguugauugaccauagauauaaaaugaauacugggaucacaaauguccuguucgguggaugcacuuaaguugaagaccauuucuucccuagcaacagugugaugguauuccuaaaugaccuuuggaaccuacugggcaucucacaaaguaaacaaaauuccccuugcaaguucugacaacugccaggcauuuuggauggugaaguaggccuccuggcagaacauauggcccacaugucuuguucccugugucuuacauuuggcuagguuuuauacaaagcauuuugccaguggaaacccugacccuauauacuggucaagagucuuagauaauaagaaauuucuguccgggagaaaauagauacagccacuacauagauauagugacagcaauacaguacccuucccacccaccacaugcuacacaauugcuuuuuuugucaaacuuuuaaguaugugaccaucaacuggccugcuuuuuaaaauaaauauuuuuguucaggcucugucuccauaaacuuugacucauuagaccugggaugugguccagaaaucugcauuuuuagcaagcauaucucuugauaauagagauaucuuauacagccuuuuuguagagaaaaaaacucuguaucucuacauuccaacucacagagaagccuagccauacuauguguagaauucuacauguggaauucuauucuguuuuuuuuuuauuugaauuuuuguucauuuaauuuaaagaucauuugugacaucugucucacacuuuuaaaauauaauuaaaauaaacaucugagugaaaaaaacugauuaugaaauucugaguuuaaaauaggaauaaaauaauuugguaaauauaauccagaagugauuauauuuaaauauauuuaucuaaauauucuuauauaaguuuuauauaacaugaacauuaacugguaaauuuggaaugcaguuguauauuuuuuguuaaaauaugucaugacuaaauauaauugcaaaaaaaauaccauuucuauuucuguucaccggccaaguuaauacuuguaauucugaacuguuagccucauguuaaaguuagccauagcuugcaguaaauugaacacacaguagagacuucuaagauauaaacuaaaacuuaucuuuaugaaaaaaucauuuguugaguguaaacuccauuaaaagguagaggacuuguucaugagguagggauguuguuuuauucacuauuuuguaugaggcauuuggaacaauaccuggcauauaauaggcacucaguaaguauuugaaugcauggauggauaacaauugaauagucuguguaaacaauugaauagucuagaguaaagccaagcuacaguguaucuuucuacaccaauacucagauuuuuaccauuaauauugcgcccucuuuuuuccccaauaauaagucuucagugcaugaaaagcacuuccucccucugaaauuacaucgguaaaauaggucaucucauucuggaggggagaggauuaaaaucuagaucagaugcuacuugguugguuuauuagaagaauuuuuuucagucuacugaauuuauggcaaagaaacaaaacugaauuuucugucauuuuaacacauuuaacaacuuguaauucaaaguuuagguucuccacauuuuacaacaggaggcugcaacuauagaacaccuuauuccaaucagauuuaacucugugauaaaaauaaguuaguggcaccuguuagagcagauaagccacaugacauuucugaucuugaguuguguuacuaagugacuuccaggccaaacuucauuagaaauauucuuuauuggccuuuggugcuagugggucucuacucuuuuuucaguguguugacuuccugccccaaauucuggagcuuuuaacuuuguacuuuauuuuccagaaaguggaagacuucacuuuacuucacuucuuuauuuuuaaacauuuuaauucuccuggcugcugacuugagcagaaaaccaggagagauaacagccuugcgcugacugguaacacuuuguaugucucccauccgaguucucuaguugaccuuagagagaauuagugccuuagagagaagaauggcaaagauacagucagugaggguaaaggacagaagcugugucguuauuccaaagcuggaccuuggucauuaauguuucagaaacaugaaggaaaaccaagcaauaagcacaaaguuaggauuagggugugugugugugcugaagagacuaaggagaaaggaugggaguaaggaaagggacaguaaugucagaagaggacagaggugcuuauaguuaaguacaacuuuaucaaccuaauauauuaagagauuaucuagcaguuguaugggauuucuguucccauguacagucuucccuaaugcauaacauuccagcuuaacuuugcaucuguuuacugcuguagcuaaauaaugaguuugccagaggcuaccaguuuaccugucuugagaauguucauacuguguuaacagcuugcacaggaauagauugguauccacauuuccuuuuguuacuuuuuugcuuuuuugcaagcagccuugccuauauguaacccauucccuuuuuccuguuuuaaucuuaucuuuuuuuaacaaugugaauauuugcuuucuauagcaguaacuacauugaauagucuucucagaagcuggcagauuugaacccaaguuuauuuacauauuuaagauagaagaaacaugaaaaagagcaguagaauguguguagugcucauuaaggcgguauaaaacauucauuucaauugccaaaccagcagauaaaccauccuuuuauguuuuucuccauauucugcaacacgcguuagaguguuauguauuuggagacaagggaguguauuuuuucaucuuuguauauccaguuccucauaugguucuuuguuaacugucaaaugaaauauuguauauauuuaugguaguauacaacaugauguuuuaauauauguagauauuauggaaggauugaaucaagcuaauuaacauacccaucacuucacauacuuaaccaauuuuugugauaagaaaauuuaaaaucugcccucuuagcaguuuucaaguauaguuggccccccacauuugcagauucugcaucagcagauucaguuaaccacggauaaaaaauacucaagaaaaacccagcaacaauaaaaaaucacaauacagcauauuuaaaaaacacaaauuuuuaaaagacacuauaauaauuuacguaagauuuacauuguauucaguauuguaaguaauacagagaugauuuuaaaguauacagaaggauguguguaggcuauauguaaauacuaucauuuuauguaaggcacuuagcaucugcagaucuugauauccaauggggauccuagaacuccccaugaauaccaagggacaaugguauacaauacauuauuauguacuguagucaccaugcuguauaauagaucuuuagaucuguuccuucugucuaacuaaaacuuugcaccauuuaacccacucccuucccccacaaacuccagccucugguaaccgccauucugcucucugcuucugugaguuaaauguuuuuagauaucccauauaagugagaucaugcaguaucugucuuuucugugccugguuuauuucaguuagcauggugucuuucagguacauagauguuaucucaccugacaggauugauuuacugucagguaaaaacauauuccgugguguauauauaaccuguuuuaaaauuuauucaucaauggauggacacuuacauugauuccaugucuuggcuaccaugaauaaugcugaaauuaacuugagauugcagauaucucuuccacaugcugauuuaauuuccccuggauauauacccagaaauagaacugcuggauugugugguaguucuauuuuuaauauauugagaaaccucuuuacuauuuuccaaaauggcucuacuaauuuguauugccaccaaugguguacaaggguuuccuuuuucuccaccuucucaccaauacuuaucucuugucuuuuuuauaauagucauucuaacaggaaugaggugguguaucucagugugguuuuaauuuguauuucccugaugauuagggucguugagcaccuuuuccuagaccuguuaccuauuuguaugucuucuuuugaguaauaucuuuucagguccuuugcccauuuuuuacucagguuguuuucuugcuguugaguuguuugaguuucugguauauuuuggauaauaacuccuuaucacaugugugguuugcagauauuuucuccuuugcuguagauugucuuuguugauuauuuccuuugcugugcagaagcuuguuaacuuuaaugcgauccuauuuaucuuuuugcuuuucuugccugaguuuuuugggucauauccaaaaagucuuuaccaagaucauugucaaguaguuuguaguuuugggucuuauauuuaagucuuuaauccauuuugagaugauuuuuguauaugcggugagauaaggguccaguuuuauucuuuugcauguggauaacuaguuuuuucagcacaguuuauugaagagacuguuuuuuccccauugugugaucuucuuaucuuuguuaaagauugguugacuguguauguguggguuuauuucugggcucucuccuguuccauuggucuguaugucuguuuuuauuucaguagcguacuauuuuuauuacuguaguuuuaaaauguguuuuagaaucagggagugugguaucucuagcuuuuugcucaagauugcuuugguuauccaaggucuuuugugguuccauaugaguuuuagaauuguuuuuccuauuuuucuuugucuguuuuauguugccguaacagaauauuugaggcuggguaauuuauaaauaaaaggaguuacggccagaugcagugacucaugccuauaaucucagugccuugggaggccaaggcaggaggaucacucgaggccaggaguucaagaccagccugggcaacauaauaagacucugucuuuaccaaaaaaaauuuaaaaguagccaggugugguggugcacaccuguagucccagcuacucgggagacugaggugggaggaucacuugcgcccaggaguucaggguugcagugagcuguaauuacaccacugcacuccaacuagggcgacagcacaagacccugucucaaaaagaaaaaagaggauuauuuaacuccuuuuucuguaggcagggaaguucaaggagauggcccuucuggugagggcuuccuuguugcaugauaacauggcggaggucauagggguagcagacagguacaaagagagagcaacaaaaaggaggaggaaacuuauaacagccugcccucauaggagccaauucaucuugcacaagagagaauuuacucacuaccaagagaauggcaccaagucauucauaaaggauccacccccaugacucagaacaccugccacuaggccccacuucccaaaaccuccacgcuggguaucaaauuucagcaugaguauugcugaggacaaacucaaaucauagcacuauuucugugaaaaaugucaucagaauuuuaauagggauugcauugagucuauagauuauguuauauaauauuuauguaacaauauuaguucaguucaugaacauaugucuuuccauuuguguucucuuuaauuuuuuuauuaauguuucauaguuuucaguguacaggucucucaccuugauuaaauuuacuccuaagcauuuuuuuaugacauuauaaaauauuuuuucuugacguccuuuuuggauaauugauuguuagguauagaaaugcuacugauuuuuguguuucuauuguauccugaaacuucacuaaauucauugcuuuuaacagauuuuugguggaaucuuuaggauuuuguauauauaagaucaugucaucugcaaacaguuuaacuuccuccuuugcaauuugaaugccuuuuauuucuuuuucuugccuaauugcucuagcuaagacuuccaauacuauguugaauaacaguggcaagagugggcauuuguguuuugcugaucuuaaaggaaaagcuuugagcuuuucaccauugaauaugaugcuaucugguaggcuugucauuuauggccuuuacuguguugagguacauuccuucuauaccuaaguuguugagaguuuauugaaguauguugaauuuuaucagauauuuuuucugcauauauugagaugaucauuuuuuuccuuuauucugugguguaucacauuuauugguuugcauacguuaaaccauccuugcaugccagagguaaaucccuguugaucauggugagugaucccuuuuaauguguuguggaauuuggcuuccuaguauuuuguugaggauuuuugcauguuuucaucagagacacuggccuguaauuguuuucuuauaguguucuugucugauuuugauaucagaguacuucuggucuuguaaaaugaauuaagaauauuuucucuucaguuuuuuauaaaaguucaagaaagauugguauuaguucuucuuuaaaugauuguuuaacuuuaccagugaaaccacuaguuccuaugcuuuucuuugaggggagacuuuuuauuacugacucaaucuuguuacuacauacuggucuuuucagauuuucuguuucuuugugauucagucuugguagauuguauguuucugggaauuuauccauuucuucuagauuuucugauuucuuggcguauaguuguucauaagucucaugauucucuguauuucugugguaucaguuuuaaugucucuacuuucauuuauaauuuuuuaaauuuuacucuuauuuuuucuuagucuaccuaaaggguuguccauuguguuuauguuuucaaauaaccaacuaagaauuucauuagucuuuucuguaauuuuuuuucugaucucuauuuuauuuauuucugcucugauuuuuauuauaucuuuccuucugcugacuuucggcuuacuuugcucuucuuuuuccaguuccuuguggugcaacauuaguuguuuauuuagaacauuucucuuuuuuuauguaguuguuuauuucuauaagcuucauuauuagaacugcuuuugcugaauucccauaccuuuuguuauguuguauuuccauuuucauuugucucaagauauuuuuaauuuuuccuuuuaauugcuucauugacccaaugaauguucaagagcauguuauuuaauuucuauauuuuuguuaauuccaaaauuccuccuauuauggguuucuaguuucauuccauugucagagaagauacuugauguaauuucagucuugauuucggacuuguuuuguauccuaacauauucugcuaggaaaguaggaaguaacuagauugggacaaaaugguucagaacuguagugguuggaagggaucauugagcacuaccacugaacuggccagucuuugauaaaagcaaaugcucuguucuuuuccuacguagaguuagcacuacgguacuagaaauguugauuauaaaaaauuuauucuacauuuuuuuugaacuuuuaguaagaaacguauuaaucaguggaaggauucauaguuuuccugguauuucacuugaaauaguuuuaaaaguaagaccuugcaaggaacauggauguuuuugucuaaauucugaaaugaucaccuuuacacuaauuuccuauuuucucuucgcucuuguuugagauaauuauuagacugaaauagguucuuuguaguacauuucuaaucuugcaaguacacuugaaagucuacauacccagagaaaauaaguguagaaucaugauuuuagcaugaggauuuuaaaacuuuuuccauuauucuaucuugcuggcuuaaaauuaguacagcuuucuuucuuguuuuguuuauauuuuuaccuuugaauguuucuucauguaaaaguguguugagaggauugagggagaggguuuaugcugcuguggaaauauuuuuccuucuuuuugguuaaaucugcucccccuugugguauaaucuaggucauuauagugcucauauuuaauaucucagaaagauaauaaguucuugaguguuuacuccuuaccagauguuaggcuaaaugcuucguauacauuuucucauucaaucaucacagccaccuuuggaaagagauauaauuaucauucagcccuauuggauagaugaggaaacacaggauuagaaacuauaacuagugaguuguagaacuaugaguugaacuuaaauuugucucauucaaaaucccauaaccuuaauuucucugucauaccaucuccaagagcacuccagaaggaaaacuuucucauugagggcuacagaaauacuugcacuauuuuccucauuuucuuauuucuccauuuuaaaaaucauuuuuucacuuucauccucaucugauagaaaugguuauggaagaugcaaaaaaaaaaaaacacacaguuuuaagugucuagcuuuguaugaaucugccucauucuaagugagcaucauuuguaccucugucauuguuuuugguaauacccuugcaagaaaacauucuccauugguuggauccuucacuguuugcuuacauugggaguuuugauucauuguauucuuaacauuucuaaugacauaauaucugaagaaagggagaauaaaugaagaguguuuuaaaauaucauuucugcuaaucuaauguaacaaaauuuuguaacuauaaaaccugacuacuuaacuaaaagauccuauguucagggucauagcacuuaaugacuuucuggcaugcuuuuacauucaaaugucuggguguaaauuuaaugacuucuacauuucgaggcuaaagaaaauuuccagcaaacacaaaaugaaaaagaguaaacacauaugcaccugauaauuuguuuugaugcauuuauaguuuugauaauaaaaaguacuuuguauugcuuuucuauucuguucuuaacuagauuuuuuaguaguaauguguauuuuguguguguguucaaagggcagccauucuacaaaaguggaagcuguggucagaacucugaugaaaauacagcuuagagauccaggggccaaagcacucguuuucucaacgguauaaucaacauuuucauccucaauauuaauucgaacugauuuucccucucuaaucaguuuacagcugagaacuaauuuuugauguuuacucuuagauuuuuuuucccaaauccauaagauagaauuauuuuuagagaagauagaauuauuuuuagagaaaugugaugauguuucacaaggcaauuuguauagcuauauuucaugacuuuuuauuaguuucauuuaaggauuuucuuaguuuaauauuuuuaaaauuggaauuucugacuuugaaagucucauuucacaaaaauuuggguugaaaaagacaaucuacuuuauaaaguguugaguaaaacccuuaguuuucauuuucgaaaacuaaguaacuauauuccaguaugcacuccauuauguauuuucuacuguuuguuuaucuuaauuacauuuucaaaaccagcauuugaugcaaaaaaaaaaaaacaaacaaaauuacuauuucagauagagcuaaauaauauggaugguacuacauuugaggguuuugguuuugguuuuauuuucuuaacuccaguauaaaagucauuuugauuuauuuccuuuucagauacccuuagauaaaggcuacguguaaauauugguuuucuuauuguuuuauguguucuaguggcaagauguauuagauauuauuucaaaagcucuuacugacaacaacauggaauuugcacaaaucagucguguuaagacauuucagguauguuaagauuuuacuccgguuuuuguaguggauacaguugcaaauuuaaacugcuguuaacuagcuuacuuacauuuauugucucaugccauauaagccacauaaacagggucugaguucuugauuaauuauaaagugaacauuuaaaagcagagacugcagguauuuucaguauauaacaagaccauugguuuuuuaaagaucucccaacuugagguucuuuuuuuuuuuuaguacaggaaaagauugccuaugauauaccuuuugaauggacaggggccucacaccccaaggauuaguuucuaaagucacugucaggcagaacugcauguggucacaguuauccuuacaucaugcucagcacagugacaggcguaugaccucaggcacacacagagaccaaaugaaaauuuagcagauucaugucucuuaucucacauucacucuagcacauucuuuuucucuuuuuccucuaaccucauguaguuuaauuugcaugcauuacaugcaucugucuugugauuccucuagauauuacgaagaacaagagagcuuauaugauacuuuucuucauaauuaaaaucaagcgacaaguuuacauuuucuaaaguugguaauuuugcauuuaaguuucuuagcuguuaccuuucacaauaguaauagauagcauuagacaucuuuaaagugagcuauuacauacugcucuuauuuuaacugaucgagcuaaaauuaaaauguaccuuucuuuuuuaggagaaccuuucagcauuuaaacgugauccccaaaucaauauuuugcugcugccccugcacacagguucuaauggauuaacuaucauugaagcaacucauguucucuugguggagcccauauugaacccugcccaugagcuucaggccauagggagggugcaccgaauuggacagacaaaguaaggacuaaaauuagaaucagucacauuugcuucaguuuucugagaaaccaaaucaguauuuaaacucuucauuuauguucaucauagcguacuuguuuuuaauuacuuccuuagauacuacauuuuuuaauuauuuauuuuauaacuuauuuauuuauaacuuuuuaauuauuuaauugaaaggcaugagauuuccaacccucccuucucuccaagaagcaaacccccaaauugucccaauuuuuuucuucccucccacaaaaaccuuaucacuuuauccaaaaaaaagcuuguuagaaauacuuaagacagcuacaaaguugaaggcauccaucaugccuuugaggagaauggaguuuugauugucuaaaguagucccguguuuaaaagaagacauaccuuguacaugacugaaaauaaauggcuccuuuuaaaauucuuaacauuaggaaaagacacccccuaggucagcuccaagagaucauuagauucaguuuaaggcccaaagcaaaccuaauaaugaauauuauuauauggcauguauuaccuuuauucauauaucagaauagacaguuaucuuugauaaggccugcuaaauguauuaccuucuggauguuagaagucuuugauguuuaaaaaaggaaaaaaaaacacauccauaauaagcacuuacuaaaucaguauuuauugagcaccuacuguaugucaggcauuauucuaaauacugaagauucaaauugaaugauacauaauuuauuuccccaaggaggucacuguguaguacaggaagcaugacuuaaaguguugggguagaaugugcaaaaguauaauaauaaaaggacuguguuaacaaaagaagauaaugaucacucgggcccuacagagucaggaaagacuuuaugguguuaagucuugaaggaauaauuauuucaaaguuggcuggaaaaggguauucacacagccaaagagaguuauauaugcaaaaauacaauggugggaaaugacaugacauuucuagggacuguaaggaguuuggaauuguugcaguauaaaguaugagaaagagaucaucggcaggagaugaagucuucugugucauacucagaaauguagacugccccguaagaaguagcggggagagaaaauaaagggcuuacuugaaaacaggaaagagacauguuuauuaaaccucuuaacaaauagggcaaaguaacuguaauaaaugcgggcuuguucuaacauaccaccaaguggcauuuaaaaugcagucaugucuuacuuguuuuuuguugguuuucuucuguguuuuuaaauauugauuuuuuguccuaccaauguucuuuuaaagcauaggcuggacuagucucauauuuaaaaccacgaguccaaaaggccauucagcauuacccaacaaucuuacuaugccucgcaagucaauauguuuuuuucuacuuucugaggagucugucuuaagugugucuucuuccuccccauggcgaucuugccucauacaggggaaacauauacaaucagauuagaaguaccucaucuuuccaucaucaacuugaacagucugccugcaucaguacucacauacuuuuugguagauuuuuauugaguaucuucugugugccaggcacuguuuuaggaacaugagauguccucauggagugcgauucuagcuguaaugggguugguagacagaaaggugguaaacaauaaacuaaguacaaucuggacuauguuaggagcuggaaaaguagagcagggugaggaaguaaaagugcaauguuugggcaggaaggcaugcaaggccuuauugagaaagucugagcaaggacuugaaagaaaugggaaaaugggaaaguuagucaugcagcuaucuugugaaagaauguucaaguaaacagugcuuucggugcaaaggcccuaaaucaggagugugguauguuagaagaauagcaaggagcuacaguugcuaaaagggagagaagcaggaguugaagugaaugggcucaguggggagagggauuacauugggcccaggaagccacugugaggauggugcuuuugcccugugugaaaucgggagccauuggaaggcuuugaacagaggcuuggcauaucucacuuaaguuuuaaaagaaucauucugagugcugugauagggugggagugaaggggagcaaggaagaguagaagcagggagagucuuggaggcuauugcagucauccuggugagagcugaaggugaccugaccauggcaguagcagugcacaugaugaggaguggucagguucuggauauauuuugaagauagaacugauaguacuuuuggacagacuagacaugggguaugagagggucaaggauaacaccauggguuuuggcuuggacaacuagaaggaugaaguaaccuucaacugagcuggagaagucuacaggguagagcagauuugguaagggaagaacagacauccaaauggagauuucuauucuguaacuagauguacaaguccauuaagucacgagacugaaugagauuaccuaggagugaguuuagauagagacagaguuuagauagaggaccauggacugaacuccagggcaccaaaguucagcuguucuaggagaggagaaggaagcagcaaagguaacaaauaaagaucaaacagugaguuaggaagaaaaccagaagacaggaguguccuaggaaccaagugaaaaauguaccucaaagaagagguuauggucaccuguuucaagugcuaugaaaaaugucaaggaagauaaggauugagaauugaucauuagauuuagcaacauggagaucaaaaccagguuaagugguagaggugacagccugacuuuaguuuuggagaaaaugggauuuuguguauuucuuauuuaacaaauauuuguauaacaaagagagguuagguaacuugcccauagucaggcagcuaguagaagcaguggcagauuucaggcacagccauucugccuucacaguacaagcuuuaaccacagugcacugcugcuucuguguggcugguaaggccaguauuuugaggaguuuugcugcagagaaaaggaagagaaugagaucaagagagguuuuuguuuuccuuucaaaugggagaauuaguaagaaaaugauucauuagagacaacaaaaacuagugaaggagaacagggagaaugcuugacaauguccuugaguaggcaagaggauaugggaucaaacacugaaguggaggaagggguugguaguaggcagaagcauggauaugucauccaguaauaagcaggaaaguaccucauaugccuucccuuuuauuacagcagaagugucccuuuucuuucaaaagccauccauucauuuguccuggacuccauucuuucucauuuuucaaggacagguguacauuucccuuguacagguugagcaucccuuaacugaaaugcuucaaguguuuugccuguaggauuuuuucagauuuuagaauauuugcauauacauagugagauaucuuaggaaugaaaccccagucuaaacaugaaauuuauuuauguuucauauacaaauucuacucauagccugaaggugauuuuauauaauauuuuaaauaauuuugugcacaaaacaacguuuuuaauguguuuugacugugacucaucacgugaagucagguguugaauccuccacuugucacguuggcacucaaaaaguuuuggauuuuggguuuuugguuagggauacucaaccugucauauauuaccccauaaauaugucuuaauauuauccaucuuuagaaagaaaaaaacacucugauacauccuaccuccaucucuacuuuuuuaucccccauucucugucaaccugucugguugauuuucuccccaccauaucacugaagugagacuuauaacauuucuagugaccuacuucuugccaguggucugaggguucuuugucuacaccccuucgaugaauuuuuccagucuuagggcuuuagguagcuuuuacagguugaugacucucagguguauaucccccagcccagacaugcccauauagcuccugucccaggugcauauauccaguucuagcucugcacacauaucucuggacucaccuuggauaccugucuaauagguaucugauagguuucacauggacaaaacaaaacuguguugcuucugcacucucacucccacccugagcuuuccccaucuuauaauguggcacugucaucuguuccugcccagaucagaaaucucggacucuucuauauuuuucuuuucacaucucacaugccagucaucuuuuaaguuuugucagcucuaccuccaaaagauauuccaaaucuacuugacugcuaucuccacugacacaaccauagugcauccacccuuacuuacccagaugacuacaggacuucuuaacuggcuucucuggugcucuucuugcugagcaagaaguacauccuccacacgguugccaaagggauuucuaaaguacagucagguauacaucaaaucaugcauacaaacccaccaagggcuucccauuauaaccacgauaaaauucaaaugcuuggucacauccuggaaggcccugugugaccuggccccugcacaucucuccacccuuauuuucaccucucucccucgcuuacaggaugcuucugccaugccagccuucuuuuggccucuugaacauguuaggcuuguuccaggcauauucccuucccggggacuguguauguaugugcuguuucuucuguuuggauauucuuccuacuccuccuuugccuacuggccucauucccaucacucuuuuuucaguuugcaugucagccuguucucccagcauuauauuuaccugaaaccgucuuacucuuuuauguguuuauugucugucucucauuagaaugucagcucauggagauuaaauaguucauuuuauucgcugcugaaccccucccagcaccugccacaagugggcaccaacugacugaugaauauagcauauaaaaugugaagucgguuuguacugauuuguuuuacuauguuuuuaagcuuaaaauucuucuguaccuuuuagaccuacuauuguacacagauucuuaauuaaagcaacaauagaagaaagaaugcaggcaaugcugaaaacugcugagagaagguagguaauaauuuaccacaaguagaagggggaagguuuuccuguuaaaaguuuguaucuuuagaacuucuucacuuagaugacaacgaaaaauauagcacaaauacguuuuuaaaagcaaagucugacguuuugccuuuucacuguuucccagucagugcuccagacuuuguauauuugaauuaauuuauuaauuguaacauguaaauauaaacuauacuacauuccuuugccacauuggaucacuuucugaggcugggaguucgaaaccagccuggccaacauggugaaaccccaucucuacuaaaaacacaaaaauuagccaggcauggugacacgcaccauagucuuagcuagucgggaggcugaagcaggagaaucgcuugaaccccggagguggagguugcagugagccaagaucgugccacugcacuccagccugggcaacagaacgagucugugucucaaaaaaaaaaaaaaaaaaaacaaacuuguuaagguuaauuguggugucaauccaaagacaaaacaaaagcagagagacuaaaccagucuuaauuuuaaaagcuugacucuggaaucauagaacuuucuaauauuuaugguauaauuuauuuaaaucuuuuugaaaacauaaaucuuucuacaucuuuaggagguagguaggauuggaugguacccaaggaagagauuauugccuuagaagggauugucacauagcaaagaagcaauuugaaacuagaaauuuucuuccauugaugguuucugggaaggaaagaggcuuccacaagggccuuuuuaccuaaaacaugaaggcuuuuuaaaguucuuguuuuccuuguguaucagacuucagugauuuuuauuuagguuguuuuaauaaaauagcaguuaugaguuguuugaaauucucuugaaacaaauuaacuucaggugguaagaagguaauuuguaaggugagagccuuaguagcaguagucaagaguuuuauucuuuguucuauuaauugcacagagaaaaaacacuuugacaaacacuaaaaguaauauauagaaaucuucacuuugacaagguauaacaaagauuuuaucacuugcuuuccucugggaguuucuuauaucccaauuacaaaaacuuaagaaaaaauaugugucuaguucguauuacuacaaauauaaucgcugauggcuugggguuucuuucugacugugcucauuugggaaaccuugcagucacacgaacucaucagcaaagcauucagaggccucugucuugacuguggcugaccuggcagaccuauuuaccaaagaaacugaagagcuugaaugaacuacacuugauucauuccauggacuuuaguguauuaauaaacuuucauagcuguagagcaaaguuacaaguuuuaaaaacccaguagauaacaguaacacuguuccuaguugaaugaauuuguuuauuguucugguuauacaguggcuuaguacuuauugaguccuuuucaauauacuguuuccaaaagaucuauaaagauucuuaauuuuacacuccuaauaaaacauuuauuuuuugucccaaauaguaucuauaucugaugaugcaagggaauuaagagagguaauguguacuuuucuuaugauaagaucacucauaaaacaguuggaauaagaaaguaaacuagucuaguuuuauaugaccugguauauugaacaaacauagaucucaguuuuggaagggccuucaguaucuuuagcacaugauucaccaauaucuuguuaguaauauuuuaaguagauggugaauuauauuaacccauuuuuugaguaggcuuauaccauaacuuuacaccuaguaauuuugcaguaauacaacuccuuacaauaaguuaauguuagacaguuauuuguuucuucugcaucuugcuacugaaaacaaaaacaaugaaaauauucauauuucuauuauguguaaagugguguuaguguaaacaguuaacuccaaauagauuuuuuaauguauuaaugauuaccuuaaaauuaucugcuuucccuacucuuaauuuuucuuauuguuaaaguuuuuauauguuguaagauugauguaucuguaaauauugcaguuuuuaugauuuuguuuuauuauaacauggaaauauggcaggguuuuuuuuuuaaucauuauuauacugaugucuuggauucuuuuucuuucccauguucuuguguaacuagacuuuuuagccagugauaucugaauucaugguagaguuguuauuucacuccaguuguuccucccuuaagcacgagucuuugaccuuuugaacaagagaaugccauguucacauaagcaaaucguugcaagugauaauaacgaaguguuucuucuucugugaggaauuaauggacuuugaaauugcugaauaaggaguagcuuguuacauccuagccauuugauguaauacaaauguucuuauuuggcuuccuuuucuuugagccuucagaguuuuaaaggacccucuuugacccucaggacuuauuagcucccaguuagcugccuggaaaacucauagaaccauucccuagaucccauuuguccgagaggcuuuggugcuuaguuaaggugcauuuucuuacucuagguuuauagagugauguaauucaacugaagaaaacacacacaugcuuuuggugcuuauucuucaguuaaaaggagguauccauugauucuuuuauaugaaauuaaaucaaacuguuauuuuuauagcucuucacauauuaaaaagagcuuucauguacauuuacguguuuaauuuacccaacaaucuugugaaguugauauaauuaauaucuuuacuguuuuaaagguagagaacugaaguucagauauauugaaacuuucuuaggacauguagcaaguaaacaguggagcccagguccccugacuccauaucuuacauucuuuuacuaauaacaugucaugcugagauucagaaggcccaugcuuauaauuuaaaaaugagacuauuucaguauuucuuuguguuuguuuucuacuauuccuuucugagcuauguuuuagagaaaacaauuugauaugcuucaauuuuguaaaaucaaauuacauauauauaaaaaaaccuaucuguauuagacaaaaacuguuuuuauuuauuucuguaagauauccauuaaauaaauauuuuaguggaaaugaaaauuguggaauucuuugauuucugagacuuagaacauaugggguuuuuugguuuuuucuuucaacaaaagauaucaaaauggcuaauacuauagaaucccauauuuuauauacauuuauuacaucuuaaaaacaauugugacaguuuccaauuguucaaaacaaguacaaaucugauccucacauuuucuuggcugcaaacaaaggauuuuuuaaguuuucuuucucuauuauuuuauagccucugaaauauuacuguguuuagaaguaguuguucuuaaaugggugcuaugcuaaugaaccaaugagacaaaaugagauagccgcaauuguuagaguagucccagucauuaaacuuaaauguguuuggaccuggagaaucauuuucuguaacaugauuccagaugaguucacuagaacuaaaaagauacauacaauguaaagugcauauaccuaacgucauagccuuuuugcuucaaacccagauagcucugcuauguuuauugcagcgucacauuucucuuuguaugugaccugagcugaauaagccaugcaugcauucaguuuuaggaauuguuaucuuucauaucacaugaacaacaaacuaaaaaucuuaacaugauaauucaacaugcaacuacuaauacuuuacaaauaaugaucaaaccaacuacuuaccuaaauauuuaggaaaugaauuuaacaaugcaagguuaaucaccaaugcaagcuauccugucagguggauaaaguaagaaaucaugucuuuuuaaucuccugcucucauuuaauagcucuuccaaugugcuuaaguuauuuacguuuauuaaacgacgagacaaccuuucaaaaaugcagagaucaccgugcugaauaaccucaggcuuaagucgaauaaaagguaucuuucaauuuuucuagaauuuagcuaaacaaaaucccacaaugugccauu

SEQ ID NO: 16202 - RNA, 3070 nt, Homo sapiens
gguuccgucgcggagacacgugaaggucggugcggaguucgucucugcaagcuuggucgcccugggauggauuccuccuccucuuccuccgcggcggguuugggugcaguggacccgcaguugcagcauuucaucgagguagagacucaaaagcagcgcuuccagcagcuggugcaccagaugacugaacuuuguugggugaggagccuggggcugggaccugaacacuguaccuacuuucccucuguccuuguaccgcgggacucgcgacaacgucggggauucgggguggggggcgggcaccuggcagcaacccuugauuuucucagguuccuguggccuagccggaugggagaagggugacuccgcuucucuggggacugucauuccggaccucggcuuuguugguguagaggacuggguaucaaagaagacuuaugccacuggacacccagcacuuucaggcacccgagguugaagcugccuagugcuggucaccaagacugaucggagcccccaguacugggauuuuauuuuuggcagcccgagucccagagagucagugaaucagugaaucugcuauuccuggacuccucgggauuuaccuucauuacccaguucuaacccucuccgcugaaaaaugaguggcuccagcccaguaacuauaaaagugguguaaucucuuccaacguacauacuuauuugcuuucuuguuggauuguuguguaauaccaagccguuuugggucugaagguugaggaauugagccugcccugugaggggacuuuggcaaaaggguggaagguauuugcagcuugccaacaacguguucugcuugccaaggacagaucucccuuaauguacacaauucacagaauucagaggccaaggauaauuuuccuuggaauuagagggucugaggcuuguguacauggcagagaauaaugaacgaaauuuuugaaccacuuaacuugaacuauauacagucauugguuuccauaggcccuuucccauaaacuuacaguauugcuggacuaugacaccuaccagaugcuuacuuaacucuggucugccuuggaccagagugcuuugauucuuuuuuaaaaauaucugugauucguuacuuuggggcuaggagggcgugugguuaaguacuauugcaagaaucuguaagcugcccggcgcgguggcucaugccuguaaucccagcacuuugggaggcggguggaucacuugaggucaggaguucgagaccagucugggcaacacggcgaagcccugucucuacuaaaaauagaaaaaauuagcugggcgggguggcacccgccuguaaucccagcuacucaggaagcugaggcacgagaauggcuugaaccuggcggagguuacagugagaucaugccacugcacuccagccugggugacagagccagacucugucucaaaaaaaaaaaagaaaagaaaagaaaggaaaaaaaacuguaagcuaugaugaaccccuuaggaaaaugcauucaauuuuccauucaucaugacaggauucaagaaucucuagcuuaaguagacaagguuauagaaucucaagucauauuuuuuuucuucuuugguagguuuuaggguaccuugcugaaaugauuuauccuuucacccuuuuauucuguaguuaacuuaaaggcauuuaguucaaacagcauuguggaguuaaaaccaaauucauugaaagguuacuucacuuauauuuugccauuuucuugcucuggaauaucccagcucugccauuuucuggcccuaugauuuuggguaaaguaucucugugccacaguuuuccucuuuguaaaaugaggauuuauaauaguaucuauuccauaguauuguuguaagaauuuaauguaaggcuagagaacauugcuauauacuuggucagcugccaaaugugaacuaucaguaacauaucagauauuauuuuuagguaaaguuuuuuuuucucuaagcaacaaaaagggaccccugcccccaaccgucuuuuucuuuccaaguucccuuugugauucuguaucuuguccugagcaggagaagugcauggacaagccugggccaaaguuggacagucgggcugaggccuguuuugugaacugcguugagcgcuucauugauacaagccaguucaucuugaaucgacuggaacagacccagaaauccaagccaguuuucucagaaagccuuucugacugaucucagcauuaccucuuuggaaaaggaagguaguucaagaaaugaagagcuguugaugggaugauugaagaaacagcuaugagaggauuggcucccaucuuuuguuacucuugggacauccugucaucugagaaugaacaaagaccaauuuuuugugugugaagcuuaagggucauauguuugcuuguauuuuuuaaugcuaaucuugugaaaauaauugacaggcgaaagaaaacucuauuuagaugcauauuacuguacaugggacuaugcuuuucucaaagccccauuaacugcuuccuauaauuuugauagugggaccacauacguaaaaaucucucauuuguguggagucauuucugauuucaggggagauccuuguguuuaucagaaagggcagaaguaggggaagaauaauuugguauccuuaucuaguguuugauugucaaugcuggagaaaaauaucuguaagaguguuuauacaguacacuucaguuaucuugaucucccuuuccuauaugaugauuugcuuaaauauccauauuaaguaagucucaagguaggguaggcagccugagagucuagaggccuuuaguuauaaaggaaucuagccagugaacauaauucuuauuacuagacugccacaaggaagaaauuaacuuacccuguauaucaggguacaaaaaauucagugaugugccuaaauaaguuauaaagauuuaggccaaucagaagcuaacagcaguuucagguagaggugcaugccuaauguuaguuaguguagauuccauuuacugcauucuucugaucacugaaauaaaagcuauauaagauucaa

SEQ ID NO: 16203 - RNA, 3070 nt, Homo sapiens
uugaaucuuauauagcuuuuauuucagugaucagaagaaugcaguaaauggaaucuacacuaacuaacauuaggcaugcaccucuaccugaaacugcuguuagcuucugauuggccuaaaucuuuauaacuuauuuaggcacaucacugaauuuuuuguacccugauauacaggguaaguuaauuucuuccuuguggcagucuaguaauaagaauuauguucacuggcuagauuccuuuauaacuaaaggccucuagacucucaggcugccuacccuaccuugagacuuacuuaauauggauauuuaagcaaaucaucauauaggaaagggagaucaagauaacugaaguguacuguauaaacacucuuacagauauuuuucuccagcauugacaaucaaacacuagauaaggauaccaaauuauucuuccccuacuucugcccuuucugauaaacacaaggaucuccccugaaaucagaaaugacuccacacaaaugagagauuuuuacguauguggucccacuaucaaaauuauaggaagcaguuaauggggcuuugagaaaagcauagucccauguacaguaauaugcaucuaaauagaguuuucuuucgccugucaauuauuuucacaagauuagcauuaaaaaauacaagcaaacauaugacccuuaagcuucacacacaaaaaauuggucuuuguucauucucagaugacaggaugucccaagaguaacaaaagaugggagccaauccucucauagcuguuucuucaaucaucccaucaacagcucuucauuucuugaacuaccuuccuuuuccaaagagguaaugcugagaucagucagaaaggcuuucugagaaaacuggcuuggauuucugggucuguuccagucgauucaagaugaacuggcuuguaucaaugaagcgcucaacgcaguucacaaaacaggccucagcccgacuguccaacuuuggcccaggcuuguccaugcacuucuccugcucaggacaagauacagaaucacaaagggaacuuggaaagaaaaagacgguugggggcaggggucccuuuuuguugcuuagagaaaaaaaaacuuuaccuaaaaauaauaucugauauguuacugauaguucacauuuggcagcugaccaaguauauagcaauguucucuagccuuacauuaaauucuuacaacaauacuauggaauagauacuauuauaaauccucauuuuacaaagaggaaaacuguggcacagagauacuuuacccaaaaucauagggccagaaaauggcagagcugggauauuccagagcaagaaaauggcaaaauauaagugaaguaaccuuucaaugaauuugguuuuaacuccacaaugcuguuugaacuaaaugccuuuaaguuaacuacagaauaaaagggugaaaggauaaaucauuucagcaagguacccuaaaaccuaccaaagaagaaaaaaaauaugacuugagauucuauaaccuugucuacuuaagcuagagauucuugaauccugucaugaugaauggaaaauugaaugcauuuuccuaagggguucaucauagcuuacaguuuuuuuuccuuucuuuucuuuucuuuuuuuuuuuugagacagagucuggcucugucacccaggcuggagugcaguggcaugaucucacuguaaccuccgccagguucaagccauucucgugccucagcuuccugaguagcugggauuacaggcgggugccaccccgcccagcuaauuuuuucuauuuuuaguagagacagggcuucgccguguugcccagacuggucucgaacuccugaccucaagugauccacccgccucccaaagugcugggauuacaggcaugagccaccgcgccgggcagcuuacagauucuugcaauaguacuuaaccacacgcccuccuagccccaaaguaacgaaucacagauauuuuuaaaaaagaaucaaagcacucugguccaaggcagaccagaguuaaguaagcaucugguaggugucauaguccagcaauacuguaaguuuaugggaaagggccuauggaaaccaaugacuguauauaguucaaguuaagugguucaaaaauuucguucauuauucucugccauguacacaagccucagacccucuaauuccaaggaaaauuauccuuggccucugaauucugugaauuguguacauuaagggagaucuguccuuggcaagcagaacacguuguuggcaagcugcaaauaccuuccacccuuuugccaaaguccccucacagggcaggcucaauuccucaaccuucagacccaaaacggcuugguauuacacaacaauccaacaagaaagcaaauaaguauguacguuggaagagauuacaccacuuuuauaguuacugggcuggagccacucauuuuucagcggagaggguuagaacuggguaaugaagguaaaucccgaggaguccaggaauagcagauucacugauucacugacucucugggacucgggcugccaaaaauaaaaucccaguacugggggcuccgaucagucuuggugaccagcacuaggcagcuucaaccucgggugccugaaagugcuggguguccaguggcauaagucuucuuugauacccaguccucuacaccaacaaagccgagguccggaaugacaguccccagagaagcggagucacccuucucccauccggcuaggccacaggaaccugagaaaaucaaggguugcugccaggugcccgccccccaccccgaauccccgacguugucgcgagucccgcgguacaaggacagagggaaaguagguacaguguucaggucccagccccaggcuccucacccaacaaaguucagucaucuggugcaccagcugcuggaagcgcugcuuuugagucucuaccucgaugaaaugcugcaacugcggguccacugcacccaaacccgccgcggaggaagaggaggaggaauccaucccagggcgaccaagcuugcagagacgaacuccgcaccgaccuucacgugucuccgcgacggaacc
